United States Patent 11,180,807 (METHODS FOR DETECTING A GENETIC VARIATION IN ATTRACTIN-LIKE 1 (ATRNL1) GENE IN SUBJECT WITH PARKINSON'S DISEASE) - sequence listing, part 57

SEQ ID NO: 839 - DNA, 120225 bp, Homo sapiens
cgcaccgggcatgctcagtggcgcggccggctgggtggcccgcgagctgcacccggatctgctcggcggcggcgacgtgagcgcgcaggggggcggcggcctcgcctcgtctctctctctgcgcctgggtcgggtgggtgacgccgagagccagagagatgtcggatttcgacagtaacccgtttgccgacccggatctcaacaatcccttcaaggtgagcttcggccccagcatctcctgccgccgcgacgcgtcgttgtttgtgaaaacggacgagttccttcgcgcccactgcgtctgcccctcggctccccttagcagcccagagaggggcgcggggccgccgtcctccatttggggtcgcgccccggccccgtgtcactcctttgggttttggggcttgggggtggaacctcctcagctcgtgcccggtcgcccttccacacgtccccgactggtgagggtcgtgtctgcagccgggactgggcccgcgcgcccggaggggtcctggcccgcctctcaggagagaaagccgagggcaggtagagtcgccccttgccaagcaagtgtggctggcagggccgggagtcggcggaggggggcccgccctggggtggggttgtcatggggacccgaggtggcggcggcggagagctgcgtggggtgatggcagaggtgtggaggaggagagaggtgagggcaccgagtatgctgcaattaaaaaaaaaaaggttatgtttttattttttaaacttgtgttgcacccaaataccaccagtggcgctgccatcccccctctttctgttaggttgaggttgaggttattgataccaaagcaaaacttaaaaataaacatatctggaaaacaatagtgcacgtggacgacctcttccctacccagctgcttctagcaaggtaaacgatgggatattttccaagctcctagtgcgtcaccggttctctgggctatgtgaggataccatttcctacttgagctgcttttcttcttggagtcgaccttatcaaccccggcttcggaagggcttggcacagaatcctgcaaaggaaggcggctgagatattcatcgtctgcgtttaaatgaatgcaacatctaaataactctctctttgaaagtattctgaatttcctaatgagtgtaactgttagcacgtgtaatttgtttccaactgttggttgaagttgtttctcaatccccccggccatgtgcagtagtaactttaatttgcagtcacacagaataaaacaggaactctaatttgtggtcacacaagtgtcacttctggcttgttgagtttacatctttttactcctggttttatctttcattaagaatcctggaagaggaaaactatttctgctctgattattaaatgcctgataattccaaggaggattattttaatgaaatgaccctgattattattgacaactcgactcactttgtagcagtgtagaattagactcagtcactgtttcattgtccctaatgtcacttaaaattcagtacaactggcctgtacctttcagtgacatggttgcattttaagacttttttttttttcctggcagttttgtttcaattagtattggacttgcttccatgttgtggaaaatcaggtagttcttaaatggtagactttctaaagagaccgttcataaattgttaaatgggtgttattttaaaatattttgaagataaaacatcaagaaccttttagcctttcctaattcagataattcactgacgctgtttattcagcatctgacgatttggcagtgtattttctacttggtcattccatttcatggttcatttcatattaactggctctcttgttagggcaaaacattgtcttcatcttagcccagactgtccttttgtgacatctgatattgccatgacacttttcctcttctgacattcataaagttgctgtagtaattctaaacccaggagttgttttaaatattcattgtggcataacgttataaatcttttttgttcttttataagtggatgtatccaggacaatgattattcaagtttgtaaaatgcatcagggacagatcatttaggtctaaagtagacttggttgtacacatatttctgcttatgatctttctctgtttttggtgactgttatagcactgtcagtgtatctgaccctttatttttccatttatgttcacctgcccctcctcctcacaaagtatagttttatatctatattttgtctttttacttctgcttatatttatgtaaaagtgatttttgaaataacatttctgatactctacttaaatctgaaatgtttctagaatcatttgagttactttatgatcatttttctttttttactttttttttttttttgagacggagtcttgcactgttgccccggctggagtgcaatggcgtgatctcaactcaccacaacctctgcctcccgtgttcaagtgattctcctgcctcaacctccctagtagctggtattacaggtgcccgccaccacacccggctaattctttgtatttttagtagagacagggtttcattgtattggccaggctggtcttgaactcctgacctcgtgatccacctgcctcagtctcccaaagtgctgggattacgggcgggagccactgcgttcaagcagatcgtttttctttctttctttctttctttttttttttgagacggagtctccctctgtcgcccaggttggagtgcagtggcgcgatctctgctcactgcaagcgctgcctcctgggttcacaccattctcctgcctcagactcccaagtagctgggactacaggcgcccgccaccaccggctgattttttgtatttttagtagagacggggtttcaccgtgttagccaggatggtctcgatctcctgacctcgtgatctacccgccttggcctcccaaagtgctgggattacaggcgtgaaccactgggcccgacccatttttcaaatctgtttttatttgcagtatttgaagataaagctcttattttcaagtatatgatatttcgcatttggtaactatgctaatttctttttcattaaatcctatttgttttccattgcctttttcattttttagcatttcttttccttcacttttatgttaggaatacttctgcaagcatcttcgtttgtgccgtatcatgaaagtagtttgagtctattctccttatataatataaccatagtggtttacttgattttattggttcttgtaaggctatttgctggattcagttcatttttttttgttgagcccctgctttatattctagtggttttcctaggcttagtgaatggttttatgaaatttgaatggctttcattgcgcatcaagaaacttggaataactggaaatctgtagtgatcgaaaagaaaataggtgattaattatatagaagtttctgaggatccactcttgagctgttaaaatggggttttaaagctatagagggaaaaatattttctgtatagtcaacatgtaattattgaagaattgctgtatgtcctttgttttctgttgagtttattcattcaacaaatactgaagaagtgtctctgtccttatggctattagtctaacagtgagacaaatatgcttggaaaatgaatgaaaggggagagtttaataaccagcagaggtcagcaatataggctcttacaagtcagcataagagtgtatggttaagtgccggaacaagtgcagtttgttcataaaaggaagaaattagtaagtggtcagaaaattttcatgctttatgcttttgcatattaacatgataattgattgaataagatagttcattatggaaataacatttaaattaatttttaaaatatgaagagaattagaatttcacagctgggggggcaaattcttaaaatatattcagtcagatctcatagattaaaaaacaaagcccacagaggcacacttgctcattgtcttgtgcccatgtgtaggtagtgtagaattggcattagaacttaggtctcctgatttctagtccattactggtgacactgtatgtgctccctggttgcattttgataccaaaattcttgttttgtatttggaggttagagttgaggggaggcagcagaggataggattaaaaaattttggctcaagaatttgaaaagatctgggcttgatcctggctttgacactaactggttgtgagaccttggaaagttacttaacctctttcagactcagtttactcatcgcgtgttctcactcataggtgggaattgaataatgagaacacttggacacagggtggggaacatcacacaccggggtctgtcatggggtggggggaggggagaaggataggagatatacctaatgtaaatgacgagttaatgggtgcagcacaccaacatggcacatgtatacatatgtaacctgtacgttgtgcacatgtaccctagaagtattaaaaaagaaagactcagtttactattttgtaaaatagggtaatagtacattctctataggattgtaaataggattagatgaacatacatttagcatatagtaagagcttaatgtatagtggttttaattaggtactaatatttagtattaatagtaatttaagaaattctgtttaatggccaggcgcagtggctcacgcctgtaatcccagcactttgggaggctgaggcgggcgaatcacgaggtcaggagttcgagaccagcctggccaacatggtgaaaccccgtctctaccaaaaacacaaaaaattagcttggcgtggtggcgggcacctgtaatcccagctacttgggaggctgaggcaggagaattgcttgaacctgggaggtggaggttgcagtgagctgagatggcaccactgcactccagcctgggcgacagtgcgagactcatctcaaaaaaaaaaaaaaaaaaaaaaaaaagttctgtttaataatctctatatgcttagctatgaatttagtgaaatttatgttacttttggatcttctggagtgctggtagtagctgtttgactgatcatagtcaaggaatcaaagctaaaaataattaagtgctttgcctacatcaacctgctagactagaccaaggttgtctgaattctggtgctttttcacaacacgtagttcctccctaataaaatatctccatgttaaaattgagcatagtgtccattttgttttggcctcaaaaattaattttagtctattgaaattttttttagaaatggcctaaaattcagcattctcacttatgttatcttttaagttacagtaatctggtggcattgtaagagttgaaatttaaaattgaaaatgacccataattcaagtgtgttattcatttgtcttagtctgtttgggctgctgtaacaaagtatagtacctcacagtgggtaatttataaacaacagaaatttattgcccagaactctggaggctaggaagtccaagatcaaggtcccagcagattcagtgtatggtgagtccttttcctcattgatggcatcttctttgtgtcctcacatggcagaaggggatggcagctctttggggcccttttcttttcttttcttttttttttttgagacggagtcttgctctgtcgcccaggctggagtgcaggggtgccatctcggctcactgcaacctccatctcctgggttcaagcgattcccctacctcagcctcccgagtagctgggattataggtgcatgccaccatgcccagctaatttttgtatttttagtagagacggagtttcactatgttggccaggctggccttgaactcttggcctcaagtgatccacctgcctcagccttccagagtgctgggattacaggtgtatgccaccacacttggcctctgggtcctttttttaatagggatattaatcccattcttgagagcagagccctgctgacctagtcacctcacaaagtcttcaccttctgataccatcacgttggtgataggtttcagcatgtgatttttaaggaaacaaacgttcagaccttagttttcattttgtaacatcaagaatgttatccatcttatttcatttaccttgacaatgatacttacaagttgatttcactcctcccttatctgtttaaaattttgaggctgagcttgatagctcatgcttgtaatcccagtgctttgggaagccaaggcaggaggattgcttgaacccaagagtttgagaccagcctgggcaacatagtgagacttccatctctactaaaatttaaaagttagctgggtgtggtggtgcacacctgtaatctaagctacttgggaggctgaggcgggagggtgacagagtgagaccctgtctcaaaaaaaaaaaaaaaaacccaaaaaacaaacaaaaaaaagatataaaattttgagtttggagattggatagcactaggaaagtattctgaggatttcctttgtgattgtcacattttgaaaactgtcttttaacattaatctggaacatagtggttgcagtttgtgggcctgtgttattttacgttcatgtcaactgcatgaattcctgctcatttttcctcatgttaatgtttttaaaaagcacatattgagctgctgttatatttcatcaacttaagatgccatcctttgtaagatgcaccattatcttatttaccactgtctcacttatctgttgctatgtaacaatcccaaaatataatggcttaaaataacaattatttgctcacgattctgttaattgcgctagacttagctgggcaggttttttcttttttttaatgttcttttctggagtcactaaagtggcttcagtcacctggtttatggtttcagatatccttactcaagtgcctgctggttacctggagatgtcagtgggcacagcaattagctgtctttcatgtagcctctctactagtaataaatgggctttgtgcatagtagcagcagtgctcccagagggcaagagctgaatctacaaggcttcttgaatcatatgctacttctgctgtattctgttggtcaaaacaaggcacaagttcagcctagattttaaaaggagtggcaagcaataggctccacttcttgactggagacagacctatgatctgaagatacacctagtataaaatggcgaggtagtcgtaggataacttcactagacactcccattcaaatagggaaagagtgggaggcgtgtagcacctgctgatgcatagcagttctgaaatctagccaggcacgtgttgttagggtcccctacattggggacaatgaatgtttcttgattagggcccagttctgctacctcgtattggttccttcacctgttattttcttctgcttttggctccaccctctgagaggtcctttatttatttttttctataagaatgagcccttttggcagctgagtagcatttttggcctgcttcttgcccattgaaaattgggagcccagaagtttctattaattttgaactgtttctttagtccaggctgtcacaactctcttaacagtttctttttaatcttaccagagttcaaaccatgccttaaaaaccacatttgtcattctttttgagacaatcttcatttagggtgaagtgtccgttgccatggtcggtattcttcagatgtttagaaaacttttgtctaggttgagcatctcatatggccaggggaaggctgctgccataggaggctgctgtgccacgtgacaaaactaagatttgaacacagttttattttggccctgtagctttacagtcatatgagatgatggtgattatgaaaatttcgaaagtaaactgttcttgtgctgatattaccaaaagttttttttggactatgattaatatttaatagtgataaatgcagatccaaataatttattggttatttccttaatatgaaccaccagtgtgatatagttgctgaaaaatatatattggcttagtgaaattagtgatcagttccttaaaattaataatcctatagtattctgttctggtctaatagctgggtattcttctcaattgcaagtgcatatttaaagagtggtttgaaaatactaggatatgcccaaagaggacagtcagaatggtcatgggactggaatcaagttctaggaagaacaatttaagtttcaattactcagtggatttagtctacagagggctaaagggaaataggagagctcccatcagatacttaaagtgttcttaggtaagtgaataaacttgttatttgttgctttagaaaaagaatctaaggttaactggcaaagtttacttgaaggtaaaggtaaattttgtccaaacagacttttaaaaatctgctaccatggcctgacaatgctcttttggtagggcattctccagcacttgcagaaattcaagcagaagttggataacctacagagatgcctaatttcaatattgtaatgtctcagggaatagggagacccaaggagagggacagagaatgggaacaactggttggtggaatagtcaggacacacaattttttttttttttttgagacagggtctctctctgtctccaaggctggagtgcagtggcgtgatctcggctcactgcaacctccaccacgcaggttcaagcgattttcctgccttagcctcccgagtagctgggactataggcgtgcaccgccacacctggttactttttgtatttttagtagagacggggtttcaccatgttggccaggctggtctccaactcctgacctcaggtgatctgcctgccttggcctcccaaagtgctgggattacaagcgtgagtcatcgtgcccggccaggacacataacatttatcaagtaagtttgcagtgttatgggcatggtttgtggcaccccaagacaattacagtagtaacatcaagtatcactgatcacagatcaccatagcagacataatgataatgaaaaagtttgcaatattgcgaatactaccgtagtgtgacgctagagatgtgaagtgagcacatgctgttgggaaaatggtgctgcgagacttgcttgatgcagggttgccacaaaccttcaatttatttttttaaaaaaggcaatatctgtgaagtacagtgaaactaggtattcctgcattttctctgttctaatatatcgaccatattggatattggaattaagtatgatcagttcagctagagaggatgctttatgttcagagaccagctatgctctgagcctcagcttctgctgagggagcagccctcatggtagcttacacatttgtgatcatgtcctctagggtgtgacttttgccaccctggcctcagctgactgatcttaacaaaggtacttgtccaaagcagtggaatagcagttatctcactaggcttttgaaggccattttcaagaattcctgtccttcattagaggtgttttttaactagaagggatgtgccatgtcatgaagaatttcaatctctgtgaaacctggcgttcttctttctgtatatatctttaaaatattctcctgctcccagcatttggggtgacctgagtgagtctgtctgtttcaaccagaattgctaaaccgtaagtgtaaagtaacattttcttgccaaaagggtgatagagttaagcctgtatttagacctacagtttttggtggtgtagtggagtaatatacttgcaaatattgtaagatgtttttaaatcacaagggagaattttccaactttcagtgggtgtgggatataaaaggtgacatggagtttggttagatttaaccttgtaacaagtctctgagttgttcctactgaggcagtctgtaatgtcctgcagcgtttgacttcatatgtgtagactggtgtggaaaaccctgttctcctttctgtgcagaaggcttgcagatctatacccagagagcaatccagtaatccccttctccttggcatttggctttgggtgcttttcagaattagtaatgtttctttatccattgctggacacctaagttgtttctgttttttgtctattacagataatgtgtctataaacattcctgtacaagtgttctgtttgatcacctgttttaaattcttttggggatatatacctacaagtggaattgcctagtcatatggtaactctgtttaatcatggaggagcttccagacccttttccaaagtggctgtaccattttatattcctgctagcagtgtatgggtatgtagatttctctacatctttgttaacacttgctattacctgttttttattctagtcatcctagtgggggtgaagtggtatcttgtggttttgatttgcagtctgctgataactaatgatgttgagaatcttctcatttgcttattgacatttgcatattttctttgatgtctgttcagatcctttggctattcttagattgggttatttgtcttttttattattgagttataagagtttttatatatcctggatacatacctttatcaggtatgtgatttgtgactttttttcccattttctgggttgtctttttactttcttgataacatcttttgaagcacaaaagcttttaattgtgttaagttcaaattacctattttttgttgttggtgttttagtgtcacatctaagaatcctttgccaaatctgaggtaaagaaggtttatccctatgttttcttcaaagagttttatagttttagctgttgaatttaggtctatgattcattttgagttaatttttgtatttggtatgacgtaaggtcaactttattgttttgcatgtggttataatggttgttccagcaccatttgttgaaaagattgttcagtccccattgaatgatcttggcacacttgtcaaaaatctcagtattcttaatctgtgttcttgcaaaggagatgaaatattttatctgaaaaagccctcatatttcatgcaaaaatgccttgcaaatacctggtagtcaccaggttttctgagtatatattaacttgtccggcttctaaaattgccagagctacttttgcaactgcttctaagtctttgcatactttaatgcttaaaaacaaatttaatagcaggttttacacttggttttagaatgtaattatgaacacattgtcagtattaccaacttgatatgtttccttttttaaaaaataaatgcttccttaaaagaaatacttccatttattttacagaatacagttgaattaaataatacatttttgcatttaagcagaaacactggaaccccttaaactcttaaagcaaaggatatgcgtatagtgtaaagcgttatgcattttgagtattgctgaaatcaaattaggaaggagggatttgtgatagttatacattgataattataacttgattgatagtagaagaaaacacaaaacatttgaatgcaaataatttagtatatatagctattaaagatgtttgcttctcaaacacagtgaaaacaatgcatagtgtagaagcattctgtacgtaacaaatactttaagttctcactttcttcaagagaaataagctgtggctgtgttatatacatgctaacggcagccatttaatctgtggaaatcctctaatggtggttagaattcttatatgataatttgggatatatggagagcactgtcaagtgaaagtggtaggtaatgggaaaagagcatcaggagtattggccagtcatggccaggagttggtaaactaggtgtaattttaccaccatttggcactttttcttataaacaaattctaaatggtggttaagcttcccaggccagtgcttacaattgtagtatgtagcaccaaacccaagcattctctacagtaatgtacccaaagagggggaaggttcatttgtgatatcagggattcatcccctgctagcctaccatgacattgaaaagtaatcataaccttaaaaactaatagctcagatattaaaaaaaaaaattagatgtctttttcaaaaatctccaagcaagtgcacaactctccaacatttgtatgaaacctacatcacaaggtgatttgtcataacaataaaaggagttcttcttactgttatcctcacttcaagtcatgatatataatagcttctaaaatccctgagcttggtaaggcaactagtaatttgcatgtcttgtttttgtttctatttatgttaataccaaaaagtttgaaagttaataaaaaatcagagcctgctttagaaaatacaggcaacttggggtaaaataaataataattacatgttgcaacaaaagataatcttgcattattatttattttctttatctgttatttaaaaagattcccatctttttttctgattcaaaaggaaaactcctggaactattaatataagaaacataacaacaacaataactaaatactgaagttagaaaaattaatttgcctgtggtcacctagctaggaggtagagaagcaaaccttaagcagtgtggttccagagcccaccttcttaccttctcccctctgctagtggaatacaaacctctgcaaatttcacttactccttcttcttatctccctgacaccaggctaagaacacagaaatgtttgcctgcagtatgtatagtttatagaactttatcttatgaactgaactctaagtggtggtgaagttcccctgagattcagctataaacatttccattaaaaatgtttatattaaatagaaaaagcatgtattactactttcaagctttgggaatacattaatttgcatttttgcaatatgctacttaccttaggcttgctacatccaatataaaaccacagagactgactaactcaacctaaaacaagcatccctagctgtaggaaagttgctatgtaggaaagttgccacatggggataaaattacacctctattttttaaatctttcttaaggatttactatccatgtaagacatgtttatattctctaaatgttcagttctttgccctactgattgctttaagacgtaatttggtttcttgccactgctctatctttaggcatattatctttttttgactatagttcagtcagaacatgttttcatgtagttcctatagctcagatatggtactacaaaatagagtgtgaaatttggactagcaggactgcctttacctctatggtatctgataacatttggtatctaattcttttgccagtggaccatctaatttctgttattttggttagtgagtttgagtggacctaatggtataatttgaaaaacaaacaaaacatattctcagtctttatcaaccattatatttaaaatggagagcttgccagtttaataggtctttatggttatttaaaattttatataattactgtgactgcattggagattaaagtggaccaaactcaattgtctccaagagattatcatcattgaagatggagtaagagtaggttatttagtaacgtatatgaaactcccaaaaatcagatgctgtgatagtcacttgggatacaagataaagagaattttctgatgtcaaataatccacactttagttgggagatataatgtgtgataaatgctttgatgctaacaaaacaagaataacatgttcttcatattgcagaaacagaacttcctgagaagatgaggcctgaactatcttagagcctcagttcccctaaatgcagaatctgaggcagaaggcatatgtgttgttatacttcacttctctcattttataggtagggaaattcggacacagaagttaatttttctaagtttactcaggagtgacaggacttggaataaaattgtttcatggaattgcttcaataagggtaaggataatgtgagaaataatttctcatagcaattgcttaaaagtgctgctggcaatataaaatgaaacaaaaaaaggaccagacctctcaatgtcattttggctgtaagctaagaaactagaatttcttgttttctatattatttaggttcattacatttattattaattatctgcaggaaatttttaccaaattatattcacaaattatgtttgtttccaaagaaatctttctctagaatctatagagtgtactcgataatcaaacagatgcctacttaggaggtaagttggcttgggcatgattgctttagttaagtttctaatttactaaggactgatttgggtctataaacataagtgagtttcttttagatttgagtaagactgttacgacccttgccatgatatgaatttttcaaaatcatgatttattgaataattcctagtgattattaagcacgtatcacagttataaaagtttcgctaaatacacttgtcttagagtcttgttgagagatttttaatggcttttcctagctcctttttaaaaaaagtggggcatttagaaactgtagtactcttccaggtgagtgaatttgttagtatttattaaattcatatgattatagtaactctgagaattatggagtaggggaaaaattgaactcaggggagggcctctcagcttggggcatttcttgtttaatcaaattgtctagtgtaagtgtatagtcttgactgaaccaagcagagctattgaagagtattttaattacattttatagagcagcacaatatttattctttttcttctgaggaaatatagttttgaacataaatttctttattgcattttcttccaacaacttggtctttggatttagatttggatttgaatcctgaccatgtcacttattatatgactttgggcaaattactaaaacatctctaagtcagtattctcagcagtgaaagaaaagatacagaacccaagtcataaagctcttctgaggattacatgaaataattaagagtctggtatcatgctaacctagatgaattttctttctctctttgaatctgtagccttcaatttcccattggcttccttgatagaactataaatgtgcattttcttataaatgtttaatatattcaaaataataccttatatctcatgaaaaagtgtgaaggaactaatggtgaaaatctgctactgtgttatataaaaatactggactggaaagattctaatcatgtctcttgtcatcctttgtaattttgaaaaacttagaggaaatttaagtctagtttgtcatatttctttttgctaacataattgaatttgtccaaatggacaaaagtgaaattattctatgagccagtcttgaataagttgtagtgcctggatcagtactgtccaatagaaatataatttctgccgcatatgcaatttaaaattttctagtagccatattagaaaaaaaggaaaaaccaagtgaacttaattgtaatacattttattttactccatataaagaatcttatttcaacacctaatcaatataaatgttgcaggaagtcagggaccccgactgttcatacaccccctccccttttgaaatccttaataaaaacctgctggttttgaggctcaggggggcatcacggtcctaccgatatgtgatgtcatccctggtggcccagctgttaaattcctctctttatactgtctctctttatttctagccggccgacacttatgaaaaatagaacttacgttgaaatattgggggtgggttcccccgatatataaaaattagagatattttacattgttttgctaaatctttgaaattgaaaatctaatgtattttatacttttagcacatctcaattggactacattttaagagctacatgtggctggtggctaccatatttacaggtagcacaggtgtatagcacatctataaaatgcattactacaacagtagatggcttttgcacactgtaggatgtgtgtgataaacgaatgtcatttattattgccggtctaaagtttgtctccagttcttagcagtcacttaatggtgagaatttacctgtcattgcaatctgttcaataaatgatttcgccagttttcattgcccattcccaagtatttaaaaatttcaaaggcctcaaatatatctacttcacattaattatatctgtaggaatgacatgaaaaggtttgtattttgaaaagctgattctggcttattatgaagaatagattggcatggggtcggaggatagggagggaagaccagtaaggagttcattgccattgacacatgagaaatactggcagattgatctctggggtggaggagggatttttttgtttgtttgttttttgttttgcttgtgtgcattttaaagatgatcaagacttgaaatgtgaggtatcttgctgggaagaagcagttgaacatatgagagaaaaggataattgacagggtgatcctaagaaaagttaggaggagattaagcttagatatgaagaagattttcccccctaccttgggggaaaggcttcctccttgcttttccttccctcctcttttttgcttcccttttcctttttttcccctaacctctagacaatgtgggaggtaaggaaaaaaaaagctgaggcccttctgatgatctgcaggacattgtgaaaacttctgtaacacaaagtcatttctcaccagttaaaataacagtaaccatatttattggctctgtttttgctttggtgactcattggcaactctagtaattgctgttcccctcagatgctttacctgctgctctctgctcccttttctggccaccttcctataacttagcttctgtttgtcactctttctaccatggctgttgtcagcttctactgctgctgttatagttcccaattttatgtctcatattcagtctcctcaaaaatgggaataggattggattgattagcagttagtcagtaccgagttgcttctgttgggcctgccaggtttcctcgtgtccaattctaaagatagttgcctttggcacagaggccagtttcttattcttagttatgtagccaagttaatagggtcacgtgacacaaagattgggcaaagaactgcttctggttgctttccttagaacatattttaaggaaacacaggtgggtattttttgtcctattcattacctaatatttgctatactttttacaattctcagttagccataggtggagagcttttttgcttgatccttaacttactgttggtggtaatgatgatagcagcctcacctgtcacttatttgagtctttcccatgtgtggaaactatattaagcactttacatgtagtaactcatgaattatatgatacattttactgatgaaaaaactgaggtacagtgaaatacgaagtgacttgttcaaagtttatagcttcttagtaatggaactggaatttgaatacaggcagccagcaatccgtagcataacatttctgaactatgggtgaccattgtgattatcaaatttccccttaattttgaagatgagaaaatcgagagagtttgagtgacttgcctgatgtcacagtattggtcgttaccaggtgctcagtttctgattcctagactagtgcttttttctgctacagaacaagtacccaggacatagaaggttttggatactaatcatgaaacccaagcctgtgttagcagatatcatagtaagtgtatatataatgtatagctgtacaataatcatccatgtagatttttatgttattagactactatttagcttaaaaatgacatatgtacagagagaaataaacaggagactgagcttgattagttatataagttgattgagtcaatctccttatttccagcaggtgaaagcactgtctcccaggttgcatctttcaggttatgtgtggcagtgattaagaaatatccaatacaatgcatggtgtaggagagcatttggaatacagtgaaggttcattcctctggagaatttggtagagaaacctagtattgaagatataaactaattgtgctagatgtaaacttttattctcttgtttggaaaaacatttgttttcatatccatattgatattttagtgaaatatgaagtaaacactgtgaagtaacactgtaaagttaagtggcattactagagtattgacagagtagccttggcttaactaatgatgtaaagatataactctaatgtctatgcatagtcagatccacatgatatttaaattaaactctgaagaatatctttacttgctacttagaagttaataaaatacagaagccaagtatgatcctctaagtcaacaaaataagactatctgagaatcttttccttattagaaatataaattctcaggcatcatcccagacctactgaatcagaaacaaggtacgttcagagtgacgctcagcaatctggattttacaagccctccaggtgaccgcaatgcgtgctgaagtttgagaaccacagccaaagaagaaaccaaattatcagttgaaataattttattttgattatgttggagaagaagaataacattttcctgccacagttttggaattattaataaggaattaggaattggaaagtcctagtttaatttttgtctcagacatgcactaattgatcttaaggaagtttcctgaccttgtttaaggccacagcttctttctctgaaaaatagaatgatacagtctaccaggaaagatcatagcaaagattggaaataaaagtaaatgtaaaagtaaatgctgaatacttagtaggcgtcaatatcatttatcgttacttaattctttttcagttttgttgtcttctcccaggttagagactatggcttcctcaacactacagttgctaaagctaatttgaaacattaattatgtaataattcagagatatcagttctttaccttcctaaatctagtgtcattcttggtatattgtgtacatgctttaatgctttgtcatctaatactgcattaggagagtgaactcagttcacttgagaaaatgattttatcaaattgcctgttaacttctagccaggattaaatttctagaatctagaaggaaacaagtgcactttagtcactgtagttgaaagtagaaaattggaagaatgattttagtctctttggaactaagttataccttatttatttattggcttttaaaagtatttaaggtgaattttagcacactcaagataattagatgtgtgtatttgtaaagtgagagttggactcgtacttctgtggcactgagagaatgacgttgatagcgtgaatgttggctaagcaggattcatctttctgatcctacattctatctccctccttttttctttttgagttaattttgttttgtaattacgaaaacatttcatggttccaaagtagaggctataaaacaatgtaaaattaagtctagcttcgaagtctatcatttttattagtttttggattactcttccttttaaaaaacataaacacacattcatttttatctgccttttgcaccaaagcttaacatttgtttacactcctctgcaccttgcttttttcactcagcccatagcacttttatatctccttataccattttacaactgcataatgatactcagctgcatagtactttatcatgtagattgtcatggtttattcagtcatcttctatttatatatatttaggttgcttccagtcgattaattagtgtgatgcttccatgtggttacaaatagaattttgctgatatttctttggagtaggttcctagaagtgagactgtgggtcaaaggataaatgcagatgttattttgctaggtattgccaacttgccctccataaaggttgtaacagtctttattcccattagcaatgcatgagaatgcctgcttccttacagctttgtcagtagagtatgtcagacttttagattttttgctaatttgataggtgagaaatgattaaatcagtgtagtcttaatgagtgtttcttttatgaatgagattaaacatctttttatttacactttttgaactatctttatgcttattttttttcaagaagtatttattggttactactgctgctattatcttgaagaattactctttgggtatttccccacagaggtggtaataatactcgttgaagaaacagaatatcaccaggcatgtatgattaagaagaaaaaaagatcactgatcacagatcaccacaacagatatagtaaaaacatttgaaggccgggagcggtggctcatgcttgtaatcccagcactttgggaggccgaggcaggtggatcacttgaggccaggagttcaaggccagcctggccaacatggtgaaaccctgtctctactaaaaatacaaaaattagccaggcatggtgacacatgcttgtaatcccagctacttgggagactgaggcaggagaatcacttgaatgggggaggtggaggttgtggtgagctgagatcgtgctacggcacttcagcagcctgggcaacagcaagactccgtctcaaaaaaaaaaaactgtttcttgtttcaaagagttcacagtctaattgggggaagaaaaggcttgcatgaagattatcatcgttcagggaaatcgatgttgatggagctctcataagtgctgtgggaacattgagcgtggagtggagagacttgggtagagggaaggtatcagaaagatcattgcttagcatatgaggtaatatttagactgagcctgtaaggaagaggaagagattgctaggctgaccctgctgggaaaactattctaactagaggaagcaacgcaaaggaagagtataactgatatttgaggactcactggttactggttttgtagatgatggtgagggtaggcattgagactacagctggaccatctggatttgatgaaagtgcttgttgatcctaaactcacttctaaattaggttaactttagcaatgctaagttgaaaattttgattaaaatgacatctttctattttctcaattttctcactgacacatgccttctctcttgataatcttcttgctgcttacacttttgggtaaattttggaggggaaccctgggaaagtaagtggagtgatttcattccctctttcccattttactgttgagcaagactaaagcctttatgttttgtctgtgtcatacttttaatttatccttactacttgctttatgccaaatttgaggctccttattcagtaggttgtttcatttggttaagggagaaagatgtttctcatatgaatttataaggctggaaaaataggcaggctagatggttagaagccttgtatctcattttaaggaatttgtgttttgttttatagtttgtgtagagcctctaaaaatctgaaatggataaaggacagaggaaagaggttggaggaagggaatggcaagaatagctttgcatttttgagaggtaaagaatggctgtgttgaggaaggtgaattggagaaggtacatgtagactaaagagcaaaagtctccagaccagcagaagcagtatcacctgagaaccttttagaaatacaggttttcagaccccaccccagacctactgaatgagaaattctgggggttgggtgcaacactctgtgtcttatttgattttgatgcatactaaagtttgagactagaaattcgaaggttagcctacatgacagtttggaaaatgcttttcatgtgaattatgtagttgacttttgttgatgttcattatgctgagatgttcattataaatgcttttcacatgaattacatagttgattttgttgagatattcattatatgtatatactttatacacacacatacatatactacaattttgtgattcaggtttttaaaaaatttcagtaggtttttggggaacaggtggtgtttggttacatgaataagtttctcactggtgatttctgagattttggtgcacctgtcacccgagcagtgtacactgcacccattatgtagtcttttatccgtcacccaactcccaccctttcccatgagtccctgaagttcattgtatcattcttatgcctttgtgtcctcataacttaactcccacttgtgagaacatacaatgtttggttttccagtcctcagttacttcacttagaataatatctccaattccatccaggttgctgcaaatgccactatttcattccttttcatggctgagtagtattccatggtgtgtgtgtgtgtgtgtgtgtgtgtgtgtgtgtgtgtgtgtgcgccacattttctgtatccactcgttgattgatatgaatttaggctggttccatatttttgcaattgcaaattgtgctgctataaacatgcctgtgcaaatatctttttcatataatgacttcttttcctttggattgatatccaggagtgggattgctggatcaaatggtagatctgcttttagttctttaaggaatttccaccctgttttccatagtgtttgtactagtttacattttcaccaacagtgtaaaagtgttccctttttaccacatccacacaaatatctattattttttgattatggctgtttttgcaggagtaagttggtatcacattgtggttttgctttgcatttccctgataatgagtgatgttgagcatttttcatatgtttatgggccatttgtacatcttcttttaataattgtctattcatgtccttagcccactttttgatgggattgtttttttcatgctgatttgtttgagttccttgtagactctgggtattagtcctttgtcaaatgtatagattgtgaagattttctcctaccctatgtgttgtctgtttgctgattatttcttttgctgtgcacaagctttttagtttaattaagtcccatctattatccttttttgttgttgtgtttgcttttgggttcttggtcataaagtctttccttaagccagtgtcaagaaagatttttccaatgttatgttctagaaattttatggtttcaggtcttagatttaggtctttgatccatcttgagttgatttttgtataaggtgagagatgaggatccggtttcattcttctacatgtggcttgccaatgatcccagcaccatttgttgaatagggtgtcctttctccacattatgtttttgtttgcattatggaagatcagctgacggtaagtatttgggtttatttctgggttctctattccattccattggtctgtgtgcctgtttttataccagtaccatgatcttttggtgactatggccttatggtatagtttgaagtctggtaatgtaatgcctccagttttgtcctttttacttagtcttgctttggctatgtgggctcctttttggttccatatgaatttcaggattgtttttctagttctgtgaagaatgatgatggtattttgatgttaattgcattgaatttgtagattgcttttggcagtatggtcattttcacaatattgattctacccatccatgagcatgggatgtgttttcatttgtttgtgtcatctatgatttctttcagcagtgttctgtacttttccttgtagaggtctttcacctctttggttaggtatattcccaagttttttttctttttttttttttgcagctattttaaaaggggtggagttcttgatttgattcttagattggttgcttttggtatatagtatggctgctgatttgtgtacattaatgttgtacacaaatgttttagtttcctgaaactttgctgaattcatttaccagttctaggagctttttggatgaatcttgagggttttctaggtatatgatcatgtcatcagcaaacagcaatagtttgacttcctctttaccaatttggatgccctttgtttctttttcttgtctaattcctctggctaggacttccagtacggtgtagaatagaagtggtgaaagtgggcatccttgtcttgttccagttcctaagggcaatgctttcaagttttccccgttcagtgtaatgttggctgtaggtttgtcatagatggcttttattaccttaaggtatgtcccttttatgccgattttgctgaggctttttcacaaagggatactggattttgtcaaatgcttttttttgtctattgagatgatcaggtaattcttgtttttaattctgtttatgtggtgtatcacatttattgacttgtggatgttaagccatgcctgcatccctcttatgaaaccacttgattatggtggattatctttttgatatgctgttgaatttggttaactagtatttggttgaggatttttgcatctctgttcatcagggatattggcctgtagttttctttttttgttatgtcctttcctggttttggtattagggtgatactggcttcatagaatgatttagggggggattccctctctgtttttcggaatagtgccaataggattgataccaattcttcattgaatgtctgatggaattcagctgtgaatccatctggccatggacttttttttgttggtaactttttaattaccatttcagtctcactgcttgttactggtctgttcagagtttgtatttcttcctggcttattctacaagggttgtatatttccaggaatttatctgtctcctctgggttttctagtttatttgtgtaatggtgtttgtagtagccttgaatgatctttgtatttctgtggtattggttgtaatgtctcttgtttcatttctaattatgcttatttggatcttttctctttttttcttggttaatattgctaatggtctatcagttttatttctcatttcaaagaaccagctttttgattcttttatcttttgtatttgtttgtttctatttcatttagttctgctctgatcttggttacttcttttcttcttctgggtttgggtttggtttgttcttgtttctctagttccttgaggtgtgaccttagattgtctatttgtgctgtttcagactttttgatgtaagcatttaatactatgaactttccttttagcaccacttttgccatttcccagcggttttgataggttatgtcactattattgttcagttcaaataattttttaatttccatcttgatgttaatgttgacccagtcatcattcaggagcaggttatttaatttccatgtatttttatggttttaagggttccttttggagttgatttccaattttattccactgtggtctgaaagagtacttgatgtaattttgatttccttatatttgttgagactttttttgtccctatgatgtggtctatcttggggaatgttccatgtgctgatgaagagaatgtatgcttgtatgttctgcagttgttgggtagaatattctgtaaatatttgttaagtctggttgtcctagggtatagtttaaatccattgtttctttgttgactttttgtcttgatgacctgtctagtgctgtcagtagagtattgaagtcccccactattattgtgttgctgtctatctcatttcttaggtctagtagtacttgttttataaatttgggacctccagtgttaggtgcatatgtatttaggattttgatatattcctgttggactattccttttatcatcatatgatgtccctctttgtcttttttaagtgctgttgctttaaagtttgttttgtctgatataaaaataactactcttgcttgcttttggtgtccatttgcatagaatatctttttctaggcctttaccttaagtttatgtgagtacttatgtgtcaggtgagtctcttgaagacagcagatagttggtaaattcttatccattctgccattctgtatcctttaagtggagcatttaagccatttacaatcaacgttattattgagatgtgaggtactgttctattcattgtgctatttgttgcctgaataccttttcttttttcttttttttttcattgtattgttttatagggcctgtgagatttatgctttaaggagattccattttagtgtattttgaggatttgtttcaatatttagagctcgttttcatagtttttgtagtgctggctttgtagtggcaaattctctcagcatttctttgttggaaaaaagtatgtatccttcatttataaagcttagttttgctggatacagaattcttggctgataattgttttctttaaggagattaaaggtaggacctcagctcttctagcctgtaggatttctgctgagaaatctgttaatctgatagatttttctttataggttacctgatgcttttgcctcacagctctttagattctttcctttgtcttgactttagataacctgatgactatgtgcctaggtgatgatctttttatgatgaatttctcaggtgttttttgagattcttgtgtttagatgtctagatctctagcaaggccggggaagttttcctcaattattctttcaaatatgttttccaaacttttagatttctcttcttcctcgagaacaattattcttaggtttggttgttaaacataatcccaaacttgttggagacttttttcattttttaaaactctttttttctttgtctttgttggattgggttaattcgaaagccttgtgtttgagctctgaagttctttcttctactagctcgattttattgctgagactttccagtacatttttcatttctctaagtgtgtccttggtttccagaagttgcgattgttttttatttatgctatttcactgaaaatttttccattcatatcctgtatcttttttttttttttttaatttctttaagttggcctttacctttctctggtgcctccttgatcggcttaaaagttgaccttctgaattttttttctggaagtttagaggttttgtcttggtttggatccattgctggtgagctagtgtgatcttttcggggtgttaaccttgttttgtcatattactggaattgttttttttgtttcttcttatttgggtagactatatcagagggaagatctggaactcaagggctgctgttcagtttcttttgtcccacggggtgctcccttgatgtggtgctcctccctttcctgtacggatggggcttcctgagagctgaactacagtgattgttatttctcttctggatcaagccacccagtggagctactgggctctgggctgttactggggactgtctgcaaagagtcctgtgatgtgatccatcttcaggtctgtcagccatggataccaacacctgttcccgtggaggtagcagcagagtgaagtggatatttttaagtacgctggttttgtgttggttggcctccagccaggaggtggcacttttaagagcacattagctgcagtagtaggaggaggatcaggcggtggcaggaccatagagctcccaagagattatgtcctttgtcttcggcgttcctcggctgtcccaggaacctgcagcagcaatccaccttcttcaaagggtctgtggattctctcggatttcctggtatgttcctgcatagtttttggagcaagaggttcacgatgtaggtctccacgtgctgctctgtccattaagtgggagctgcaagttagtattgcctcctatctgccattttccctctcactgtgtgatttggttattttcatgaaagcctactattaaaagatttgaaaaattggaatggtgtgatcatgtattatacttggaaaagggaagacagtctatgatcatgtggtgaaataaactacagtagagatattggagtagaataaaacaagagttacttaatattgaatgctctagatgttggctgtatgacattgatttgtaatgcagtatgaaatcttcagtgggacaaactgaagctgttataaaaagggggaacgtgaactctttgtcgaggccaaaggaaatgatggtgggtctacctgagatgcttttgtgtagtcagttccacacagctattaagaggtggtctactttttatcttgatgtaatagcttgcagctgatttgaatctaactcagtttttgttttcctttgagaatgtgaaggttgtatgggtttaaatttcaccattgttgaaatgagacagtaaatctgagagccttcttttattttcctctgttagccttgctgcatgaccacaagtatagataaagcaaatggtatgtaaatatcaaaattattttttaaaggataagtaatcttttttttctcctttgaattttattctaggatccatcagttacacaagtgacaagaaatgttccaccaggacttgatgaatataatccattctcggattctagaacagtaagattattcttgcttttaaatgtttaaattgaaattcagtaggaattctattttaactatgatttcttttttagtggattgcttacacttaaataaaacaaattgttaatgttttatttagtattcagcaaacttggatttttttaatatgtagaaatattagtagtaattgaagattaccatgatgatcctagtgaaatacttcaaattttcttttatgttttacagattaaatcacaataatctttctaaaatgtaaacttttccacattacttgaaatactaggaattagagaaatatttcttggtatacatgttgtctgcctgataatgtggggtgatttttttttacgtggaaactgtgtagaactgtaccatgaatgtttgtatgattgtcatttgaattagattattctgaatagtactagccttctgttctggcagagtagaacctctggaactttacccagactaggaaagcatatttttcccctcaaaatttagtatttttttcttttaaaaatttatttattgtagagacagtgtcttctatgttccccaggctggtcttgaactcctggtctcaatccatcctcccacctcagcctcccaaagtgctgcaactacagatgtgagccgtggcgcctggcctcaaaatttagttttgatttataaaatgtacaagtatgaaaaaaatcctcataaaacagtgttttgctactctagatgtatatgagaagcatctaggggactttattacactaccccttatggccctcatctcttagagttagggcaattttttttttaaagttcttttgatgattttattgtgacctagatttgaaaactgttgaggtagattctgttgagactatctccagaatttctgtggcaaataatttcatctcctgtatttgggtctgcctccaatacttttgttaccttgccctgtgcatctcttctatttggctgttcctgagttgtgtcctttagtaagctgctaatagtaagtaaactgtttccatgagttctgagagcgcttctagaaaattatcaaatccaaggagagggtcatggaaacccccagtttatagaaagttagtcagtatgggcggcaatctgtgacttgtgactggtgacttgggacttgtgactggtgtctgaaatgagcccttaacctgtgggatctgtgatagtccaggtaggtagtatcagaattgaactgagttgtaggacatctagatggtgtccaaagagttggggaattggttggtgttgggggaaaaaaccccacacatttggtatcaatagtattgttggtaaaaacagtccaaaagtaaaagcattaaaataagaatgaacttttaaatttctctttatttcaaagccctcatttaacagcctttgcttatatgtagcaaattaattccaggttgggatcactaaagtgctctttgagcatgtaaattacaggttaaaacatgtgaaatggccaataagctgaccagttttgatatataaaaatggtggtttcatatgattcaaccttataatgaattagtgctgtgaatatgtgagagtgcaatttggtagtagttgttgaagggaaaaaaagaagagctggcaaattatattccactgtatgtagttcttttaacttgatttctaggaggtggagatgggaacaagaccatttttaaactttgtcgataaagaatgaaaagagatttttttttcttttttttttttttattgatcattcttgggtgtttctcacagagggggatttggcagggtcataggacaatagtggagggaaggtcagcagataaacaagtgaacaaaggtctctggttttcctaggcagaggaccctgcggccttccgcagtgtttgtgtccctgggtgcttgagattagggagtggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagaatttttcttagtacagaacaaaatgaaaagtctcccatgtctacttctttctacacagacatggcaaccatccgatttctcaatcttttccccacctttcccccctttccactccacaaaaccgccattgtcatcatggcccgttctcaatgagctgttgggtacacctcccagacggggtggtggccgggcagaggggctcctcacttcccagtaggggcggccgggcagaggcgcccctcacctcccggacggggcagctggccgggcggggggctgacccccccacctccctcccggacggggcggctggccgggcagaggggctcctcacttcccagtaggggcggccgggcagaggcgcccctcacctcccggacggggcggctggcctggcggggggctgacccccccacctccctcccggacagggcggctggcctggcgggggctgacccccacctccctcccggatggggtggctgcagggcggagacgctcctcacttcccagacggggtggctgccgggcggaggggctcttcacttctcagacgatgggtggccaggcagagacgctcctcacttcccacacggggtggcggccgggcagaggctgcactcccggcactttgggaggccaaggcaggcggctgggaggtggaggttgtagcgagccgagatcacgccaccgcactccagcctgggcgccattgagcactgagtgaaccagactctgtctgcaatcccggcacctcagaaggccgaggctggcggatcacttgcggttaggagctggagaccagcctggccaacacagcaaaaccccgtctccaccaaaaaaatacaaaaactggtcaggcgtggcggcgcgcgcctgcaatcgcaggcactcggcaggctgaggcaggagaatcaggcagggaggttgcagtgagccgagatggcagcagtacagtccagcttcggcttggcatcagagggagaccgtggaaagagagggagagggagagggagagagagggagagggagaccgtggaaagagagggagagggagaccgtggaaagagagggagagggagagggagagcgaaaagagatttttatataaatgtttgcaaaactttactagcaagaaatatgtttagcatttttatatagtagcagctttagattactcttatcagttgtagtattcttcatcaagctgtctactttgtgccatgtgctttgcctgtattatcttattgaattctcataatattcaaaattgatattttaaatttccgttttactaataaagatctgagacacaggtcagctagcaagtaagtggcagaactggcttattaactcgtgttatctgtaaagcttttgcctttttcattttgctagtgctatctttggagatagttgcttaagaaatagaaaaaatagtcctggtctttgaaagatttctcacctaattggtgtaattaaaaattacacagacacaaagaagatatatccagaacaaataaaacaaaatataaatcatgattgtaaatgttgagactttatagttacaaaaagattttctgaaagtgaatagtcttgagcaaggagctaggcaatagtgagaagccaatttacaatgaaacacttcccttagatttgatgaacagtgatatggtgtcagaaccaggaaaattcttatgataattgggtgcattttcctctgcactgttaacatgatggaaaacacagtttaaatattaaatattcctttgtttattatataatgtgatttcagaaatttgtccatttttgtggctgtgattattttccaaagagattaggtgtagttagataattgatttaagtggtatattagcattagaccttggtcctgttttagttaattggtggtattcgtatttttatcataggacagtgtttgtgaaactgaagcttcttgattcttgtatcaggatatggtgagctacttgaggtcaagaaggaagatcttctagcagaatgcctgagtgtgtaatcttgctaagatttagaaagttcctgccctgttcttctttttattaaaattgttttcttctgtacttaatttttctgtttgaatggaaaccttaagttatttaaggaaggctacagtatggaaatcttgagtaattatatacatatatatatatttagagatagggtctcactctgttgcccaggctgaagtgcagtggcacagtcgttgctcattgcagccccaaactcctgagctcaagcgatactcctgcctcagcttttcaagtagctaggactacaggtatactctaccacatgtggctaattattttctgtagagaagaggtcttggtaagttgcctaggctggtctcaaactcctggcctcaagtgatcctcctgccttggccacccaaagtgctgggattttaggtgtgagctacagtgcttggcctgcataattttataacttatatattcaccattttacacattcagagaaaggagttgtaacaagacactttataatatagactaagtcattttattgacagtgtcatgaaagcctcttgagcacttaaatgtggctagtctgaattgagatgtactataaaaatggaagatagtcttgagttatgaaataattttttttgtttgaattcaaaatgcatttttctactgaaattatgttgtgcatggtaggtaggttttctggcctaccctctaaaatctaatgcataaatagagaaattatccttaagaattgatgtatgtttatggggaatgtttttcttttcaattaagtaacagttgaaaatgcctattgctgcttgattctcactagttttggccactggtgagggcatttgtggctttagacagaattttttttggtgggtattgaaggtaagggatagggacacctgtgtgtgggagaagtgcagcactgctgacaaatccttagagacatttcttggggcctagtttactgtcatgtttcttttcgttagggattgtctgcctggttctttttctgtttcgctagttgatgccatatatgatttctgtcacatagagcagagagaagaaccacaagagaaaattccaggtactgacagtgtgagggggtatgcccagatggtcatctctgaccataaagggacatggataattggtttatgtaaggaagtactgcctctaacataattcaggacatgaagtagactgagtctaaagaggacctgcattttaacctaggccctgtcactaagcagttggtaactttaggcaaaccatataacctcttcgaaaatcttttttttatatatatatatattacaatgaaggcagggaggaaaatgttgagttaaataattttatctttttatagacacaggttcttgctttgttgcccaggctggtctcaaactcctggactcaagagatcctcctgtgttgtcctcccaaaatggattacaggcatgaaccaccatgcctagctgagttaaataatttagtattagtatctcttgaaaattaggactaaagcatctagctgcaggggctgactggatataattgtacatagtagtttactcatctttaatactgccaaagcattctgtatagtttaacacctgtctttattttctctcgctgtgcacttcttttttctttctctttgccttctgcttctcactgttttgtattcttggagctcattatctgtcccttctggaacctctttgtttccagtctcatttaatgatactgttgacttacatcctagtatcgttggctagaaatacccgatttgtctttggcgctaacagcttcttttcctacatctaatcagttgccacatcctgtcacttatacctgctggagatattacctgtctgttcttttcattctttcttacctgtcctaagtcaggcactcatgtgaaataatagaatgacctatctagttatctacttccagccttcctcttcaaatcgctttttatactgtgactggacttattttcctaaagcagaggtcagattaggtcatctaccttccttagaaatgattatgcattacctactcagtagtttggcatgtgagaccatccacggtttgacttcagactttttgtttttattttaatttttttcgtagaccatttttttaggctttcagaacaattgagcagaaagtacagagtaccagtttattttctccagactgtctttttactcttatcttctaatgtgccatttgctctagccaaagtctaattaactcatgaacccccgaccctattgagactgactccccattgtatagagtcaagagagactgtgggtgatcataaggcttggcttctctaggtatgtttatccccttcaatggatccagatgaatacttcacactggatatattcattttctgttgctgtgtaacaaattaccataaacttagctgtggctcaggagttcagatacagcattacttactgggtcctttgctcagggtcttacaaggctgtggtcaagctgttgtcttggctgcattctcatctagaggtttaattggggaagaatctgcttccaggcttatatagattgctggcagaatttatatcctggtggtcgtatgactgagggtcctagctttttgctggctatcagctggaggccaaccattgattgtagatgctgtccacagcctccagaggctgtatagtttcttgccccctgggcctctccaacatggccacctattttggcaagccttcagagaatcttactccagtctgcgaagagggagtttatataatgtaacgtaatcaaaggagtgacattccatcatttttaccatattctcttggttagaagcatgtcacaagtgctgtatgcactcaagggaagggcattattaaaaagatgtgaacatcaagaggtaagaatccttagggtacactttagagtctacctgccacactgggaataagatatggtatattaggactaagtgtgtttccatctgtctctttatccccatttaaaagggtcaaagtagaacccccagaatacctatccctccctatccttgaaacatagaggatttttagagtgacagaactactctatatgatactataatgatggatacatgtcattatacatttgtccaaacccatagaatgtacaacaccaagagtgaaccctaatgtaaactgtggatttgggtgatgatgatgtgtcagtgaaggttcataagttgttacaaatgtccactctggtgggagatattgataatgggggagactgtgcatgtgttgggacagggatatatggaaaatctctgtaccttcctttccatcttgctgtgaacctaaaactgcattagaaaaataaagttaaaaagttagtgaagcaggaaaccaaaaactgaccaggttcagttcagtttttgacatgttggatttgcaatttccaagacatccagatagacatgtttagtaagcagttgattgtatgaatctggtgttcatcagagaggtctgggctggaagatatacatgtgggaatcattggcccttagatggtatttaaaggtataagactggatttaatcatcaattgagtgaacatgtattgcagagaagcaagacctaaactcctggtgcactcgaatattggaggtggaagggcaggaggagaaaagaaataaaggagactgagaagaaacaacttagtgttctgaaagccaagtgaagaaagtgtttcaataatgagatagtgataaactatcaatgctgatgatagagcaaataaaattaagacagaaaatttatcattgaatttaacaatgtagaagtcattagctatcttgaatagtgtagttttggttgagtgttgggagcaaatgccttactaaagtatctttaagaagaaagaactgggaaaagcgcaaatagacaactcttcataggatttttgcagcagtggagagcagagagttttttttagggaagaggatgagagaaatgggggctggaaagggaaaggaggttaagataaagttttgttatagttacagtaatcaagacaatatggtactggcatagacatgcaaatcagtggaatagaactgacagcccagaaataaacacttaaatttatgatcaactgatttttgacaagagtgtcaggataatccaatgggaaagaataatcttttcagtaaatggtgctggaataactggatgtccacatacagtagaatgaagttggactcctacctcatcccatacataaaaattaactcaatcatagacctaaaggtaagcactaaaactatacaactcttagaagaagacataagagtaaatcttcatgacctttagttaggccatggtttcttagatgtgacactaaaaatacaaacaacaaaagagaaaacaggcaatttggacatcaaaatttaaaactttttgtccaagagcactatcaagagagtgaaaagacagctcacagaatgggaaaatgtttgcagatcacatatttgataaaagacttgtatccagaatatatattaaattattacagttcaatattaaaaagacaaccaggctgggtgtggtggctcatgtttgtaatcccagcaccttgggaagctgaggtggatggatcatttgaggtcaggagttcaagaccagcctgaccaacatggcaaaaccccatctctaccaaaaatacacaaattgaccaggagtggtgagtccacatggactcagatgtttctccttagaagataaatggccaataagcaggtgaaaaaatgttcaacattgttagctgtcaagatgcaaatgaaaaccacaaggaggataccacttcacatccattaggatatctataatcaaagagtcaggcaatagcgagtattggcaaggatgtggagaattggaaccttcacacactgctgatgggaatgtaaaatggtgcagctgctttggaaaacagtttgctagctctagacatttgttaaacgtggagttaccatatgaccctgtaattccactcttgggtacatacccaaaagaagtgaaaacatatgtccacatcaaaaccagtacacaaatgcaacccaaaattggaaatagcctatgttcctatcaactgatgaatggataaataaaacctagcataaaaataaatgaagtagttactacaacatagttgaaccttgaaaacattatgccttcaccattatcaaacaattggtgaatctatattgacacaccataatcacccaaagtctatagtttatcctagggttcacctctttttttttttttttttttttttttttgagacagggtctcactttgttgcccaggcttcagtgcagtggcatgaatgtagcttactgtgacctcaaactcctgggctcaagcaatcttcccaccttggcctcccaaaatgctaggattacaggcataagtcactgtttctggcccaaggttcactattttttttttttttttttttttttttttgagacagagtcttgctctgtcgcccaggctggagtgcgatcttggctcactgcaacctccacctcctgggttcaagtgattctcctgcctcagcctcctgagtagctgggattacaggtttgcgccaccacacccgcctacttttttgtatttttagtagagacggggtttcaccatgttggccaggctggtctcaaactcctagcttcaggtgatccccctgcctcaacctcccaaagtgttgggattacaggcgtgagccaccgcgcatggccccagcgttcattcttgatgttgtacattctgtgggtttggacaaatgtgtaatgacctatatccattattataacatcataccgaatagtttcattgccttgaaaatcctctgtgctgtacttattcatctctttgccccttcccagaccttggcaaccactaatctttttactgtctccatagttttgccttttctacagtgtcatatagttggaatcatacataatgtagcctttcagattggcttttttcacttagtagtatgcataataaggttcctctgtcttttcatggcttattagctcatttcattttaatgctgaataacatactattgtctggatgtaccacagtttatttagccatccacaaactcaaggacatcttaattactaccaaattttggcagtgatgaatagagctgctataaataactgtatgtgggttttttgtatggatgtaagttttcagttcctttggataaataccaaggaatagactgactggaccatatggtaacagtatgtttagttttgtaagaaactgccaaactatctttcaaagtctgtactattttgcactccaaccagcaatgaatgagagtttctgttgctctacatcctctccaacatttggtgttatcagtgttttggattttggccatcttaattggtgtgtagtggtgtcattgttttagtttgcatttccctgatgacatatgatgtggagcacctttttatgtgctcacttgccatctttgtatcttcttttatgaagtttctgttaaggtcttctgtccatttcttaattggtttgttattgttgaattttaagggttcttgtatcttttggataacggttctttatcagatgagaatattttctcccagtctgtggtttctgttctcattctcttgacattgtcttttgcagagtgttaattttaaggaagtccagcttttcaattatttctttcagggatcatgccattgttgttctatctaaaaagtcatcaccatacccaaggtcaattaagttttctcctgtgttatcttcgaggagttttattgttttgcattttatatttaggcctatgatccatttttaaatatttgtttgtttattttagtgacagggttttgctgtgttgctcaggctggtcttgaactcttaagctcaaggaattctgccttggcctccctagtagctgggactataggcatatgcttggcttctgtgatccattttgaattaattttgctctagcaccatttgttgaaaagactgttccattgtactgcctttgctcagttgtcaaagatcagttgactgtagttatgtgggtctatttttgggctctccattctgtcctgttggtctgtttttctaatcttttgtcaatactatactgtatggattactgttactttatagtaagtgaactctagtagtgtcaatcttccaactttattcttctctttccatattgtgttgactgttttgggttttttgcctttccacataaacttcaacattagtttgtcagtgtccacaaaataacttgctgggattttgattgggattgcgttgaatctgtagatcaagttgggaaaacctgacatcttaacagtgttgagtcttcctatccatgatcatggaatatcttttattcttctttgatttctttcatcagttttgtagtttttcacatatagaatgtatacatatttcattagatttatgcctgttttactttgggagatgtttatataaatggtatgggtttaatttgaaattcgacttgttcattgctgttacatatgaaagtgattgacttttgtatattaactttgtgttgtgcaaccttagtataatcatttattagttctaggaggtttttgtcagtaccattgaattttccatgttgatgatcttgttatctgtgaacaaagacagtcttatttgtttcttcttaatcttcataccttttttttgggtcttattacattagttaggacttctagtacaatgttgaaaaggagtggtgagaggggacatccttgcctttttcctgatcttagctggaaagcttctagtttctcaccaataagttgatgttagcattgggctttttgtaggtgttctttatcaaattgaggaagttcccctctattcctagtttgctgaatggttttattatgcatgtgtgttggattttgtgaaatgctttttctgtatctactgatatggtcatatgatttttcttttttagcctattgatgtaatgaattacattaattgaattttgaatgttgaaccagcctaggatacctggagaaaatcccacttggttttgtatgtgattcgtttcatatatggttggattcaatctgctgatattttgttggagatttttgcatccatgttcatcagagaatattgatctatagtttttttgtagtgtctttggtttgatatgagggtatttctagcctcataggatgagttaggaagtctttcttttgcttctttcctccgattgagactgtatggaattagtaaaatttctaccttaaatgattggtagaattcaccagtggatccgtctgggcctgttaccttctgttttggaaggttattacttattgaggcaatatctttaataaatagaggcctatttagatagcttgtttcttcttctgtgagttgtcacaaattgcattttccgaggcattggtccatttcttgtaggttatcagatttgtgggcatagagttatttatagtatgtcttggttatcattttaatgtctatgggaccttagtggatgtctcttccttcatttctgatattagtaatttgtgtcctcccttttgttcctccttagggagcctggctagaggcttattgagtttatcgatcttttgaaaaagccaggttttcattttgttgatttttttctattgattttctgtttttaatttcgttgacttgtgctcttatttctttccttctgcttattttggatttaatttgctcttctttttctaatttcctaacatggaaacttggagtatggattttagatctttcttatcaaatatatgcactcaatgctatacattttcctctaagccctgctttcacagcatcccacaaattttgataagatgtacatttttttttccacttagctcaaaatactttaaaatttctcttgagatttcttctctgacttgtgttatttagaagtatcttttttaatcttcacatattttgggatgtttcagttttcttcttgttattgatttctcatttaattcccttgtttgagagtaaatactatatttgtttttttttttttaatttgttaaggtgttttttatgttacagaatgtcttctgtcttggtgagtgttccatgtgaacttgagaagaatgtgtttctgctgttggatgaagtggttgataggtgttaattatatccaatcaacggatggtattgttgaattcagctatgttcttaatgatttcttgcctgctagatcggtccgtttctgatttgaggggtgtttgagtctacaactataatagtagtttcatctgtttctccttgcagttccattagtttttgcctcttgtagtttgatgctctgtcattaggtggatgtacattaaggaatgctatgtcttggagaattgacccatgtgtcattatttaatgcccttctttatctctaataactttctttgctttgagtctgctttttctgaaattttttatcagtgttagcatggtatatttttctgtttacttctaatccatatgtttatttatatttaaagtgggtttcttatagacaacatatagttgggtcttgttttttgatcatctcataatcttttaattagtgccttgagaccgttgatgttcaaagtgattattgatttagttgggttaatatatatcatattgattgctgttttctgtttgttgcccttgttctttttgtcttctactcttggtggtttgttttgttttattttgagactgtttcactctgtcacccaggctggagtgcagtggctcaatccccgatctcagctcactgcaacctccgccttccaggttcaagctgtttcagccttctgagtagctgcgattacaggcacctgccatcacacctggctaatttttgtatttttcgtagaggcagggtttcaccatgttggccatgctggtctcaaactcctggcctcaagtgatctgcctgcctcggcctcccaaagtgctgggattacaggcatgagccattgtgcccagccctcttggtgagtttaatagaacattttatatgattataatttatctccttcctggttgccctagagtttgcaatatacatttataacaaatccagacctacatacaaataactatactgtttcacaggtagtgtgagtgccttataataagaatatgattcctccctcccatctttgtatcattgctgtcattcatttcgctgatatataagcatatataaacatatatatgtatatatatacacacacaagatatttgcagaagaacccataattgaatacattgttgctgttattattttgaaccaactgttttctcttagaccatttgagaataagaaaaataagacgtggtgtctcatgcatgtaatcagctttgggaggccaaggtgggaggattgcctgaggccagggattcaaaaccagcctaggcaatgtagtgagatcacattgagatcctgtctctacaaaacaaaacaaaacaaaacaaagaacaaaaattagccaggcatcagcctggtgcagtggctcacgcctttaatcccagcgttttgggaggctgaggcgggcgaatcacttgaggtcaggagtttgataccagcctggccaacatggtgaaaccctgtctctaccaaaaatacaaaattagctgggtgtggtggcatgcgcctgtagtcccagctacttgggaggctgaggcaggagaattgtttgaacccaggaggcggaggctgcagtgagccaagatcgtgcctaggggacagagtgagactctgtctcaaaaaaaaaaaaaaaaaaaaaaaaaaaaaagggatggtgggcatgcctgttgtcctagctactcaggaggcagaaggattgcttgagctcaggagtttgaggctacaatttgctgtgatcatgctactgcactccaacctgagtgacaaagtgagaccctgtctcaaaaaaaaaaaaaaaaaagggttttaaacttcgtctatttcttgtatgctcatgcttgctttatgtggatccaagtttctgacctatattattctcattctctctacagaacttacatatatttaaaaatatttaatatttcactgcagccttgacctcccaggtggatgggactacaggcatgtgccaccaaggctaatttttttatttttttagagacggggtctcactatattgcccagcctggtctcaaacgcctgggctcaaacagtcctcttgcctcagcctcccaaagtgtcgggattataggtgtgagccactgtgcccagccttacaggttttttttttttttttttttgctaggctgacatgatgtactgggtaaaaggaattgctgtaattaggtctttagttgtgtggtggcaaggtgttcagaagcactctatagtcctgtgattaggtctcagtcttttattgagtctatggacttcacaaatgtttcgaagttgttttcttctttcttaggtgggacagaatggctagagttggctgcagttgggtatttcccttcccccaggtgagttaggctctgataagccccaacaggttaggcactggttaaatagtttctcctgaggggaggccttgttaagaacagagtgctctggtgtttttcaaaaatggttcttccccactccacttgttagaagaaggaggggatttttttctccatgtactatgagttgagttcctggagataaaacaaaagtgcgaggggactcaccacatgaatgggttcccctgtagattttaactctcagtgttgtctatgctgagcctccaacaatttcttaattacagttaaggtttttctaccccagtaatggttcttgcagtggtttctgctagagagcttttgctctggcaaattgttactccttgtattgacctatttctgcagtcatgggtcagcaatttgccctgtgtcctcacatctcttaacgatccagaatgaattactgattttttagtttgttcatcttttcacttgttgttagggtggagtggtaaattctaaactccttatacatgaaactggaaactgaaagtcccctttacttgctttaatttttttcagagtaaaaaccatgagtctttaaaatagcctttaatctgatccctaatattctttgttcttcatcttgtcgcaccctctccctgtgtattcctgtctagcacgctgattcctcacatattccatgcattctcctgactttgcactggttgtcacctctgcttaaaatggtcttccccccaggtagataatctgcaagacttactttctcacctccttgaagtctttgttcaaatattgacttccccaatcacctttataaacttattctgtcagcctgtactcatgacctcttcactctggtctttttgttgttgtcccgtaaaatgattgccttttaagatgctctagaatgtatttgttcaatatgtgtattgtttatcttctgttgctggaatgtagctttatgggagtaggggtgtttgcctattttgttcattaatgtatcccaattcctgtatatgtttgtggcccattgtagttgaccaatgaatgtttgatgaatgtatgaatgaatggatatggtcacatttgttcttttatgttcctttatctatttgaaaactcccatactggtatatttcttctttcctattacacacgtccttccccagacaattatcctaatcttcaaaaaccttattttaaagtgattagtctaataaagttatgtctgtttgtcctgattctgagattagtatgtgtaaactttcagcactcttaataacaagggaatctgtgttaagcatagccacagtcatttctttgctgaatcaacggctgttaaagtgagtgaaagctgcagaaagtttcaggatccttttggcagtttaagtgaaagaaataaaacagtgttttatagaagctgtaaactttgttgccttagaggggagttctcaaattttaaggtgtctaagaatcaccatggggagtttgttaaaaatggtagtttgttaaaagtacaaattctctcttctaatccctaaggttctgaatcaataggttcatagaagggcccagagtttgcattttcagtaagtacctggggtttctgatacgggatgtctgtgaatataaattaagtaacattcttttagaccctacatacactttggctgttttttggtttagagatggaagagaaagagctggagaaagcaagaagaaatttctggaataggtgtttagaatatggaagaaaacctggaaggagaaaatatatttgcttatgcatgacaaagacaactcatgaacttcctgtgccttgaagagaccttgggtagtcgtttatttaaaatgaatcacccttggaatttccagtgcagagagcttactatattatagagcagtccatccactattgtataatcatgattattataatgttcttaattctcttgagccaatatatttttctataatttttatctgtttgtcctagccaaactgaagaggcaaatgtagtaaggtaattcgtgttaaaatataaaataattataacccttatttttctaagagatatttaagcatgtagtctattcccagtttgttaaatttcatccatccatgggatgaggatatacagccttgctctgccagactttgtttttgattctgcctccggggtcagttctctcattctcttccaggtctgttccagttttgttctttgtctccaactctgcacactctgcttttctcagtacttcaagtttttcccaggtacagccaaagtagtggcagacacagttctaggtttgtcaggagaggagcttactgtagtacatttggttgcagtagagtattttctttttccctgccaataggttggctttccttctgtatttggagttttggtccatgtaaaatgaagatgatatactatggagtgcccagtgagatagagaggtcttcctttttgcatctcaaatttttcttctcctgtcatttttttcttgttgttatccctaaagtagaagttctgttagtgagggtctattggtagtacttttttcagtatttattgttattatttcatcttggttctcaaacagctgatctgactggttttagagttctgcattatcagttattttctctcagccatttagcacattatacttgagcttgcattgttgctgttgagaagctagctcagtcttaggatcttaggtgaaaggatacacagtggtttataggtgaccttcctttgtgtgggaattatccttttttttttcttgcagtttttaaggtttgctctttcattgtgatgtatctgagtgttactatttttaaaatttggcttgtgttttagggttttgaatctgagaattagtgtcttcatatactgtttaaacattgactctcccttatcctgtttttttttttttcccctctggacctcttaattgtatgttagaccttctcaatcatcatgtcttataatttctcatatttacattttttggatctctgtgctgtgtcattagattcacttccattcctttattatttcatctttgtgtagtttgctgttcaacttgtctattaaatttataatttaaaagtcattattatagttttcatttctagaatttcatttaagaagctggccaattctgatagtctcttgttagtcaaacttgtattaccctcttaattctttattaaacacacctgttttgtatctgataattcaaatatattcaggtcttattttgtaatttgctatttctgtggacccttgtggtttgtttcctcatagatttaaatcataagccaaagttacttggaactttatctgtgttaatttcttgaagcctggtgtattagtcagttctcatgctgctaataaagacatacccgagaccaggtaatttataaagaaaaagagttttaatggacttgcagttctacatggctgaggaggcctcacaatcatggtgggaggtgaaggacaagcaaaggcacgtgttacctggtggcaggcaagagagcatgtgtaggggaagtcccctttataaaaccatcaggtatcatgagatttattcactgtcatgagaacagcataggaaagacccacccccatgattcagttacctcccaccaggcccctcccatgacacgtgggaattatgggagctgcaattcaagatgagatttgggtggggacacagccaaacccatgtcacctggttttaatgtttgttcctctacttttgccaaatgcctgaggccactaccagcctgagatccttttcactgaaaattggatgttggattatcttgtccatgtgggtagtggaattctgacctgagatctgcaagttggtaggtttttggtttttgttttgttttgttttgttttggagacaggatcttgctctgttgcctaggctggagtgtagtggcatgatcttggctcgttacaacctgcctcctgggctcaagctatccttctgcctcagcctcctaagtaactgggactccaggcatgtgccaccacacttggtaaatttttaaattttggtgtagagctgaggtctcactatattgcccaggctggtctcaatctcctggccttgagtgatccttccacctcagcctcccaaagtgctgagattacaggtgtgagccaccatgcctggccattggtaggtttatgactgggaattctcagggaagatttcccttttttcctcccttctacatccagaattaaggacaagacatggaggtattcccatcatttatttttcttctgtgaaattgcttttttcttactcatccactgaaacggtcattttttagagactcctggctttatgcagggatcttgtcaatcccttaccatccttgtaccagctccaaagctttgtctctagtttactagtgcagatggatcactagtaatttggtgaatggtttggtatcaaggctgttctttctttggatttagtagttcctgctttcttgcctcccaggatttcttgttgcgttagttgtgtatttacaatattatttaaataaaatttggtctagtattttaggtattatgtactagaaggggatctctacatatgggtgatctgctatgttttaagaagtgaaagtcttgagtggcttgttttatatttatatatatatagatagagacagagacacatatagatacacacacacacacacacacacacacgcatacacgctcatctgtcccagagtgaaaagttggaaatgaactgggaaccatcatcacaataggtatttagtagtgatgaaaagaggtcgtcctccagaattctacttggcttgagttggctaatccactatgttgtggctgaagaaaatactgggtctttaacatctacagatgtgaagaaattatcaggataatagctattagatttatatcagtgctattagagatttgtggctctccaacatttctcatcattgctatactgcaagcaactatggccttaaatatatcgcattaccagctctaaccctaccttcatccttatctactagtttattatacttaatacttccttggttatttaaagtaatacagcatttatagcaaggtttcagctgggtacattcttgggtaatttcttctgtgtttttcctgaaatatgctgctgccaggctaactttgccagacattttattagtatttggtcattgttttattgttgctgcttattacaccaagaagacagggctttggggcgatgcttttggttttttgctgggggaagatctttattactgatcaagatagcagttctaaatgccatgtgaacttgggacaatatatgtgagaattatatctcacttaaggtgccgggaactctttttcttttttttttttttccaactttttaagttctggggtacatgtgcaggatgtgtaggtttgttacataggcaaacgtgtgccatggtggtttgttgcacagatcaacccatcacctaagtattaaacccagcattcactaactattcttcctgatgctctccctttgcccacccctaatccccatccccatctcccgacaggccccagtgtgtgtttttccccaccatgtgtccatgtgttctcaatgttcagttcccacttatgagtgggaacatgctgtttggttttctgttcctgcattagtttgctgaggaggctggcttccagcttcatcgatatccctgctaaggacatgatcacattcctttttatggctgcatggtattccatggtgtatatgtaccacattttctttatccagtctatgattgatgggcatttagattgattccatgtctttgctattgtgaatagtgctgcagtaaacataggtgtgcatgtgtctttgtagtagaatgatttatattcctttgggtatttacacagtaatgggattgctgggtcaaatcgtatttctgcctctagatctttgaggaaccaccacactgtcttccacagtggttgaactaattgacactcacaccaacagtataaaagcattactttttctccataacctcgccagcatctgttgttttctgactttttaatagttaccattctgactggtgtgagacggtatctcattgtggttttgatttgcatttttctaatgatcagtgatgttgagcttttttttcatatgttggccccatgaatgtcttcttttgacaagtgtctgttcatgtcctttgcctgctttttaatggcatttttttcttgtaaataagtttaagttccttatagactctggttattagacttttgtcagatggatagattgcaaaaattttctcccgttttgtaggttttctgttcactctgctgatagtttgttttgctgtgcagaagctctttagtttaattagatctcatttgtcaatttttgcttttgttgcattgcttttgtagtttttgtcatgaaatctttgcccgtgcctacaccctgaatggtattgcctaggttttcttctacagtttttatagttttgggttttacatttaaaggaccatacttttctaattggagaagttagcattgattagccttagtttttctgcccattaataagagatactgggtgtgggggaacaagcatttggaaaagagaatttgtgattattttagtgacaaaagattgtaatggagattttaaaaatacaagaaaatgctcttaatcccactgcccagaaataatccctattaacattttgatatattttcatcttattttaaaataggaagttcgtgtcatgttgtatatacagctttgtttcataactttttttaatcacttatttgtccaagcttcctcatcttattgcactcttttagaacttttaaatagctgtattgtatactttcctatagctgtatcagtttaaccatttcttctgttgtgttggacatttggggttttgcttttgtaaataaagctgtagtgagcattcttggcatacatacatttgcaaatatcttggattatttccataggatatttttaaagaccagatattcatagtacatagggtataaatacttctatggctcttgaaacataatgccaaattgtgctccaggattgctacatgtactagtgtataatcccacttttcagtgtgtgagaatatctattttaccacatctttctcaaaatgtggtaatcctatgataatcattttaaaaataattatgtaaaatgtgcatttctttgattactaatgaggttgaaattttttgtatgtttatttttcttttgtattttgtaagctgcctgttcagagtttttaaaaatgcagtttttttcagtaacatgtttatctgataattttgtattgatttgtacctagtgaaatgtattaactaattgttgtatatgttgcttattatttagattttgccatctaatcttgattatgaatgctttatatcatcaaatttctaaatttttatgtggtcaaatatattaccttttcattatgatttctttcccctcatcttttctgaatgtttagaatgacttttcttcacgccaagagcagataatgccctatagtctatagagtgtattttagtgtctttatagttgttttttgtcttgttttgttttttttttaacattcaatttttaatccatttggaattcttttgagatacagggattttgtttttcctcccccaatttaaataattctcccaacagcatttgctgacaaccttttgtatttccattgacttgaaatgctatcttgatcagtgctttaattttcatatgcaccaccattgtgtatattgtgtaaattccaattttggtattgtcagagtttgtttttctatctcatggttttgaaatgatatatgattgtttttgcacttcttgattactagtgctgttacacctcttttcacatgtttattgacctctttctattgcttgttcagatcttttgctagtttttcgattagtttgtattttcatggatttgtaacaattctttatatattctgggtagcaattttctgttatatgcattacaactatcttttcctagtccatgatttgactttttactttttgtaaatttcagtgtaattaaattcgtcaattttgtgtggtgtgtgttttccattcttaatttgacagatacttactgagcatctactgtttcagggactattttgggtacttgggataggtcataaacaaaatacacagtatttctagagttcatattctagaagctcaagaaatattcataaaaatattcacatgtatttttccctgaaagtgtttaagttttgctttttcagttttagatcatgaatttacctcgaattaatctttgtatatgatgcgaagtaagaaatgtttttttttcctatatgagtaaccagttatccaggcaccgtttattgattaacacattgtttcttcactgttttgtagtgacacctctgttagatatcaagtttctgcatttgtgtgggtttgtttctgtgtctgttttgtttattggtacacttctctgtccttgcatctgtattacactcttaattactgtggttctataataagccttgatatcataggtcttcctactttgtttttcttcaaaatggtttgacctgtttttagttcctgccttttttttttttttgagatagactctcactctgtagcccaagttggagtgcagtggcataatctgggctcactgcaacctctgcctcccaggctcaagcgattctcatgcctcagcctctccagtagctgggactacaggtgcacaccaccatgcctgtctaattttttgtattttagtagagacgaggtttcaccatgttgcccagggtggtctcgaactcctgagctcaggcgatctgcccaccttggcctcccaaagtgctgggattacaagtgtgagcctctgcacccagccggttcttgccttttgtatatgcattttagaatcagctgaactacagttatatctttggttatgcgtggcttccttttcagggctgctgttagctgtgtcagagtaaaatcctgctatatattggtggtgtcttctggttttaatagttcttaagatccttgaacgtccttgtgcagcttctttcttttttatatttttcttatttatgacctcccccttccctccctcttctctttctttcctttcttcttttcttttctgttactgtttttgcttctattgttcttttcatgttcccatccttgttttttgtttttttcttatggtcattctaaagagtactttaaaaatatatttttattaaagtagtatatggtgcatgtgtcgagggaagcaaataatacagaggcatataaaacaacaggtgcaagtccgtctgatatcaggtggccgagacttcccagatattttatgggggcatgtataaatctgtgtctgttgaaaaaaaggtcatatacagactgttctgtagcttgctttattttttaatttaatttttattttattattattattattttttgagatggagtcttgctctgtctcccaggctggagtgcagtggtgcgatcttagctcactgcaacctccgcctcccgggttcaagcgattcttctgcctcagcctcccaagtagctgggactgcaggcgcccgccgccacacctggctaatttttgtatttttaggagagatggggtttcaccatattggccaggctggtctcgaactcctgactttgtgatccacttgcctcggcctcccaaagtactgggatcacaagcataggacactgcgcccggccagcttgctttattttatttagtattttaaaagacattcttctatcgctaatttattctcatggctgcattgtatgtatatacagtaatttaaccaatcccccattgatggacttgtagatgtctacttcctgatcttgcagctttcagacactactgatcctcactggcaaagtggaagttgggtaatttattttctctctccttacgccttcccttttactcttttaaatttagtggggttctaccaagaactttcctgtatactcttcagagcactggcatgtagctttctcaagagggaagagttggcagtaaaccttggtgtagttcttttgtctggttctatctgtattttactattaaactcaaaagttctttttttttttttttgagatggagtcttgctctgttgcccaggctggagtgcagtggtacagtcttggctcactgcagcctccacctccccggttcaagtgattctcctgcctcagcctcccaagtagctgggattacaggtgcccgccaccacacccggctaatttttgtatttttagtagagacggggtttcaccatattggccaggctggtcttgaactcctgacttaggtgatctacacgccttggcctcccaaagtgctgggattacaggcatgagccaccatgcctggcctctattaacatacggtatcctggaggagagtgtttgtcatatagtgttataagtagcagtctgattgtagagttgaaaaatgaatgagttggagaaaatggagatggagaatttaagcagctctttgccacacacttgactatgagagagcagggaatgaagagatgcagattttgggatttttcattttattggtgttatactttttgaaagaagttaaagttggatctctgtgttacataattttccttctcttaatcctcctagcctccaccaggcggtgtgaagatgcctaatgtacccaatacacaaccagcaataatgaaaccaacagaggaacatccagcttatacacagattgcaaaggttagttcatgttagttgtataaattcatattggccattataatatcaataacatttgctttcagagcaaaataaatctttatatggttacatttctgttgcttaatttttaactcactttcaagtctggatttgctgtcttgtcacccttcaaatactcattcctctttttgtcagcttataccatttgctttattccattattaggaattattgaatttatgtatcatctcagtggataaatttttattgcctttggtcccactttttaatgcacactaccattaaggtaaaaatgatggaataatagatattattgggagagcgttgcaatggtaaaataacagtgttaggaggtagaagatggcaaaaatctgagaagaaaggagattaataagatgcctgatagcatgtaagggcaaattgagttataaagaatttcttaatcacatcttttgacctcattctcctataacatttaagatattagaaaatattcttgcattggtggccttatatatcatttaatctgattaataggagccaattcagttgcccttttttctattgttcattttcctcaactgttcccattgcctctgttcttcactcatttaggcatagaggtcatcttaatttcattttccagattacctaaagattgtgactacttttactaagagaagttttcctctcctaatggacccaacattcccactgagagtttctggaacccaaagaccaaatggaccaaatatcctcataatattttctgtaactatgatcttcagtaaattcctgtactttggaagtgtgtttgaattaggtttctctcatagtagagaagtaggagttagcatataaatgttaaagtattttatacttctgacagtctattcacatattgatattttttatttaggaacatgcattggcccaagctgaacttcttaagcgccaggaagaactagaaagaaaagccgcagaattagatcgtcgggaacgagaaatgcaaaacctcagtcaacatggtagtatccaaagaaatttgaaataaaaataacttttaaatactttacattatgtctatactagctcctaggtcatttggcctgtggataaaaccctaccctgttttcctgttctaacaaggagatcagacacagcagattgcctgtttgatactctgtagccttctaatcttggctgatttgcatagtcttttgttgatagcttagaacagtgttagcctcatcacacagaaaatgaatgtgaatatgataatttttgcttactctgaggccaggagcctttgattctgcagttaggccctccttggttctgtggactctttatgagtacatttgcatgtaccctacatttgacttttacctgatttattcaggttaatttcagattatctgccccagtcctcgcaagtattttgtcaaatcatgttagaaaaattggaagcctaaggtattcatatgatgccaaagaaataagtggtgaattgttgcagtgaattctattaagtttgtgcctgccaaagcacttcaaaggagtctcttagggaaagctagcagtctctgagtaagaagagataaaagagctagataagtcattgttaggatgtctgggatagtgatgcaatgcaaagctagaacaataacaatatacagaactatttctttttaacttagaatgtgtaagtctagggcctcatgagaacacatttatcctgggtcattttcttgcttgcagcatcagaggtagcatctatagaaggagaaactaaaagttgaactgggaccaatgtttctgaagtacctgtaactaaaatccatcctatttctttagcactggcaaatacaaactatttctatgagagttatgttagtaaagacagtaacaaagagtaggaaattaacaattagactgcagtatgttagcacattttagtacttttcccctcttaactcatacttaaatcatcaatacaatcctgtgaggggtgatagagtttttattctcattttacagatatggaaactaaggctcggaggagagagtaagttgcccaaggcgaccttgccagtaagtggctagccacttctggttccagagcctctcttctttacgagtattcactgccgcttctcaaatagtatgagattggtatgagaaatgaactatatgaaatttgaatagtatgataaatggaacacaggagactcattggggagaatcagaaataggttattgttctttctataaaaattaccctggtctgggaaaagtaggtaaaattgaatttttaaaaactgtgggatataacatctaaaatcgggaaatggccttaggtgctgtttttacccgctattttcatgttttgacttctttattttaattttttatttcccccaccatttctcaagtcttatttttaatctggtttctttatgtagacacatttttttccctttacagtttgaatttgtttttctctgcatttttaaaggttctataattcttcagcttccttatcatgactgtttcatgttttctttgttgtagggttttcgtacatgtatcttttggatattattttttcccagattttgagtattctaaatttgattctttggtattggtttaatcttggacttaacagaaaacttgaaaaaattagaagctagtctttctccacttgagataggaattataacagaattatatttgaagatttaagatgctgaggagaaaattgaagtttaaaaactggatggccctttcatgccagccagactctttggactgtgaaataaatctgttttagggtagaagcactggatatgtgctttctttttgtttcttgttttttctgtacataaatggttcctgctaaacatggtatgatatgacactggaaaattattttactatctaatgtgctctaaggtgatgatattctgagaaaattttttaaaaatctaaagcttgtctttcagagttctaggaatacaaagatatagttctacagtttttctgaacttttgttaacataatagagtttttctttattatgaaacaaaaaataatatcacatttgttataatataaataaccttttctttttctaaaaaaaatttacaggtagaaaaaataattggccacctcttcctagcaattttcctgtcggaccttgtttctatcaggatttttctgtagacattcctgtagaattccaaaagacagtaaagcttatgtactacttgtggatgtgtgagtatacaacaatttacatctttgcttagaatttgtatttttgttgtcaaaatccgcatttttatttcaaggatagtatagcaaaccagtcttctttttctatagataaagcttaataatcatgatttcagagtgaaacatatcctatttaggtacttcagaattgtactatatgtgacaatgtaagtccttggctgagaaaaacttgtatgttgagaactggcattcttttgaggaaaagacaacttctctgtcatgtgggtaaaattttataagattctttttccttgaaagatgttatctagacatgatttgcttggaaaaaatagtgcatactaattttatgcagaggaaggccatttaaaagaattctgttaaatgtaggcgttttagctatttttaaaagggcataaaattattacataaactaagtgttctttttatagctttgagtacagtttactttttgttttcaattgcgatacttttattattgaaagtgcttaattaatacaggacattttgttgaacggaacattagaatatacgtttggggctctgatgcttacatcactttgagtataataactcatggaatactgaaacaaaatgtcaagccgttaacagttttactctgtgtgcacagacctcccacttactctctgtttcatttttattccaaacagtagtctcagcctcattttgataccctgtcagaaggggaggtagctattgagggttctcacatgcacaacatctgggttaatggataatttgtagggtacattcttgatggaggaaatttacttgtttttactttatgattaatgagactaccacccttcccttaatggatgagataattttccttaaaatcttttaggagcattcttcatgtatgtcaagttgttttggaatgtgagaagtgtttcctaatggatagtctatttttaactcttcattagtatttttcgagatattcttgatctaatatcttttgctgaatcctcagtgtcagtagtatatatttttaatattaaatgtctgattccatatatgtacatgctaaccaactcttatttaatcaatataatatatgcatttatattttatatatgtttatttttttaaatgggcagaaattgtcctagcattttattttattttgagacagagtcttgctttgttgcctaggctggagtgcaatggcacgatcttggttcactgcaacctccgcttcccgggttcaagtgattctcgtgcctcagcctcctgagtagctgggactacaggcacatgccatcacgcctggctaatttttgtattttcatctatacttggaataattttcatgaactttaaagtgtaattatacatatattttatctttctttcagtggattaggaaataacctaatttgaaaattgaaatttaagttagaatgttcttaaggtctaaaactttttaaggcagctggatgctatttaatgctgcagagtaataattttctatttcacaatcttcaattctgtttttaagatcttaacacaaccacccttattttgaggccaagggttttgagtaaatttattatgagcaagcattcctgagagttaaaaatcctaatgggactagagtaatgagtgagagtgtctcttttgtgatagaattgaatgggattttaaagtgggaaaagctcctgcatttctatggctgaaaaattgaagcttacagaggttgagtgattggcttaatattagatgactacaacctaagtgacttcatctggagctctttttaaaaaaaaacaaaaaacaaaactctagagcttgtttacttatctggtgggttaggtaagagcaaatttaggcatcccagaatgtgtgtgtgtatcctgtttcattaattattaacttatttgatttgtaaagaaatcttaaagtttgagatttaaaaaactagatccaataggttttcccagttgttaattttaattcaagtaatttgttggcatatttttattgatttgataatttacattaaacatcattttagcttatataagaatgtacttactataataaattcagcctgtgaataaatttttaaaaaatcctttgaaacagttattaattacaatgggtcaaagtagttctttaggatcatggtatagttagatgttactcagattttttgtttttggtctgtcagggaaagcaattattaacagcatatgatgaatttgtcaacatctatttgtgttaaccaaaagaaaagcctgccacagtagctaaaatgtatcatgttgtgtgggggagtgaggaggggacttaataaatttaatcctctaccaaaacgcaagtttttttcaggattttacaaatggacagctctatgaagttgaatgaacaatccttatacattgactatatagtcactagaaattgctactgtattagtatttttagtccagtgtttagtctgcagccccattctgtaaagatatggtttttcctcctaagtcctgggtcttttcctggcagacactgcttttcttcttgggcttcagatcaagagacatcacgtttccttttcgggaagaagcccttaaggtagtgcgcctctggtttagctacatcattgcctgtgaggaggagagggccaacagaatttttgccaaacagtacatgtattaagactcgctttcctgtgtatactctgttttcaaatcaaatatgtaagatacaacagtgttttgaaaaatataaatggaaacatggagtagaatacatttgctcttaggaagtatttttttatttacaattttttgttggatgaattcataaattgaatgtaaatctttctttttctattttgttttctgattccacagtccatgcagtaacactgtttctaaatatcttcggatgcttggcttggttttgtgttgattctgcaagagcggttgattttggattgagtatcctgtggttcttgctttttactccttgttcatttgtctgttggtacagaccactttatggagctttcaggtaaaatgtgtgtactttaaaatacactctttaaaacctgtgaagtaaataattcgtagtatacattaaagggaaaattgatgcattttcattaaaaaattcttgtattgttgtgtaacataccttcaggaaagttcaatatagcatgcctgtgtattcattggattttgtaagtcataaaattccatttttttctcccatttgataaaagaccaaacatgaaaattgatggaaaaataagaacagtcttagaagttaatatttataaaatattctcttccatatgttatacttcaaggaaaattttgctgtttgcccaccccacctcccaaatcaaaatcccaattggtgcttatggtttttttttttttaaattaacctaagtaaggtaaatatacatgcaatatttaaaatgagccatttgcacctagcaacttggattattttctttataaatccattttaggttttttcaaaggcagcaccattttaaaaacgatttatgctactaggttaagtataatgctttacatagtatattttaatcagtggttagggttaacatttccttagcgcatgttctgtgggatattaataggtgctgggggagaaaaaaagagctcataagcttagtaaatttgggaacagctggataataaggttaagcaagtttcttcatttcaggatttcttacactctttaagtacctagtatgatttgtgccttatgacttgaccatgcaaccattatttttctgtggagtactttgttggactattgctttaagaagtattgggaaatactgattgaaatgatagtcctatatgggttcatatatttaatagtttttttaaactcatttttatttgagtaaattcttgtgaataaccatttcaactctcgtgaataaggggtaacattactaggatatatgcgtgtgttgtttaaaggatatattagggaaattagaggcccacatttaagtgttcagtatgttttgccattgcaacctaaaatctctttagttaaccagaatgtgtaacacacgcgcgcgcgcacacacacacacacacacacacacacacacacacagagttagaaacccagatctgtaaacagatgagggaaaaacagaagagaacaggagatgggagaacattagggaatttggagagaaaatgtatcagacaatgaagaagtaaattattacttagaaatggcataaagagaagaaatgatgagaggaggagtgaagggaagaaatgatgggagaagggaaaggagaaaagaacctttggatacattgaaatatgggagattggttgccaaggaacggggagagcttctcctgtagagatgggttggagaggaatgaaaggaacatagttactccttgcatgatctgagttattgctgttattttcttcgttatctaagcatggctcacaaggctttttctgttttttgttagtttgttttgttttgttttttttggacatctaacctctgcctaatgacctccatcacattaccaatatgttatcgatctgtgatgatgctggctggtgggagtgaggatatctttatgaaacttttcaaaaaagtgacctgagactagggaatttggattttaaaccttctgttacttatgtagccaaaataaatgactaaaagccagctttgtgccttttatttcctgaagtcacttggtatcttttttttttcccccattttggcagttgaaataaaaatgcttggtggaacatttttacttgtggcattattgatccctaggctgagtttttagctgcatctcagtcttttagagtatatacaaatatattaataatctggttttcactgtgcagagtagaaatgagaggaatactttttttttttttgagatggagttttgctcttgttgcccaggctggagtgcaatggcttgatctcggttcactgcaacctctgcctcctgggttcaagcagttctcctgcctcagcctctcaggtagctgggattacaggcatgcaccaccatgcctggctaattttgtatttttagtagagacagggtttaaccattttggtcaggctggtctcgaactgctgacctcaggtgatccgcccaccttggcctctgcccacctcggcctctgcccacctcggcctcccaaagtgctgggattacagacatgagccactgcgcccagcctcgagaggaatactttttatggggaaagttgaattaaagtatttataatcattaatataccttcctgttatgtatctttggcatttccttatattgatatatttacaggactttgttctccgtaaggtaaactcattgtaaaaatctcaaggaaaattatatagtgaagtttcaaatgtatgtgtttttaaaagttaagtttattaggtatcaggattaaacatgaagttgtcattttgttatttatgtagtttacaaagattgtaacttggggctgggcatggtggctcatgcctgtaatcccagcactttgggaggcagaggctggcggatcacatgaggtcaggcgtttgagaacagcctggccaacatggtgaaactccatctctactaaaaatacaaaaaattagctgagtatcgtggcatgtttctgtaatcccagctcgaggcaggagaatcgcctgaacccgggaggcagaggttgcagtgagccaagatcgtgctactgcactccagcctgggcgacagagtgagatcctgcctcaaaaaaaaagaagaaaaacaacaaaaaaaccccaacttggtcctgaattttgtacttccacaaatcactaggcattatgcaaatacatcaaaatattaggtaattattaacaaggcagcattattgttgaatgttgttgagtaactattagaaacagactgagaaagagtatttgcataatgcttagtgatcttggcttccccacttaaaaagctgtgcggttctgagcacatgcagtaaaactcagagcctcagtttgttaggtttaaatgagggatatttgtagagttgaaagaaggattagagataatgtatgcaagttttgcattatagatggtgaataaatggtagctgtaattaatttttaactttttttggaccctcttagattttatcatttacattttatgatctataagtgaactgtgatttcttatagattatattttacagagccattatttgtagctttgaagacaattttcaaagtagtactttctcccactttttaattatgatgtatttaatgcataccaaagaatacctgaaacacaagttaaaaggcataataatgagtcatctatgaactgtgagcccactggtcaatttaagaaatggaacattatcaataccgctgaagcactggtatgtttccatttccctgctccataggtaaccattaggttgaattttgataatttttgctcattctctagcataattttagtttttcatatatatttgtactcccaaacctttttttagcttgtagagaatatttttaaaagtattttaatatttataaaagtgatacatctttgtatacaggttattttatatgcagttttaagtagctgtgcaaatacttttttggtaaaataaagacctgttttaatccttttctaccaacagttcttgccgctgacttatgtgggcatttacctttatattttaaataatgatcatatactgccattccttgattttgtttaagtagctttattaggatatattgtatatactataaaattcacccactcttatgggaaaattcaatgatttattttattttattttactttaagttttgggatacatgcgcagaatgtgcaggtctattacataggtgtacgtgtgccatggtggtttgctgcacctatcaacccatcatccaggttttaagccccgcgtgcattaggtatttgtcctaatgccctccctccccttgccccccacccctgacaggccctggtttgtgatgttccccttcctgtgtccatgtcttctcattgttcaactcccacttagagtgagaacatgaggtgtttggttttctgttcctgtgttagtctgctgagaatgatggcttccagattcctccatgtccctgcaaaggacatgaactcatttcttttttatggctacatagtattccatggtgtatatgtgccacattttctttatccaatctatcactgatgggcatttgggttggttccaagtctttgctgttgtgaatagtgctgcaataaacatatgtttgcatgtgtctttatggcagaatgatttatattcctttgggtacatacccagtaatgagattgctgatcaaatggtatttctggttctagatccttgaggaattgccacactgtcttccacaatggttgaactaatttacactcccaacagtgtaaaagcgttcctatttctccatggccttgccagcatctgtttcctgatcttttaataatcaccattttaactggcatgagattgtatctcattgtggttttaatttgcgtttctctaatgaccagtgatgatgagctttttttcatgttggctgcataaatgtcttttgaaaagtgtctgttcatatcttttgcccaattcaatgatttttaagtaaattaatagagttgtgcaatcattaccacaatcagttttagaacttttccatccttcccaaaatttccctggattcatttgcacacaattctcattcctttcccctagctccaggaaaccactgatctgttgcctgtgtctaaaaatttctcttttctgagcatttcatgtaaatggaatcatagaacatctagtcttttgctgttttcttttacttagaataacgtttttgaggtttattcgggctgcagaatgtgttagtaattcatttctctttaattgttaaatggtattccattgtattgttacatcacattttatttatgcattcaccagttaatggatatttggctcttttcaacttttggctttttggataataccatgaatatgcatgtgtcttagttcatatttgttgctctaaaggaacacctgaggctgggtaatttataaagaaaagagatttatttggctcgtggttctgcagagtgtacaagaacaatggtgccagcatttgcttctagtgaggacctcagattgcttctccttatggtggaaagcaaacgggagcagatgtgagtagagatcatgtggtgagaatgaagaagccagttgggggagaggtgccatgctctttttaatagccagctcttttggaaactaatggagaacttattccttatcatgagtactgcaccaggccattcatgagggatcatgagggatcgatcattcatgagtgataccctcataacacaaacacctcctgctaggccccacctccaacattgggaatcagatttcagtgtgaggtttgggggatcaaaaatccaaactgtaacagcgtgtacaagtctgtctatggccatatattcatttctcttgaatatatttttaagagttaccataacaatattcctaggagtagccttactgggatgaaactttttttttaaaacgtgtctaaatttttaagaaactgccaaactgttttctaaagtgggtgtaccatttcacattcccatcagcaacgtctgagggttctagtttctctgcatcctcactaactctcatcttttgtcttttgattattgccattttagtgggtatgtagtagtatcttgtggctttaatttgcatttccctagttactgatgaagtttgagcacctttttatttgcttattagacgtgtgtcttttttggtgaaatgtttgttcaagtttattgtctattttaaaaattctgttgttgacttcttactattaagtttatttttaaaatatattttgttgtaagagttctgtattggagatataagttgttttgttttgttgtttaacagtttgcagatattttatcccagtgtgtggcttcttagtggtgccttaagaagcacaaaaacattcaattttaagagtctaatttaactatttttttggtcttgtctggttagtatcatgtctaagatccttttgcataacccatggccataaagattttctcttatattttctcctagaagtttgtggtttatctcttgtgtttaggtgtataatacattttgagttaatttttgttttttgtgtatgaaggttattggtctttatttgtgtaagggtctaaatgcatctttttgctgtggatatccaaatattcctccactacttgttagaaagactatattttgtaaattatctttttgtacttctgttgaaaaatcacttgtccatatatggagaggtctatttttggacttttcccattgaattgtttggacacttttcttgcaaatccattgaccagtgatgtaggatttatttttggactcagttctgatctattgaactatgtgcctatctttataccaatatgcctttcttgactaatgttaatgttgctttatagttagtcagtctttcgactttcttctttttcagaattgttttggctattcagagtcctttgcatttcatttaaattttggactcagcctgtttctacaaaaaataaaaaataaaaataaaaaccctgctgtgattttgatagggattgagttaacactgtaagccagtttggggagaattaataccctgacagcattgattttgtgaatatggatttctctccatttatttatatttttataatttctctcagccatgttcttcagttttaattgcacaaatcttatacttctgttgttaaatttgttactaagtattttatcctttttatgttattttaggtggaattattttaatttcctctttggattgtttgttgctagtagttagaaataaagttgtctttcatatattgatcttgtatcattctaccttgctaacctccttcactaattctagtagtttgtgtgtgtgcatgtgctggtgcacatgcatgctcaagattccttgggattccatatatattatgataatgtcttctgcaaataaaaatgtttgcttattccttccaaagtagttatctttaatcaatccaccttccttttttcctccttttgctttattaaactggctacagcttctaggatagtgagaatagaagtaggaggagtaacatccatgccttattcccaattttaagagaaagcattcaccattaaggatgatattgactgtagatttttttttttttgtagatgccctttgttggtctcaggaacctctcttgtgtttccagtttgttgagttggtttttttttttttttttaatttttttttatcattaatggtgttggatttttccagatgcttttctgttgccatgatctgtggagataatcatgtgatctttgtccacttactctgttaatatggtgagttacattgattgacttttgtaaaccaaccctgcatttctggcatactttccatttggtcattttgagttccttctgggagttgcaatgagggtgctgatttttatgatttgccctaccttggttgaaatacgtttccaagagagttgcagggaatgagagcagttctaggcaagaatgccacagactcatgctgttcttaccagagttcagtagtttccatgaatagatgtttctcagtttgttatgttgtgtgcctttggacagaatactgaaatggttatttttgagtttgatccatatttattgtattttgagaagcggatttgttgacttcctcattctgtcatgctggaagtgaatttccatttcttgatttttaagttttagttgtcttgtactcatttgctgctatggagaataaagcttcagcttttctaaagcttatgttgccccttttccccaacacacatgcatcttttctccccacagtccttctgttacatgtaacaatgattttaggttagactagtatttggagttctttatttattactatgtaaatagtatttacagtatttatttataaatacagtatttatttataaatacagtatttatttataaatacagtatttatttataaatacagtatttatttataaatacagtatttatttataaatacagtatttatttataaatacagtatttatttataaatacagtatttatttataaatacagtatttatttataaatacagtatttatttataaatacagtatttatttataaataaatagtatttattactatgtaaatagtatttacagctgcactttctagtatatcgtgattatattttgttttttgtacagctgtattgctacagtaaatgccttattttgatctgttgctttattttacacacatacacactccttccttcccttctgattctttccatattttctggcaagattgaaaaactatggttcatcctttctgtttatataaccagaaaaagagatttttttttcccaaagcgaagtctcaaactcttcatgaggaaaggtaatattctttatataactacaagaagaacctagtgcttatcagattctcttacgtttatatataaatatatactgttttagagtctacaaatcatgttcagtactttgtattatttagtctttatggtcttttgggcaaattattaggaactgaggttttaacccagatcttcagactagaagcttaggatgttatgttcctactttattatatttacattatcatttagtttgcagtgaatccaggtacatcagtgatttccacacagtaagttaactgactttggaatatttagtaacaatgtttatttcttgactagctctttaactagtgtagttagtatttgttacaaagttctctgcccactgagtgttgagaatgtggagaagataaatagcttgttaactttgtatgcagcttatttcctaatagcttttctgagtatgatctaaggactcttggggccttcctttcagagagcttaggttcctcccttttctaaccatatacatatgtgaagcagatttcttcattttcaaccaaaacaacgtattgtataacagattgagtgcagatacagatataagaaaccatatagatataacattgctaggaattttaaaactctaaaattaacactcctgcatgcacttgaaagaatatatagcctgctcttgttgggtaaaatgttctaaaatgcttcaaaatattcaaaatgcttttgtacttttttttttttttagcattttgtaaaatgttcaaaatgcttttgcagacgcaactataggttgccaaccaaaaaagctactttatatatgaagttgacaagtctatatattaagttgacagtctcttttaattaatgtgcttatgccatttatatttaatataattacttatctgcttggattaaaatctgtcattttaccatctattttctgtttattccaactattctttgtttcttttcctttctttttgccttttttttttttttttggatcagttgagtatctgttaatgactgtcttctcccctatttcttcattatttatatctcttaaaactgttttttagtgatgccctaatttttacaatatatgtctctaatcatagtctctgtattcaaataatattattctgcttcatatgtactgtaaggatctcccagcagagtactctcagttcccccttcccaacctttatacagttttaaaatgtattttatttttatatatgctagaaacacacagtacattacctttaaagaatttttttaatttgaatgggtacataggaggtgtgtatatttataggatatatgagatattttgatacaggcatgcattgtgtaataattacactatggaaaaaggggtagtcatcccctcaagcatttatcctttgtgttacaaacaatttagttatactcttttagttattttaaaatctacaattattttgacaatagtcaccctgtcgtgctatcaaatactaagttactcattctttctaataatttttttgtattcattaaccatctctacctctccggtgccctggcttctgcctactacccttcctggcctctggtcaccatccttcttctatctctatgtgtcactacttttgctttagattttaattttaatttgcttttaattttaaaagaattaaatataaggaaaaatgaattttacattggcctttattaataccatttcagcacttttcatttgtgtgtgtgggtgtatatgtggagatccatgtttttgtatcatatcataatctttttgccagaaaatttttctttaatatttttggtagaacaggtctgctaataatcagttctctgatttttgtctgaaaaagtcttcattttttgttcatctttgaaagatattatcaataagtataatatgggttcacaggtatttttattgtttttactttctttcgtactttaaacacatcattttcatccgttctggcttgcaaagattctggctagaagtccactataattcttatccttatttttctgtatttagtgtgtcttgttttctctggctgtctttaatattttttctgtatttcttgttttggggtgtttgaatatgatgtgttaaagtacgtgtgtgcaatgtgtgttatgtatatgtgtgtgtttctgtttatccttagtgttgtctaatgttcttggatctctggttttgagtcttcattaattttggaaaattctcagtcattcactgtctctttacatatttcttttgtaacttctttatcgtcgctttctgtaatttttattacatatgtgttagaatttttgatattgccccatgtctcttagatgttctattctttatttccattcttttttacttttgcatttcagtatatataatttctattttcagtttcactgattctctcccaccctcagttttgctgagtatattggtgagcttctcaaaggtactcttcatctctgttatgatatttttcatttctaccatatccatttggtaatttcctatatcttatatatatgctaagatgccccatctcctcatgcatgttggccacctttttgactagagtctaagaacatattagtcaattattttaaattttttgtctgataatgccaacacctgagttatatgtgaatatggttttcttgattgctttgtctctacatacttgacagtgtgtcttttttttcttgtttctttttatgcctcataatttcttgttaaaaactagacatcttttgaagacggtagagactgaaataaataggttttgtgccttaagtgggaggtgagatgggatagcaaatcccatcctcctcagggcacagctgaagacccactggacatggcttttctgttgtgctaggcttttagtgtatggatggtgtgctgctgtggtgggggcaggtgtcaggtaattcagtcagaaattgatctgggtttgggtttttgctcaccatgactgccctcagtacctcagagacttcaaattactttggtgttaccttatgtttagagtgagtcctgcttttccagaagctttttcttggtgtttgctccattagcttcgggtttcccctttgtgcctgcccctcagagagggcttctcttcgcacactcttcccccaggagtagagtgctgttacttgttactttatacttggagcatggtgggcatgttggggagttaggggtggaggatattcttgttctggttcagcctcagccttaggcagcctgtgtctctggagtggagagatctgcccttctcagtgatcctgccccaccaccatctctaaggtctctgtaatagatatattcctgtcccacctccagggttagaggattttttttcctgtgccctttccccagctgcagtgggtctttagctgtgccctgaggaaaatgggctttgctatcccattttacctcccacataaagcttttgtttggaagagttaaaggggagttttggtggctgctctttgcctccccaagacctgtaccctgaatgaggccagcctcctgtctttcttctgagcacctggtgagatctgtggagaagagcctgtgagtgagtgatgatacccatgtagctttggctcctgggggttctgtactctctctaaccaacctttcatcttagagcaatgcatcacaagctttagctgaattcctttttgcttgtctgttccaggtaaacaagtgctagtcttttatctctctttgagttatttttggggttgtttgccctttgatgggtgttaagctgtgattttgcaaatgaatgtttgttatgagagttagaaacagtggtcttttccacttttctacgtcctaagctgaagccttcccctactacatctgagagatataggaaagttccttcttagacacagatacatttacttggtggtcctcctcttcctcctccctctcctcccttccttccttctttcttccttccttttcctcctccttcttcagaagttttaaaagcactttagtttttctttttacaatctataaggtttttaaaaaattttttaacattttgtttttacatctatgagttttctttttaaaggtaaacctgtttgtgaagataatcctcttgtgctatatggcatcatttgcacttcagagtaaatcactactgtcagatatctccttctgaaaaactgtgatgcagaaggaagtgttagcttccagtttgaaaatccctgttactgttacagtatttgaggtttataataagtataaaaataacataagaggaatgagattacctttttaaaaatactttttgatgaatcatttctggattctggattctgtgtgtattctattagctggatattttgtacacatctgatttttaaaaggaaatatggataaatggtagcattattctagaacagcaacagtaggtatgtcagaaacatgtatggtgtatctaagagtagtttagaggtagaacagagcaggatgaaacatgtttacttatttcatacatatgtaaatataagttatatatagtgttgacttaaatcatgagatctataaatatagaaaaggagagctttatttcttacagaggattacagcctgcaggcttattaacatgacctacaatatgaaggttttttttaattttttattatactttaagttctagggtacaagtgcacaacgtgcaggtttgatacataagtatacatgtgccatgttggtttgctgcacccatcaactcatcatttacattaggtatttctcctaatgctatccctcctccagcccccaacccctcattgtgtgatgttccccgccctgcgtccaagggttctcattgttcagttcccacctatgagtgagaacatgcagtgtttggttttctgtccttgcgatagtttgctcagaatgatagtttccagcttcatccatgtccccgcaaaggacatgaactcatcctcttttatggctgcatagtattccatggtgtatatgtgccacattttcttaatctagtctatcattgatggacatttgggtttgttccaagtctttgctattgtgaatagtgccggagtaaacatacgtgtgcttgtgtctttatagtagcatgatttgtaatcctttgggtatatagccagtaatgggatggctgggtcaaatggtatttctacttctagatccttgaggaattgccacactgtcttccacaatggttgaactaatttacattcccatcaacagtgtaaaagctttcttatttctccacatcctctccagcatctgttgtttcctgacttttgaatgattgccattctaactggcgtgagatggtatctcattgtggttttgatttgcatttctctgatgaccagtgatgatgagcattttttcatgtatcttttggctgcataaatgtcttcttttgaaaagtgtctgtccatatcctttgcccactttttgatggggttgttttttccttgtaaatttgttttgagacttttgtagattctggatattagccctttgtcagatgggtaaattgcaaaaattttctcccattctgtaagttgcctggtgactccgatggtagtttcttttgccatgcagaagctctttagtttaattagatcccatttgtctattttggcttttgttgctactgcttttggtgttttagtcatgaaatccttgcccatgcctatgtcctgaatggtattgcctaggttttcttctagggtttttataattttaggtctaacatttaagtctttaatccatcttgaattaatttttgtataaggtataaggaagggatccggtttcagctttctacatctggctagccagttttcccagcaccatttattaaatagggaatcctttccccatttcttgtttttgtcaggtttgtcaaagatcagatggttggatatgtgtggtgttatttctgaggcctctgttctgttccattggtctaaatatctcttttggtatcagtaccatgctgtttggttactgtagccttgtagtatagtttgaactcaggtagtgtgatgcctccagctttgttctttttgcttaggattgtcttggcaatgcaggctcttttttggttccatatgaactttaccgtagtttttttccaattctgtgaagaaagtcactggtagcttgatggggatggcattgaatgtataaattaccttgggcagtatggccattttcacgatattgattcttcctatacatgggcatggaatattcttccatttgtttgtgccctcttttatttcgttgagcagtggtttgtagttctccttgaaggggtccttcacatcccttgtaagttggattcctaggtattttattctctttgtagcagttgtgaatgggagttcactcacaatttggctctctgtttgttattggtgtataggaatgcttgtgatttttgcacattgattttgtatcctgagactttgctgaagttgcttatcagcttaaggagattttgggctgagatgatggggttttctaaatatacaatcatgtcatctgcaaaatttgacttcctcttttcctaattgaatacccgttatttctttctcttgcctgattgccctggccagaacttccaacactatgttgaataggagtggtgagagagggcatccttgtcttgtgccggttttcaaagggaatgcttccagtttttgtccattcagtatgatattggctgtgggtttgtcataaatagcttttattattttgagatatgtcccatcaatacctagtttattgagagtttttagcgtgaagcgctgttgaattttgtcaaaggccttttctgcatctattgagataatcatgtggtttttgtctttggttctgtttatgtgatggattatgtttattgatttgcgcatgttgaaccagccttgcatcccagggatgaagcccacttgatcatggtggataagctttttgatgtgctgctggattcagtttgtcagtatgttactgaggatttttgcatcgatgttcatcagggatattggtctaaaattctctttttttgtgtgtatctctgccaggctttggtgtcaggatgatgctggcctcataaaatgagttagggaggatttcctgtttttctattgtttggaatagtttcagaaggaatggtaccagctcctctttgtacctctgatagaattcggctgtgaatccgtctggtcctggactttatttggttggtaggctattaattattgcctcaatttcagagcctgttattggtctattcagagattgaacttcttcctggtttagtcttgggagggtgtatgtatccagtaatttatctgttttttctagattttccagtttatttgtgtagaggtgttcatagtattctctgatggtagtttgtatgtctgtaggatcggtggtgatacccctttatcattttttattgcatctatttgattcttctctcttttcttctttatcagtcttgctagcagtctgtcaattttgtagatcttttcaaaaaaccagctcctggattcattgattttttgaagggttttttatgtctctatctccttcagttctgctctgatcttagttatttcttgctttctgctagcttttgaatgtgtttgctcttgcttctctagttcttttaattgtggtgatagggtgtctattttagatctttcctgctttctcttgtgagcatttagcgctataaatttccctctacacactgctttaaatgtgtcctagggattctggtacgttgtgtctttgttctcattggtttcaaagaacatttttatttctgccttcatttcgttttttaccccatagtcattcaggagcaggttgttcagtttccatgtagttgagcggttttgagtgagattcttaatcctgagttccagtttgattgcattgtggtctgagagacagtttgttgtgatttctgttcttttacatttgctgaggagtgctttacttccaattctgtggtcaattttagaatatgtgcaatgtagtgctgagaagaatgtatattctgttgattttgggtggacagttctgtaggtgtctatcaggtccgcttggtgcagagctgagttcaagtcctggatatccttgttaaccttctgtcttgttgatctgtctaatgttgacagtggggtgttaaagtctcccattattattgtgtgggagtctaagtctctttgtaggtctctaaggacttgctttatgaatctgggtgctcctggattgagtgcatatatatttaggatagttagctcttcttgttgaattgatctgtttaccattatgtaacagccttctttctctcttttgatctttgttgatctgaagtctattttatcagagactaggattgcaacccctgcttctttttgctttccatttgcttggtagatcttcctccatccctttattttgagcctatgtgtgtctctgcaggtgagatgggtctcctgaatacagcaccctgatgggttttgaatctttatccaatttgccagtctgtgtctttcaactggggcatttagcccatttacatttagggttaatattgttatgtgtgaatttgatcctgtcattatgatgttcgctggttattttgcctgttaattgatgcagtttcttcctagcatcgatggcctttacaatttggcatgtttttgcagtggctggtactggttgtttttttccatgtttagtgcttccttcaggagctcttgtaaggcaggcctagtgatgacaaaatctctcagcatttgcttgtctgtaaagtattttatttctccttcacttatgaagcttagtttggctggatatgaaattctgggttgaaaattgttttctttaagaatattgaatattggcccctactctcttctggcttgtagggtttttgccgagagatctgctgttagtctgatgggcttacctttgtgagtaacctgacctttctctctggctgccctttacattttttccttcatttcagccttggtgaatctgacaataatgtgtcttggagttgctcttctcaggtagtatctgtgtggcgttctctgtatttcatgaatttgaatgttgacctgccttggtaggttggggaagttttcctggataatatcctttagagtgttatacaacttggttccattttccccgtcactttcaggtacaccaatgagacatagatttggtcttttcacatagtcccatgtttcttggaggctttgttgatttctttttactcttttttctccaacacttcatttcattcatttgatcttcaatcactgataccctttcttccacttgatcgaattggctactgaagcttttgcatgaatcacatagttctcgtgccgtggttttcagctccatcaggtccttttaaggtcttctctatgctgtttattctagttagccattcgtctaatcctttttcaaggtttttagcttcgtgatgggtttgaacatcctcctttagctcggagaagtttgttattacggatcgtctgaagccttcttctctcaactcgtcaaagtcattctccgttcagctttgttcccttgctggtgaggagctgtgttccttttcaggagaaggggcgctctgatttttagaattttcagcttttctgctttggtttctccccatctttgtggttttatctacctttggtctttgatgatggtgatgtatagatgggattttgttgtggatgtcctttctgtttgttagttttccttttaacagtcaggactgtcagctgcaggtctgttggagtttgctggaggtccactccagactgtttgccttggtatcaccagcggaggctgcagaacatcaaatattgcagaacggctaatgttgctgcctgatccttcctctggaagcttcgtctcagaggtgcacctggccgtatgaggtgtctgttggcccctactgggaggtgcctcccagttaggctactctggggtcagggacccacttgaggaggcagtccgtccgtcctcagatctcaaactccatgctaggacaaccactactctcttcaaagctgtcagacagggacattgaagtctgcagaagtttctgctgccttttgttcagctatgccctgcccccagaggtggagtctacggaggcaggcaggcctccttgagttgtggtgggctccacccagttcgagcttcccagcagctttctttacctactcaagcctcagcagtggtggacgcccctctcccagccttgctgccaccttgcagttcgatctcagactgctgtgctagtagtgagcaaggctctgtgggcgtgggaccctccgagccaggcacaggatataatctcctggtgtgccgtttgctaagaccattggaaaagcacagtgttagggtggaagtgtcccgattttccaggtaccatctttcatggcttcccttggctaggaaagggaattccctgacccctttcacttcccaggtgaggtgacaccctgccctgcttcggctcaccctccgtgggtggcacccactgtccaaccagtcccagtgagatgaaccaggtacatcagttggaaatgcagaaatcatctgtcttttgtgtcgatcatgctgggagctgcagaccagagctgttcctatttggccgtcttcaaacggatcactataaagttttgatagttgatttagggtttgaagttatgttaacactttattgaagagtttaggggggaaaatgatgtttcaaagtatatgattaaaatagttaggaaatttcaagtgtaagagtgataggaccatcaagagaattaatattaaacttttcaagtggtattagtaaaaagctggctgggtcagggcacgctggcccatgcctgtaatcccagcactttgggaggccgaggcaggcggattacctgatgtcaggagtttgaatccagcctgaccaatgtggcaaaaccccgtctctactaaaattacaaacaaaacaaaacaaaaattagccaggcatggtggcacgtgcctgtaatgccagctgtttgggaggctgaggcaagagaattgcctgaacctgggaggcggagtgagccaagatcagtgagccaagattgagccactgcactccagcctgggcaacagagtgaggctctgtctcaaagcaaaaaggtgactgggtgtggtggctcatgtgtataatcccagcattttgggaggccaagaggagaggattgcttgagcttggtgctcgagaccaggctgggcaacatggtgaaacctgatctctacaaaaagtacaaatattagtcggttgtcatggcatgtgcctgtagtcccagctactcgggaggctgaggtgggaggattgattgagcccaagaggttgaggctgcagtgagctgtgatcatgctgctgcactctagactgggtgacatagtaagaccttgtctcaaaaaaagaaggaaaaaagcatgataaatagtttcatgatgtggtattctagatgtttgaaaactcaaacttgtactgtttagtattctctgttcagataggtatcatggaggcttatttgcagaaaaatgtttgagttttttgtttgtttgtttgttttgagacagagtctttctctgttgcccaagctagggtgccgtggctctatctctgctcactgcaacctcagcctcctgggttcaagcagttctcctgtctcagcctcctgagtaggtgtccacaaccatgcctggttaatttttgtatttttagtagagacagagtttcaccatgttggccaggctggtctcgaactcctgacctcaggtgatctgcctccctctgcctcacaaagtgctgggattacaggtgtgagccaccgcgcccggctgagttttgttttataagagcatagcctatgtaatagcttggaaacagtccatttgtgacctaggacctaatcaatgttgatttccgttttccttttatttaatttttttgttcaaaggtaatttgaaaatggttatctactggctgattttgtctgtttaagctttctacattgagtatcaattcaaatgtgagattttagttgttatattctcctatatataagaaacactgcattgagcatttggggttattatactttagctagtggtgttctattccttgataattaaatttcttggagatgatggaattgaaatattatcttagaggtagttttatcacttggttaagaattttagcttaaggctgggtgccatggctcatgcctgtaatcccagcactttgggaggccaaggcagccggatcatgaggtcaggagttcgagaccatcttggctaacacggtgaatccctgtctttactaaaaatacaaaaacaaaaatattagctgggtgtggtggtgggtgcctgtagtcccagctatgcgtgaggctgaggcaggagaatggcatgaaccctggaggcagagcttgcagtgagctgagatcgtaccactgcactccagcctgggcaacagagctagactctgtctcaaaaaaaaaaaaaaaaaaaaaaaaagaattttaccttaatagatgcacagataagtagcagcatttctgttaccagctatgtatttggattatttgacctctctaaatctgtttgcttatccgtaaaatggagtcaatattagtgtgcctcacgtgggtgttgtaaggtttgaatgggcaatacatgtgtttgacatagtgcttggcaaataatgttcaaaaaatattagctattattaagtctgttaagtatagaggattcagagtttgcaccaaggttgtggtctaggtttgatattgttcaggtttaaaacttcatgtaatgtgagctttttcattgacccctgtgcttttgacaaagcataggtgggaagaagagagttcagagtctctttcattccagtcctgtgcttttttagccagactagtgagtggttttgcttttttttttttttttttttttttgagataggatctcattctgtcacccaggctggaatacagtagcacaaccattgttcattgctgctttattttccaggctcaaatgatcctcctgcctcagcctcccaaataggcaggactacaggcatgtgccactacacctaatttttcttatttttaatagagatgaggtcttactgtattgccccacgctggtcttgaactcctgagctcaagcgaacctcccaccttggctcctaaagttctaggattacaagcgtcaaccattgtgcccagctcttaatagattttaagagatagactctattataaatttagaattttcgaatcttcttccaaaaaaacacatatgcaaattttttttgcactgttgtggtaaggggcagttcatagtgctgcctttcaagcctactaatagactccctattctggagaaagaattcatttcagcataaagttactaaagagggaatatggggctggtttagacagttttggagcccccaaataagacaagaaaagcacctgtacttcttaggtttctgtgttagtccattttcatattgctatgaagaaatgctcaagactggttaatttataaagaaaaagatgtttaatggactcacagttccacatggctggggaggcctcacaatcatggcagaaggggaaggaggagcaaaggtatgtcttacatggtggcaggcaagagagtgtgtgcaggggaactgccctttataaaaccatgcagtcttgtgagacttactcactttcatgagaacagcacaggaaaacctgcccccatgattcagttacttgccaccaggtccctcccatgacatgtgaggattctggaagctacaattcaagatgagatttgagtggggacacagccaaattctatcagtttctttttattctaatgcctgtacaccatcaataatttcttgtattacttgattctagtagtcttgattgttagcaaccatgttccagaaattttcagtatcttatcaatagcctaatgccacttctgtgagcaggacattacttctgtgagcaaaacagtttattttgatacagtattacatgagtgtaatacaggtatcaacaagtaatgtttatcagttgctttctgtgtgcctatgcattcccagctaagcactttacctgcagtattttatttatataaaagcatgttccactgttacccccattttgcaaatggaaaatctcaggcttaatactttgcccaaagttacacaactttaagtgggagagtctggattcaaacccaaatctgtaaattcatgttctcttatctgctatgttgagttgccagagttaaatacatttagtggtgtgctttagttaacttgtgtccccccatcttagcccttgaaataatgaaatactttgtcttttcccatcccagcaaatggtagttgtaattaatatctctggtattgatttggcatgtgaaataaactttacaagatcaaataagcttattttctgagatttattatcatacttcagggaagaacttttctattaaaattgtgctgcagcttgactgtggaagacattaaaccaaaaactacttgcttatttgaaattcagttttccagtaggctttgatctgaaagagccaggatggcaagtagtagagagcttttatttatgtgttctgatgagaaaatacattacttaggtggatttattatgaataaatatccatgataccgtaaatactttatcgtaaactgaggcagattacaatttaattcacataggttaaatcaatgtatagtgtttttatttttaaatctatatttctgttctttggtttaaaatggctatgttcaagctgatttaaacagtctgctttctggtctcttcctgcacgcaagacccaccttctgaatgccaatagaagttcttcttcccctgatgatgtatttttttttttcctggaccttttctgattctggctaaggtacagctctcctgggtgtcttctggctattccagagctcctcagcttttccttgcccttccctcaagcatctgaaaggaacttgatattcacgtgatgattgtattgcttcattttgttttgaatttgactgattttgcatttgcagtaatttggacagctcaggtaaaggaagatttgtgctctcttggagataagagtctaggtagttaagtaagtgctgggatatggagtttatgtcttagagaactttgaagtgttttaaaataattattcgtattaacggtcagtgtgcaatgaaatgaattttattgtctccttattcagaaatagaaaagttggtaaaatgaaataaatacaatctttgagaatgatatttaacctgcttaatatcttttatttagctttatttaaaataaaactagacaaaagtaaactttgaggttttcatttgatcagttttgtacactaactgtgcatttgtgtgtactaactgtacatacagaaagaggaaggtggactagttttaacatacctccatttgtatttgaaagcaatattttagaaatagtttttgagtaggacttcttaatttttaaaacatattcagtatcttctaatagatttcttaactagaaattacagttaggcagtttcagcttctagaatgtgtctaagaatttggaacaaggtaatggacatagctgttgtgaaggctgtagacattattcagcccctttttagagcacatactttatatatttataatgtaaaatattttaatagtctggtttcttggcacacaaaatagtaaaaactctaagtgaaaaaaatataatattaagttatattcttcattctttgccagagggacagggaaatagaaatatactttagaagtgtctgtttcaaaatagtaaaagaaaaattagtattaaaagtgatgtgttctatagtatccctggagatatgagtcatacataggatttctattcagtattataaaaatagcattttatattgtagattttgatattggttatttttcattaataattttttctcagctgtatggtcattaataccagctttggtgtaatatagtactgctgcaataagatgtggaaccatttagtttaaatctgactgacatagaaaacattattaatgaaccattaaaatttgctcttttgtgactcaggggaaatggctgattctagagtaggggtctccaacccctgggctgtgggcttgtactggccagtgacctgttagaaactgggccacacagcaggaagtgagcaccagctagcgagcattaccacctgagctctgcctcctgtcacatcaacagtggcattagattctcataggagcacaaaccctattgtgaactgcgtgtgcaaaggatctaggttgcatgctccttatgagaatctaatacctgatgatctgagatagtttgatcctgaaaccatcccaccccaccatacgtagaaaaattgtcttccacgaaacaggtccctggtgccaaaaaggttggggaccactgctttaatgtattcatgttaactcattgccatgttttatactggttgtagaaatgtaaaaaccttaaaatagtcaagacaactttgaaaaagaacaataaagttgatggactaacaccacctaatttgaagacttactagaaaacttcaaaatagtataatattgacaaaaaggtagacaaatagaagagtgggagagaatggcaagcccagaaataaacccagccatagacagactactaattttgagaaaggtacaaagggaacgtaatgcagaaaggacagtctttttaagaaatgctgctagaacaattggataaccatatgcaaaaaagaacttcatacttgatatgatattttaaaaaattaactcaaaaaagaacatagacttgaatgtaaaactgaaaatagaaaactcctagaaaaaaacaggaaaaaaaaaatctttgcattcttggctttggcagatttctcagaaacaacagtaaaatcaagatatataaaagaacaagcgtgaatacactggagttcgtaaaaaggcaaaactccttttcaaaagaaactttcttcttcttcttcctcctccctcctccccctctccctcccctcccttctttcccctccctcctcccctgccccccttcccctaccccttcctcccccttctccctcctccctcttctccctcctgcctccttcccccttcctccctccttccccctctttccctgtcctccctctcctcccctcctcccccgtcctctcctcctccctcctctcctcctcccctctccttccccctcctccccttctccccgttccccctcctctccccctccccctccctcctcctttccccctcccccttccccctactccactactgctactactacttcttcctcttcttcctcctcttcttcttcctccttctcctcctcctcctcttcctcttcccttttgtttttttttgtttttttttaaaataaagatgggtgtgtcaccatgttgcccaggctcatgtcaaactcctagcctcaagcagtcctcttgcctcaatgtctaaatagctgagattacaggtgtgaaccattacaccagctcccaaaagacactcttaagagaatgaaaagacaagcaacagacggagggaaaatctttgtcaaggatatatctgaaagaggacttgtatttctagaatatagttttaaaaactctcacaactcaacgataaaggaaaaagcaatctaattacaacatcagaaaaatattttaattagttcatgaaagaagatctatatatgacaaaaagcacataaaaagatgctcaacaacattacttattaggaagatgcaaattaaaaccatgtaagatattactgtacagctattacaatagctagaattaaaaagactgtaacaagtgttaatgagatgtggaggagctggaatactcatgtactgccagtggggatgaaaagtagaacaaccaggctgggcacagtggctcatgcctgtaatcccagcactttgggaggccgaggcgggcagatcacctgaggttgggagttcgagaccaacctgaccaacgtggagaaaccccctctctactaaaaatgcaaaattagctgggcatggtggcccatgcctgtaatcccaactactcgggaggctgagacaggagaatcgcttgaacctgggaggcagaggttgtggtgagccaagattgcgccattgcactccaacttgggcaagaagagcaaaactccgtctcaaaaaaaaaaaagaaaatgtaaataaaaatagaacaacctgtttgtaaaacagtttggcagtttcttaaaaagttaaacgtatacctatgatatgttccagccttcccacttgtaggtatttacctaagagaaaaaggaaatatatgttcatgggaagacttgtacatgactattaataatagctttattatgaataataacaataataactttatttataataataaaaaactagaaacaacctaactgtcccaacagtgaatgaataaactgtggtatatttacacagtggaatactactcagcaatgaaaaggaatgaacttttgatacatgccacaaaactgggtgaatctcagaatagctgtgctgagtaaaataagccagacaaggaaaaaagactacataatatatgatcccatttatataaaattctataaaatagtcaaactatggtaacagaaaaacagtgggtagggtggggctaccaaggggctcaaggaaactttggggatatgctcatcatagtgattggggaatcaagtatataaatatgtcaaaaattattaaagcgatattttaaatatttgcaattcattgtgtgttgattgtaattctatgatgctgtttaataaaagaagaaaacgagtaagtttttttgtcaagagggattgtggtgcagttggaaattgaaagtttgtccttgtgaggttagaataacgatatctagtgttagcatgacgagttcacataagttattacaatgttgttaacttgaggcctcaggtggttgccacttttttttgtttgtgcttttaaggtttgaatgtcattctgcaggtaaatgtaaagataatgagaaaaatgacgtttttccccttctttctctccccctaacccccttttttctttctttctttttttttttcaaaggagtgacagttcatttagattctttgtattcttcttcgtctatatttgtcagtttgctgtacatgtactccaagctgcaggatttcataactggggcattggtaagtttttttttttactagttttcagctttaatctaatattgtaatataatttttggcttcctaatctagttaacacagataaaccagattagaaaaattaaataaaaagcaaaaattgttttaaaaatacaattttaaaatgtcataaggcataaactttggacaaacctgtgtctttgaagattatgttcccatctataaaaacagcacattttttctagtttaaataaaacatgtatgtaagggcgctaagaggaagactgcaaaagagactgaggtggtcagagagatagagggaccaaggaatgtggaagggacaggaaagagcttcagggattctaaggaaaagggatacctattatgtataaagccctattttaggtatacaaacagatatatttttatatacgaatatacatggacacttgtctttgaaaggtagaataactgcacacacgttatatacatatatctttaaacaatcgaatcattctcatggctcattcagtgggggacctcagaaatggagactatctggacccaggctaggaggtaatagcagatttaggtctctctttacattctgatgcaaacattccttgagtgaaatggtgggtggaagagtacacatctctaaaattatctgttcctctcttctttcttttatactgacttgcattcagctgtattcttacatgtcagaagaatgtgtgatgcaactttgttccactgtgtacattaaaccaaaattgaaattagcatttaattagaatgtgttgaggacttacatttagtattctgctactgaagtggagaagtgattggcagacaactcctggcagttctgcagagctcctaatgggcataaatacatgcagaaaatttatatagatatttaaaatcagttctcagataaagtagtttttattattattttaaatagtgtctagtttttggtattttagggaaaggaaatgttttaaatgtttaattaaaaatatactgcttactttaacagcacgaggtttttttaattctcgtgaaagtgaggtaatttctttcgctttttagcacagacatagggaaaatgctaaaattgagcataacagcatgtatgtgactaaatagcgtaaaaagagtctgctaatgagggtgcatacagaattgacctgttttaagatagaccctcatgtagttcagattttttaggttaaactttttacttttaggtaatcatagattcacatacaatcataataaataacacagaaatctcaggtaccctttatcctgtttcacccaatggtaataatcttgtagaactatagtaaaatataaataccaagatcttgacattgatagtaaagataaagcacattttcatcaccagaggattcctcatgttgctttttcatagccactctcaaaactccccttttcccactccttaacccctggcaatcactaatgtgttcttcatttttgttgttttgtcatttcaagaaggttatagatgtggaatcatagtctacaacctttggcttttttcccctcagtgttattttctggagatttatccaggttgttatgtttatctgtagtttattctaatttgattgattgattgattgattgattgagacagagtctcgccctatcacccaggctggagtgccgtggcatgatctcagctcactgcctccacctcctcggttcaagtgattctcatgcctcagcctcccgagtagctgggattacaggcgcctgccacccagcccagctaatttttctatttttagtagagacaggatttcgccatgttgcccaggcaggtcttgaagtcctggcctcgtgtgatctgcccgcctcagccttccataatactgggattacaagcgtgagctaccatgtctggcctcctttttatttttgagtagtattctatgatatggatgtatcacaggttatttaactgttcaccagttgaagggcatcagtattgtgtccagttttggactattacaaataaagctgccatgaaatttgtgaatagatttttgtgtgaacataattttcatttctctgggataaatgcccaagagtgtaattattggattatatggatgttgcacatttagttttcttttctttttttttttattatactttaagttttagggtacatgtgcacattgtgcaggttagttacatatgtatacatgtgccatgctggtgcgctgcacccactaactcgtcatctagcattaggtatatctcccaatgctatccctcccccctccctccccccaccccacgacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgccattgtgaataatgctgcaataaacatacgtgtgcatgtgtctttatagcagcatgatttatagtcctttgggtatataccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatgatatctcattgtggttttgatttgcatttctctgatggccactgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagacgagtaggttgcgaaaattttctcccattttgtaggttgcctgttcactgtgatggtagtttcttttgctgtgcagaagctctttagtttaattagatcccatttgtcaattttggcttttgttgccattgcttttggtgttttggacatgaagtccttgcccatgcctatgtcctgaatggtaatgcccaggttttcttctagggtttttatggttttaggtctaacgtttaagtctttaatccatcttgaattgatttttgtataaggtgtaaggaagggatccagtttcagctttctacatatggctagccagttttcccagcaccatttattaaacagggaatcctttccccattgcttgtttttctcaggtttgtcaaagatcagatagttgtagatgtgtggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggatagccttggcgatgcgggctcttttttggttccatatgaactttaaagtagttttttccagttctgtgaagaaagtcattggtagctttatggcgatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctgggtattttattctctttgaagcaattgtgaatgggagttcactcatgatttggctctctgtctgttattggtgtataagaatgcttgtgatttttgcacattgattttgtatcctgagactttgctgaagttgcttctcagcttaaggagattttgggctgagacagtggggttttctagatatacaatcatgtcgtctgcaaacagggacaatttgacttcctcttttcctaattgaatgccctttatttccttctcctgcctaattgccctggccagaacttccaacactatgttgaataggagtggtgagagagggcatccctgtcttgtgccagttttcaaagggaatgcttccagttcttacccattcagtatgatattggctgtggggttgtcatagatagctcttattattttgaaatacgtcccatcaatacctaatttattgagagtttttagcatgaagtgttgttgaattttgtcaaaggctttttctgcatctattgagataatcatgtggtttttgtctttggctctgtttatatgctggattacatttattgatttgcatatattgaaccagccttgcatcccagggatgaagcccacttgatcatggtggataagctttttgatgtgctgctggattcgttttgccagtattttattgaggatttttgcgtcaatgttcatcaaggatattggtctaaaattctcttttttggttgtgtctctgccaggctttggtatcagaatgatgctggcctcataaaatgacttagggaggattccctctttttctattgattggaatagtttcagaaggaatggtaccagttcctccttgtacctctgatcgaattcggctgtgaatccatctggtcctggactctttttggttggtaaaatattgattattgccacaatttcagatcctgttattggtctattcagagattcaacttcttcctggtttagtcttgggagagtgtatgtgtcgaggaatttatccatttcttctagattttctagttgatttgcgtagaggtgtttgtagtattctctgatggtagtttgtatttctgtgggatcagtggtgatatcccctttatcattttttattgtgtctatttgattcttctctctttttttctttattagtcttgctagtggtctatcaattttgttgatcctttcaaaaaaccagctcctggattcattaattttttgaagggttttttgtgtctctatttccttcagttctgctctgattttagttatttcttgccttctgctagcttttgaacgtgtttgcccttgcttttctagttcttttaattgtgatgttagggtgtcaattttggatctttcctgctttctcttgtgggcatttagtgctataaatttccctctacacactgctttgaatgcatcccagagattctggtatgctgtgtctttgttctcattggtttcaaagaacatctttatttctgccttcatttcgttatgtatccagtagtcattcaggagcaggttgttcagtttccatgtagttgagtggttttgagtgagattcttaatcctgagttctagtttgattgcactgtggtctgagagatagtttgttataatttctattcttttacatttgctgaggagagctttacttccaagtatgtggtcaattttggaataggtgtggtgtggtgctgaaaaaaatgtatattctgttgatttggggtggagagttctgtagatgtctattaggtctgcttggtgcagagctgagttcaattcctgggtatccttattgactttctgtcttgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagagtaggattgcaacccctgcctttttttgttttccatttgcttggtagatcttcctccatccttttattttgagcctatgtgtgtctctgcacatgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggtgattttgctcgttagttgatgcagtttcttcctagtctcgatggtctttacattttggcatgattttgcagcggctggtaccggttgttcttttccatgtttagcgtttccttcaggaactcttttagggcaggcctggtggtgacaaaatctctcagcatttgcttgtttgtaaagtattttatttctccttcacttatgaagtttagtttggctggatatgaaattctgggttgaaaattcttttctttaagaatgttgaatattggcccccactctcttctggcttgtagggtttctgccgacagatctgctgttagtctgatgggcttccctttgagggtaacccgacctttctctctggctgcccttaacattttttccttcatttcaactttggtgaatctgacaataatgtgtcttggagttgctcttcttgaggagtatctttgtggtggtctctgtatttcctgaatctgagcgttggcctgccttgctagattggggaagttctcctggataatatcctgcagagtgttttccaacttggttccattctccccatcactttcaggtacaccaatcagacgtagattaggtcttttcacatagtcccatatttcttggaggctttgctcatttctttttattcttttttctctaaacttcccttcttgcttcatttcattcatttcatcttccattgctgataccctttcttccagttgatcgcatgggctcctgaggcttctgcattcttcacgtagttctcgagccttggttttcagctccatcagctcctttaagcacttctctgtattggttattctagttatgcattcttctaaatttttttcaaagttttcaacttctttgcctttggtttgaatgtcctcccgtagctcagagtaatttgatcgtctgaagccttcttctctcaactcgtcaaagtcattctccatccagctttgttccgttgctggtgaggaactgcgttcctttggtagaggagaggcgctctgcgttttagagtttccagtttttctgttctgttttttccccgtctttgtggttttatctacttttggtctttgatgatggtgatgtacagatgggtttttggtgtggatgtcctttctgtttgttagttttccttctaacagacaggaccctcagctgcaggtctgttggaataccctgtcgtgtaaggtgtcagtgtgcccctgctggggggtgcctcccagttaggctgctcgggggtcaggggtcagggacccagttgaggaggcagtctgcccgttctcagatctccagctgcgtgctgggagaaccactgctctcttcaaagctgtcagacagggacatttaagtctgcagaggttactgctgactttttgtttgtctgtgccctgcccccagaggtggagccttcagaggcaggcagtcctccttgagctgtggtgggctccacccagttcgagcttcccggctgctttgtttacctaagcaagcctgggcaatggtgggcgcccctcccccagcctcgctgccgccttgcagtttgatctcagattgctgtgctagcaatcagcgagactccgtgggcgtaggaccctccgagccaggtgcaggatataatctcgtggtgcgccattttttaagccggtccgaaaggcgcaatattcgggtgggagtgacccgattttccaggtgcgtctgtcacccctttctttgactcggaaagggaactccctgacctcttgcgcttcccaagtgaggcaatgcctcgccctgcttcggcttgtgcacggtgcgcgcacccactgacctgtgcccactgtctggcactccctagtgagatgaacctggtacctcagatggaaatgcagaaatcacccgtcttctgcgtcgctctcgctgggagctgtagaccggagctgttcctattcggccatcttggctcctctccgcatgtttagttttctaaagaaacagacaaactgttctctagaatgcttgtgctattttacactcccaccaacaattatgagcaatttagtctccacttcctcaccagcatttagtggttattactttttattttagccatcctaataggtgtgtagtgatatctcattgtggttttgaacatcttttcatgtgcttatttgtcgtctttatgtcctcttagtaaaatgtctctgcatgtcttttatccattttcttaatttttgtattctgttgagctttgaaagttatgtatattctagatgtgaatcctttgttggatatatggtttataaatatcttctttcataattcagcagaattgaaaataaacatttaaaaaaatgtaataataggccaggtgcagtggctcacgctataatcccagtttgggaggccgagtcaggtggatcacgaggtcaggagttcgagaccagtctgaccaacatggtgaaaccccgtctctactaaagatacaaaaagtagccaggcgtggtggcacgcacctgtaatcccagctactcaggaggctgaggtaggagaatcgcttgaacccaggaggcggagattacaatgagccgagatcatgccactatactgcagcctgggcaacagagcgagcttctgtctcaaaaaaaagagtaataataaattcaaaactcataagcttaaaaaatgtacagcttaaaaaatgtacagtctggaattaaacacttgagactctggagtttggtttgcttttgaatttagactatgccatttataagctgtgtgacctcgggcagattactgaatgtctcagttcctcatttgtcaaatggggatttaaaacagcatctatcctattgggtgggttgtgagaattaaatgcactaatacacataaagaacttgaatattgcctggctgataagtgttgaatatgtgttagatattatgctatttttaaaaagtttacatcaacttttgcctaattacactttttattactttttagtggttggatttcatcccttactggtctcaaccaaaatattcctgttggaatcatgatgataatcatagcagcacttttcacagcatcagcagtcatctcactagttatgttcaaaaaagtaagtgaaattttatgtctaaatttttatagtgaacgtgatgtaaagttctcattttcctattttgctataatttggtgtaacctgaagccattttatcgttattgtatgagtttgctctctgaggattactttttacaattaaaagttatgcataagtacattttagaaaattgcatcacattttaaacttcagtaaaaagggaatattttaaaatcattttaactgaaggctttcatgagttaaagagtcagcctcatttttaaaatttggatttttaaatatactctaaatttcttttttttgatatgaaggatattagcctgttaataaatagaagtaaaattattatgtgatatgtacattttattcatatatatctcttaggtttttgttttgttttttaattttttattataaattcagagggaacatgtgcaggtttgttacatggttatgttgcataatgctggggtttgggcttctattgaacccatcacccaaatagtgaacatagtacccgatagtttttcaagctttgctcttctccctccctcccttttgggtccccggtgtctgtttccatctttatgtctgtgtgaaccctttgtttagctcccacttctaagtgagaacatgcagtatttgattttctgttagtgtgttaattcacttaggataatggcgtgcagctgcatctatgttgctacgaaggacataatttcattttttaggtggtgtagtatttcgtgatgtatatgtatcacattttctttattcagtctactattgatggacgcttaggttgattctgtgactttgctattgtgactagtgctgcaataagcatatgagtgcaggtgtctttttgataaaatgatttcttttcctttggttagatacccagtatagggtgattgctgggttgaatggaaggtctatttttacttctttgagaaatctccatactgttttccacagaagtagaacaaatttatattcccgtcaacggtatataagcattccattttctctgcatccttgccaacatctgttgttttttgagtttttaataatagccattttgactggtgtgagatgggaattattgtggttttgatttgcatttctctgattggtgatgttgagttttcttccatttgttggctgcttgtatgtcttcattcaagaagtgtctgttgatatcctttgcctactttttaatggggttttttttttcttgttgatttgtttaagtcctttatacattctggatattagtcctttgtcagatgcatagtttgcacatattttctcccatcctgtagattgtctctttactctgtttattctctctttctttcttttggtttcttttctccttccttccttccttccttccttccttccttccttccttccttccttccttccttccttcctcccttccttccttcctttcttgtctttcctctatctgtctctctttctgtcttcctgtctcttttgtgaaagagagtctcactctgtcacccaggctggagtgcagtggctcaatctcagctcattgcaatctccacctcccgtgttcacacaattttcctgtctcagcctcttgagtagctaggattacaggtgtgcaccagcatgcctggctaatttttatatgtttagtagagatggagtttgaccatgttggccagcctggccttgaactccagacctcaaatgatcagccctcacaaagtactgggattacaggcatgagccaccacgcccagcctgtttagtgtttcttttgctatgcagaagctctttaagtcccatttgtcaatttttgtttgtgttccatttgctattgaggtcttagtagtaaattctttgtctaggccaatgtctagaagagtatttcctagattttcttctaggatttttgtagtttgaggttttacatttaagtcttcaatccatcttgagttaatttttgtatgtggtgagaagtaggggtcaattttattcttctgcatgtggctagccagtttacccagcaccatttattgaatagggtgtcctttccccattgttcattattgtcagctttgttaaagatcagttggttgtaggtgtgtggcattatttctgggttctctgttcgattggtctgtttttgtactggttaccatgctgcttgcttaccatagtcttttttcttttttgagacagaatcttgctctgacgcccaggctggagtgcagtggcacaatctcggctcactgcaccctcagcctccccaggttcaagtgattctcatgcctcagacagccaagtagttgggactaacaagcgtgaaccaccatgcctggctgatttttgtatttttagcagagacgggatttcaccatgttggccaggttggtctctaactcctggcctcaagtgatccgcccgcctcagcctcccaaagtgctgggattacaggtgtgagccactgtgcactatagtttgaagtcaggcaatatgatgcctctggctttgttctttttgcttaggattgctttagctattcagactctttttggttccatatgaattttagaattgtattttctacttctgtgaaaaatgatgttggtaatttgataggattgtattgaatctatatattgctttggacagtatggtcattgtaacaatattgattcttctaatccatgaatgtggatgtttttccatttctttgtgtcatgtgtgatttctttcatcagtgatttgcaattcttcttatggagttctttcaccttcttagttaaatgtattctggatgtgtgtaggagtgtgtgtgtgtgtgtgtgtgtgtgtgtgtgtctattgtaaatgggattgggttctttatttggttctcagcttgaacgttgttggtgtttagaaatgctactgatttttgtatgttgattttgtatcttgaaactttttgttggttttttgagacagaatctcactctgttgcccaggctggagtgcagtggtgtgatcttggctcacggcagcctctacctcctgggttcaagcaattctcatgttttagcctcctgagtagtcgggattacagatgtggcacctggctaattttttttgtatttttagtagagatgatttcgccatgttggccagtctggtctgtaactcctgacctcaagtgatctacttgccttggcctcccaaagttcgggattacaggtgtgagccaccacacccagtctgtatcttgaaactttactcaagttagttatcaggtttaggagtcatttaggatttgtaactgcccagttgttttagctacacttcttcctgtagaattcccatgtctgttttcacagctttaaaaaaaaaatcattacatagaggaaggtaaattagtgtttttatttgtttatttaaagttttattttgtcttggatatatgtaattttgatatattttatatgtattcaaacatgatattgagaccttgggaataacacctatgttttaaatgaaaaagactttttgataggtctcactttaaagaaaataagtccttataattttttttaccatttcattacttgagactatgtatgaggaatgcatagaaataattttaccttatatttaaaaccacttttactctttcagtactttactcagacatttgtcttttatccttctcaaaaccctacgaaggttagactgtgtccgttcttccatattttctctatttgaaatttttaacttctcttctgcaccaaacacacataccattgacactcagctctctaatgttactaaatcccttttccagttttcctcctccttaacctctgtagctttctacaccacagatggctcctctgctaagactttgcaatgatgttctaattctcttgactctctggctattctttctcctccatttcttcatccagttcataaattaaggtcttaaatgtaatcggctctttgtgctatgcagtcattttctttgggaatttcatcttcccttattatttcagtttcttctctacctagatgacctagaatcttggaattggaaaagataatgcattgcataaacctttagttgcatcttcaattggtcattttcatctccagttgttgattgatgtcatcttctcacagtaatgcctcataaactcttcagtttcttagtgatagatgttccttttgaacgttctgagtaatattcaagaagcatttattaagaccacatattgtatagattccattattgtgaaatgtataaaatgggcaaatatatagagacagaaaatgtattacagcttgcctgtggcttatgggtggggtggggagtgagggtaatgaaagtattctaaaattaggttgtgtagatattatagtcacaactctatgaatatactaaaaatcattgaattgtacactttaaagggtaaaatgcatagtatacagattttatcttaatgaagcttttttttttgaagaaacacttattgaatacctactaatgagatggcactaagcactttatgtaattccattgaacatttttgtcagtgctgtgattgcttctgtcagtgcttccattacttcttttttgagacagaatctgtctgtcgccaggctggagtgcagtggcgcgatcttggctcactgcagcctccgcctcccgggttcaagcgattctcctgactcagcctcccaagtagctgggactacaggcatgcgccaccacactcagctatttttttttttctttttttgagatagagtcttgctctgtcaccaggctggagtgtgatggcgtgatctctgctcactgcagcctccaactccctggttcaagcagttctcctgcctcagcctcctgagtagctgggattacaggcatgtgccaccatgcctggctaatttttgtatttttagtagagacagggtttcaccatgttggccaggatgctcttgatctcctgacctcgtgttctgcctactgggattacaggcatgagccaccacgcacagccacttccattactttttaattcactttcttagatacctttttagtatcttttccatttccaacctcagctaatccagaaattctttttacaggttacttatattccctcatccttctcgcagtccatttaatatataattcctatattaaccttaaaaaaaccccaacaaattggcactctgcagatttttgacgtggatctgggattgggaacggcattttggtggcagtgcgaagaagggctacattcagaaacaccagcattgctaaggttgtaaaaacacactacatgccataaagccatcaaatgggccttaataacctaatgatgaaatcacttttattttgctcagccatactctgggccctatgcagaacacttcaccagtattatgccattttgtcctctcggagaatcacagattgggattatagtggtggtgggaagaagggctaatggtgacgtctcacagctccatgattcacactttctattcttgtcagactgtactgctcggtttcttcaaatacatcatgtacattcctttgttccagattttgtttatatgatgttttttaatccgtgcattaattcgtcttctctgctatttgaagacctactagtattctttcaagacccagctccgatcttgctgtgtctcccagaatgttttttgttgccttgtatcttagggaccatgtcattctctgttttcttggggaaacttaactgtctatattgcttactgtggcacctgggcataagccagtttttatgccttatggtgcatgtattctgggtacgcagctgttaagcaccccccgcgtgaacaagtcttttagcattggaattagatgagaagagcaagagttttgctttggaaccatacaactcaggttgaaattttgacagcttcacttacagctctgtgacctgagacagacttctgtaaccactcaggtttggtgtcctcaactgtactccaagctgcgtgagagtggagacctgttctgtatgctttcaggttgtaattctcacatctggaacagtgacatgcagtgattggcatgtgataggcactcagatatttgttgaataaaagaaggaatgggaagagtaaccactttcatagggttggtgtgaggattaaatgaaacagtgaatgtaaactgcatagaatagggccttctcagttaatagttttcctttctgatcttgacctttttatcattttatattcagggtctggtttagtgtctacttttgtttagtagatgcctttatcagtcagcatgctatcagaaacagaaagaatgaaaaggttaattgcggggaattggctggtgaggtcagtctgatatcaagagggcaggccggaactctcaggcagaagttgaaactctggtccacaagtgggatttcttcttcctcagaggaactccagttgtgttcttaaggcctttcaacagattggatggggcatacccagataatctagaacactcttcttaaagtcaactgaaggcagatgccgattacatctacaagataccttcacagcggcacctaggttagtgtttgattgaataattggagactgcggcctagccaaattaacatgtaacactgaccatcacagcaccattctttggagaattcctttattatttcacatgtattattgagggtgttttatagaagtagaaatgtaatacattttgagtatagtagagggttttgtggtgtgtggcagttttcactcatttgttaaacagctgttattgagcatatattacgtgccaggcactgggctgtgcatgagctcagagagatcacctgttggtgaggaagagaaataaattggtgggccccccaattcagttatttaatggccatgatagaggtaagtatagggagcagagggacacctatcaggttttggaggtctttttaagtattgcctcagctgagatataatgatggctgctcatcattatagttatctaagcaaaagaataagggacagggaagaggataagagggataaggaggtaccagagagtggggataccacgttcacatctagttgtaggaaataacatggcaaattcagggaattaaatgtagctcagaatggatgggagataaaacatggtgtgtgagctggggctaggagaattgtaggttgttggtattggaagatgaaattgaacacgtaagtatagttttatcctacagggtcttgttaagaagtttaaatcttctccaaaaagtggtagtgagccatagaagagttttaaggaggagagtaattgaattgattagatttgaattttagaagcatttattctgaaatacatttgggatttgcggggccgagcagtcgtacttggaaacacttaggagacgggctaggaagctgattagtaatgatggtggcctgaactgaggaaatgtgaagaaaatgtagtcaagagaaaacgagcaggtaaggattaatccaactgggcctggaagtaggggacaagataagactcaaggatgacacccaggtttttagatgatggaccattcaagaagagagtacaagaaaaatggtttggggatcaagatgttttccacgttgaccttgaatttggggagtttaaattaactggtggggcattaaaatataaatattgagtaggcttttgtatatatgagttaggagcaagggaagaactttaggctggatttctagactggaaagtattgacttgttgaagtaaatgaagcctagaaagtgtatggagtcagaagagggctttggggagaatactcacaacaattaagactctgctgtgggtgaagtataaagggaactttaaccatcactggcagtggttgaggaatgtgtggcacagatgatcaatagagccagggtgtggaggaagtgtttattctgtagctgttctataatgaactactctgtgcacactctgaatactttgaccagcagtttttttcctttccattttccaggtatacagtttttcaggatccaccacacaaaggaaaagttatagaatggtgctcatatgccaggcattgaaaagaaatatgactttctcgaataaaagtattgatatggatatcatgcagcatactctaatattttgttgttgttgttgtttttacctcatagttaaagaagttaccagaacttctgtttatatgtgttcacaagttcctaaacttctctgggtctcagattctttatctgtgaaataaggagtttagatgagatgattttctgtatgattttatgaagtacgatagggatactataagctaaaatataatttgcaccagctttcatattttaatagcaggcatttctcttgctgtaatagaaattaagatccaattttaaaaacctaatttttcctttttaattttctgtttcacacttggtcaaaactggcagtttaatgacaaaaaatcctttgcaggtatgtagcagtatttataaccactaggggtcatgcttttcaagaacagttaatgccctctaaccgtaatctgtgcacggttttgactctagaattgttgggttttattaagctgttcttctcttaaggtaaatgtgctctgtcctatatatttatcctaattgaagtgaataggattttggtaatttcgttggctttctgttgtcttgcataactgaagtgggtcatcattggtgctgcagggcccagtatgagattgtgctgtttgtttcccccacagtgttgttttatactccacatttcaaatattgaaagaatatatgtctcctatacatctgcatggagaagggtctagtttagtccttatctttcacaaatagatttcttgttttctttcagattatttccaaatggtgtttttacaaaagctcctctttctattagaactatcagaaagaattgagtaatggttttgggccaagcagggagttgttataaatgtgtcaaataacagtaaatgaatgcatcacaggagactatggatcagggaatccaaaacttttcccttctgttaattggtatggctagaataacttaatatggaagtaattaatagatgatatatcatttgtattccttttgggacctgattttgaatgattatcacttccatgaaatttgttcatagactgtcatgttcacattaagtagtttttaatagtgaattttttgcattttgaaagaattttagaaaaaagttattttacctctttaaaaaacaagttttctgaagtgtttcaaatcttgtttatttactacagtatatattctgcagatactcatttttgtgggagcgctgaattgggtctatgatagagaacactgtgattaagtctcattagttggtgttttatggtaaatgctttgtgaagatatcctattatatataaagtgatagttttcttaggtgaaaagtgactcttacagttatccctctatatgcaggggattggtttcagaacccacacatccatataccaaatctatgcatactcaagtcttggagtcagccctgcagaacccatgtatacaaaaagccttctgtgtacttgggttttacatcccatgaatactgtattttctatgtgagtttggttggaaaaaaatcacatattataagtggacctgcccagttcaaggattatcatctatactttcttgaaaatattgttatcattcacctctcccccttgtctcttccactttgtaactttatttatgacctaggatagaaagctgataattccactgtactatttttctatagtcacaaataggcatgctacttctctctcagaaccattcagcactgtcgtctttgctgactaggaatcaattctggatggttcacattgtctattaaaatagtcatccagttacttgtcaccttcttctaagggacacagatagagtaatacttttgaattcctagaaaaaaatggcactcttgagcagattgtttatattctgtcctcggctgatactcttagtatattcaccaaaaaaaaaaaaactttacccccaattttaattttgttacctttttcaataagtactaagctagctacttaatagatcccaaatctaggttactataactaaattattattatcttaggcatcttcaaatttggtagatttcgtagattggtgagtatttataatgctgttcatgtggcactttcatctaagtcatctttatatgcatatttttatcagctttattgaaatataattcacatacaattcacccatttaaaatatacggtttagactgtgcatggtggttcacacctgtaattctagcactttgggagggtttggggggccgaggcaagaagatgacttgaggcgaggagtttgagatcagcctgggcaacataatgagactaccctccaaccccttacaagacattaaaaaaaaaaaaaaaaaaaaaacaaaaaaaaaaaaaaaaaaacaacaacacagcccaggcatggtggtgtgagtttattgtcctagctgttggagagactgaggtgggaggatcacttgaacccaggagtttgaggctgcagtgagctatgattgcataccactacactccagcctgggctactgagtgagaccttgtctctaaaaaatacaaaataatttaaaaaaacctaaagtatacaatttaatggcttttggtgtattgtatttgttttaattgtggcaaaatatgtataacataaactttgacattttaattacatttaggtatacaattcagtggcatcaattacattcacagtgttgtacaaccattactaatgtctatttccagaactttgcatcaccccaaacagaaactctaatcattaagcaataattttattcctccctattctcagcctctggcagcctctaatttgctatgaattgcctattttagatatttcatataaatggagttatacaatattttccttttgtacttggcttctttcattaccataatgttttcaaggttcatccgtgttgcagcatgtatcagaaatgcattcatttttaagactgaataatattccattgtatctgtatactacattgtttatctgttgatgggcatttgagattttcccaccttttggctattgtgaatagtgctgccgtgaacattggtgtacagttatctgtttgagtctttgcttttacctctcttgtgtacatatatacccaatgtggaattcctatgtagtcttatagtaattctatgtttaggtttttgaggcacctccaaactcttttctggaaggactgtatcattttacattcccaccagcactttctctacatccttgccaacacttgtgattttccgtttttctcattccagccatcctagcaggtgtgaagtagttgtatactttaaaaacatttaacctctgaggtgactgcaaactaagcattttactttgtaacacaggtatagtctccttaagccatattgcacttatttggtaccttctaaaaattattattaatgaggacaattttggaacatttaatcctcagcaggtagtaataataattattcagtggcttctactgcagattactaagctgtgtcttttagggggtgtaacaatgagtagaattagttcttgcccttaggcaagtaaaagcatgtaggatataatacaaaatggacagaaaccctgtaaaagaaaaagtacatacatgctccccaaaatgtacaaaggattggcggtactctcaatagggaaagccatagctagttcaggcacaaaatggcagacagagcattatttgagatagtgcttaaagggtgcgtgagatttcgacatggtgaaactagactggcaattcaaggggttacaaaagggatatctgacccatctgtgggcaggagggttcatagagggtttccagaaatttcaaactgaaaatattaggcttagacgtccatacttttttaaaaactcaaaacaagaatttaaaaaatatatttaaaaaactcatttgtttttattttcccagcttttataaaagttgaaataattttggcatgacagggatcttaataaaagcacagtttcttgaaatggtattctatatgttttaatgaagacatatgtttgggttatttaaataaagtgccattattctttacttcccacacgatacagtttttctgtgtcatataccaccacagcatgtattgtctctgaagctgcattaaggaggcaggactcctttatggagccgcatctacattttggctgtgacacttcggcagatacttaaaaattaatttaacttatgttagtgtaactcatttatatacattctgatttgatctttaggaaaactcagaggagcagatagtgtaacaaatattctttttttatgggaagcagacttgaagttttgagtggtggccagccagctagaaagtagtggaattagtatataccaaatttaatgccttttctgtgattttcctagaactaaatattattttaggagtaatgcagttctcataagtagaaaagatagtatttaagttgtttaattttttttttgaattctctaggctattctgcatttatggaattttccactaggtaatatgcattcaggtcacatacacagtgagattttctaaagtgacagtacagataaaaaggctgtgcaacttggtgataattgtgctccatttaagcaaccatcaactggtgcatttttttaaagataaattagattttatcaaaattgaaatattttttctttttgatactttatgttctgggatacatgtgcagaacatgcaggtttgttatgggtatacatgtgccatggtggtttgctgcacccatcaacccattatctacattaggtatttctcctaacgctatgcctccccttgccccccacccccaagttgtgtaattttttaaaaaaaattatagtacttggtgtcaaaaccttgtccctgatatcagcagtatgaattattaatagataccatctgaaaccctggagggaagtaataagcttttaaagatgttcatcctgatgattagcctgtcatctttcatggggccctgaaatcaagaatccaccctttttcacatggatataatggatttaatacagtatttagcattatgcactgtatatatatgtggtcttttccctctaggtggctctctgggtctatatagatacaaactattgagaaatgtggctattcctacctttattttgcttctgtgttctgtgggactgtgaattacattttagtaaactgtgaagcccatgaacacatagtatcagctgctcaatttagtgcaagtttgaaaaaggaaataataaagcaaataagaattaacatttatttattacatgctcacaaacttgggggaagaggggaagagacagacaagtgaatccaattgcattgctctggtttggtctagtaagtaaagaaggttgataagatttctataatacacttcattttctaggatccagtcatttgtactcactttgagataagtgtctggaacataggagtagtgatttatctatatctttaattttccatagaaaacttggttttaaaagggaataaaaataattacttttatacttaatgatagtgctaaggtactaggggaaaggaatctttggatttaccagtatatgtatttgtcagtgctctttttcttcctgaccatttgacactttgatctgtagtaatatggcgtttgcttttaccactgtatcagaagcactcagggctgtgtgggttatttttgtcttgtaccgtgatagattttcatgcattaacttgctttcttgatagtttttctgacagcttttcatgtgttaacatgctttcttctcttggcatcagtgagaagtatctgtatctggttcttccctttcctctcccagtcattctttcttcttgtggatgcctcttaaatagtgtctttttaaaacaatttcaagttttattttagattcaggggatacatgtgcaggtttgttacaagggtatattatgtgatactgaggtttgggggacagttgagcctgtcatccaggtagtgagcatagtacccaattggtagtttttcaactcttctccccctcccaccttcccctatcttttaagtccccaatatctatcgttgccatctttatgtccatgtatacccaatgtttagctcccacttaaaagtgagaacatgtgatatttggttttctgtttctgcattaattaggttatatacttgattttattctctttctactctgggttctccatagacagtttcataaatgccaaggtttcagctatcatttatatgttgttttagtccctttgggctgctataacaaaaataccatagattgggtagcttaaacaacagataatgatttctcatagttctagaggctgagaagtccaagataagaaagacactgacaaattcagtatctcaggggggccaacttcctggttcatagacagtttctgtgtccttttgtgatggaaggttgtcagagagatctctggagtctctttaaaaaaaaaaaaaagttctttttggagacgtatattgcccaggttggagtggaaggctgggaccataggtgtgtgccaccacactgggccttgggggtctcttttataagggcatttattccattaatgcaagcttcaccttcatggcaaaatcacccccgaaaaggcctgcctgctaataccatcatattggtggttgggattttaacataagaattttggggggaacacaaacattcagtccataacatatgccgttggtttccaagtccatgtctttagcccattcctctcccaagctttgaaccaaacctttacctgcctgctgtggcaggcctagagtaggttgtcagtagagttggaatgaatgaacaaatgtttagaacttatcatctgccttctccccaaaccagcctatcctctcttttctctgtcttcttgaaactactttcccaaatgcaagcttgctttgagaatctttgactcattctttttcttacctcacagttaccagttcctatccaggtttggaaaaaatactgacttggatgcattggcccttccctaagcctgctttgattgcattccagtcaagcttctaatttagatccagtcacagtgcagtgtaattaccagtatctttctgtccccactctgcgaagtttgtgggcatataattaataaatgtttgttatttccttcttcaaatttgtgttaaaataagtggctgatgttatgtattgatggactcatagtttaattatgcaggttttaagacatatactgatagaaaatttttgaaccctactcctgaaaataaattccaagatttgagtgattaatcagtatggagaaacaattcccagaagtgtttctttgtgcattctttaggacttgaccatacacaaaaagttaaattgtatacagagtgcatagcggcaatatgttgaaggacataagtagtgcttggtacattaaatgataaaatgatctcatttgattataacagggcctgtggtgtatatgtagataaaatggaaatagataaggtactgttctctctgaatagtctggggtaataaattaatgtattgtttcttgttattatgtttaaaccatttcattgtaatgctgtaataatttcacttgactaattgggtgcagaggaaaatacaactttttgaagttggctaagaagttctttatttttggtttaaattagcataattatctcttctgcttggagaagaaaaggaaaacctatattaagaaaatgtttaaatacaattattgtgtgtcagtttggtggctaatattcttgatcttaggaatcatgactacaatctagtatttttatgtttgattaatgttgagattaagagctgctggaaatgaatgcgtaggttgctacttaccttctcccacttttttgtgcctctgtaggtacatggactatatcgcacaacaggtgctagttttgagaaggcccaacaggagtttgcaacaggtgtgatgtccaacaaaactgtccagaccgcagctgcaaatgcagcttcaactgcagcatctagtgcagctcagaatgctttcaagggtaaccagatttaagaatcttcaaacaatacactgttaccttttgactgtacctttttctccagttactgtattctacaaatatttttatgttcaaaacacacagtacagacagcatggatatttcctgttcacttgtgcatgggctaaaaccaggaaaacttccttgtcttattactttacctaatagtttcttaatatttcagtgccccttgcagaaaaaatattacatgctaaataaatattctccatatttttgggggatgacattcagtgaattatttcagtggtgacccactgaaaattaataatggtacttatgattaaaaacgcatttaatactaactgcagtagttctttcaagaatctttagagataaggattgcacattggaaaagtaaaccatgtttcattcctttttccctatttatattgaaagaaataggccagcagagacttagggattttaaattggcttgctttttagctgtttcagtcaccagtgaagagcctatgtgcattttgtagtagataatgtaaaatttgtcatctttttcttttcttttttttagaatagctgatattttgataacaatctctaatttgcatgggcaccacatttcttatattaaaagaattagtgttttggcttctgtactgcttatggttgtaggattcaggggttaatggaatcacagaaatgatattctgcaagaatttcttttaaataaaaagtttgggggtgcaatataagaagtttatataatatgcagtacattatccaaaagagaaggtagttaatgcagtagaaagtagtggtaataattcctttttaaaaaaatttcggtagtcatatagtaacattttgctatatgaaaactttggtatattctgtggttacaactaagattgtgtctggcagctcttttttggggatgtgtgtgtgtgatttttaacagaggtattaaaggctagcctaactgttgtctaaaaagattgtacagtatttaagggattttccttttagcttttcatctccagtggcattaaacataaaaagaccctggcattttttcacatacttgaatccctaaatgcacctgtctttcactttttgagacagactgaatatatctaaaatttccagcaataaaaaaaaaagcatttaacttgcaccaagcaagaaaatataaatacagttaactgcattaagataatcacgttaaaattgttactatgcagcacagaacttcattcttatagtattcttgggttcaacctttgaatcaattttaccactgattaaataaatgactcaaagacatctgtaagtcatgctgctgtgttttgaaagtctttaactaaattaagattgcagaatgatagtgattattcaattagattttaagtaaggattgtgatattagaggctggaaatccttattttttaaaaaatcagataggcataaatagttaaatcactttcattctccccaaacctgtagttacagaaaaagttttatgctagaggtgggatgccaagttttcactatccatgaagcagcgctgcatgtcactaggtaacacagatccatccagatggtgtttacatttgatttatttgggatcttattgacatcaggtatacttggaagacatttcttttattcttcagcgtatgaatttaaagctattttttgtaaatatttctaatcagcgataatttctacctatgttctcaaccaacttagccagtttgtttttcagagcctgtagtcttattggaaatctattttatcagtgtgctttattgagtgtggattttgcatacattcaaaacattaaccacaaaatacagcaagtgcacctatattcaccattaacttatatcccaagtccattttttcctgtacactacaaacaaaagatatattagagacttttgaaaaatgctgaaatactttgcttcagaattggaatgtttatattatgtagaaatcttcaaaggtagcattattaaatagcaaagaataattagaacccacatatctttttttgtgtggatggggaaaatgttttaaaatccagttatttaatatgagtttgagagagaaaattgttttttaaaaatatatgtgcattgaaatgatggcaatgcttatagtatgatcaagtatgaaaggaactttaaattcttatatttacttttctctcagtaaattgttaaattttcactcagcaaaagattggcatttgttaagtgttctatatttagtactaaaatcacagtcatgaaatcatagtcataaaatggtcttcacacagcagtcatccgtgtcatttatcattttgtaatattaaattatggcaattttatttcaaactaaagtttgaacaccggaaagtcattactcagtgatttgtaatttgggacttggattatttatctagagatgtttgtatattttgtcagtaactaatactgcgctgccatcatggtgactgtcatggttctacagaaatgccctccatgtgtccctctaatgttgcatgtttcagtgggttggaagttttgtatatttattgtattaacacagagtgtcataaaataaaatgctgtttactggatgtttgtttgtataattttgaacactataatagcaattcagagacagacattgttaaaggtttgatgtatatagaaattccatgtttgattttttaaaatatgtgtataagtctgtcatgtgctaaacaaaataatatgaaagacctagttaaaaattctaaccaatgtaaaatgaccatttttctgttgcattagacctttacaggtaatggaacatgagcttcacccatattaaatattttggcccctttaaggtcaaaatacagatcatctagaagttagattcaaaatggaaaacctattcatggctcagatttttcattgtgggttaaaaatgggtgtctctgtactagtattgtatttattcaattgaacttgtattctgatttctatccttgctacctattgctgttttatgtactgatgaaagtacctatttgtgtatattggatttttcacttggttagctaaagaagatgtaaaaatatctaaaataatgttcatggtgaatcttattttgagaaatacatgttaaaaaaggaacagtattctttattttctgggtgttatatttaaaaaagcaagtttggatttttacacctaatttactaggaaaatattttattctgtaattcatgttaagattatgtatggtttgcattttaaggggatttatgttaggttaattagttgtttctgtaaatcatttgtaatagcatagtgctttttactcattgctgtatctttttctgaaaacactgttgttaacatctaattcagtatccttattggtacaaatctgtgtttggcatgactgtttatatacagaatttgttacattttgagcattttttcccctgcttatgtataccttagagttaccatggctgtcatataccatttcactatatctcctttcagtttttccttaaggaaaatgtttagaggaatttgttcatttcatgtgattaagccctttagagatgaaataagattggttaattttaaaaaaattgaggatggttaaaaaatagaaaacaccttactttgatacattttaaagtacaatagtatacatttatttagagtagactaatgtgtttaaaacatgagttgttttaaatacttttttattgagctaaaaagttttatctcacatattaagtattacagaaagtgaagtattttggctagaattttagggcatattttataaagcagcatgcctgtaatattggtgggtatttttaaactttaggactttatcacagtatgtagagagctagaaataaatctagaaactttctaagccaggtattgccactaacctgtcttatataagcagatacctcttatttgaagattgtaggaaaatagagaaagactgttctccagttttctcacccccgctgtgggttttatatttacaatttaactttggggtttgggtaagacaaacatttaatgtataggattttggccaggtgtggtggctcacgcctgtaatcccagcactttgggaggccaaggtgggcggatcacgaggtcaggagatcgaaaccatcctggctaacatggtgaaaccccatctctactaaaaatacaaaaaaaaaattagctgagcatggtggcgggcgcctgtagtcccagctacttgggaggctgaggcaggagaatgacgtgaacctgggaggcggagcttgcagtgagccgagatctctccactgcactccagcctgggcgacagagcgagactccatctcaagaaaaaaaaaaaagaattttcattagtgctggccgtgtttcaaatggcaagggaacatgggaactatcatgtggcaatgtagtgagtgttaaactttgtgtttgtccaaatcctgatttatttttcagttcatatctttctgggcttgacatggctgatggtgtagctgaaaccctcctaacactaaaagccatttaatcttttctgtaataggagcagaaaatagttaatcatccacctagtaatataagattactgtgaatattatcttctatacattaaaacagttctagtttgtagaataataccatacaagttttatttttaaattctagttattttcagtgcttacttaaatgtaattctagaattcctccacaacttttaatattttgtatgccagtgattctcaagataaatcatgattgtagtagttgttactgttggcagtttgtagtagtattcaggtattttggggatgggggaaaacaccaaaaatcagtgtcttttatctggtgatcactgtggtatctacagtattctagtctcctgcacaaaaactgaacccactgggcctatgcatccctcacactttttttctagtataaaagcaatacataatgtgttgtagaacaattaaaaattcagaaagtgatacatgagaaaataaaaataaatccttaattctgtca

SEQ ID NO: 840 - DNA, 553581 bp, Homo sapiens
cccgtgtgcagtcgccccgcgccccgcgcgacccttcgggtgagtacgtgggcccgggcgttgggcgagcctccccagccgttcggtccagccgcagcggagccctcccggccctgccgcccgtgtcccggctgccacctcgtcactgcccgcgagtgcggaagcagccgcggaaccccggcccggcccccgaattctccggcgcctctgctcctgccttcctggggatggcagccaaagaggcagggtgaagtgtcaaggagggaggggggacgcgccagccctctggctaagggcagaggagactcccgggcgaaaggctcttggtgggagtcctcaaactcccggctccagtgtgtgtgcagagatacggcgggagagcagaccttgaactttccttgcttcagcgattcctagcctaggaactgagtaaaagccctatttttcttaattaaattaacaggttgcagttcgtaggtgttgttcttgggaaaaaaacaaagacttgggtgtttgggtgtttgctaacttcatcgtgactaaataaaactattttttttcattcctatttttgaaaatgccacaggcccacaagtgtgttctaccctctgtggaacaatgaagtatgtgtatgtgtgtgtgggtgtgcgtgtgtgagagagagagagacacgggagtaaacatcacatgcttatcaggaaccaaaaaggaaaaaaaatgagtaaaagtatgttgaatataagggtatgtattgcccccaattataaatgatgtattgtctgaaatccaaggaaggacttctaggaagctacagggttttgttttggcttcagaaacaaggtcttccaatttattgaatataaaagtagttgaatccctgtaaaccccatttttttttgtaaagtattgacatttgaccatggatatactttcttttatcccccaagtctttatagtttaaaagtaattatggattttgacattttgtctcaggcatttatccctcctattccaccctccatctgatccgtgtgatgagaaactggctcttgtcagttttatctaagtttctttaagctgtcattaaaaaataaacttttcacatgaattctatttaattcattaaatgtgtttttctttggcattgtgtttggaatatgatcatggcaatttcttttcttttctttaatttctgtctttctttctttcatggagtcgggctctgtcgctcaggctggagtgcagtgccatgatttccagctcactgcaacctccgcctcccgggttcaagggattctcctgcctcggcctcctgagtagctgggattacaggcgcgcgccaccatgcctggctaatttttgtatttttagtagagatggggtttcaccatgttggtcaggctggtctcgaactcttgacttcgtgatccgcccgccttggcctccagaaatgcggacattacaggtgtgagccactgctccgggctggcaattccttattgcaaacaaatcactgaaaaggaggtctaaacatttttaaaggatatagtagtgattatattttaattttataatgtgctccggctcataaatattttgccatttcaatggagagttttctctgttcagaggacccctagacctactttgcttttggagttgctgttttaaaaacttgcattgattaagcaatttgtttacccaaggactgcaggataggaacaagggaagaaaaatcacttaaaggttgagacaatgtgaagagaaaatctaggaagtgatttatagatgtaaacctctaaattagctaaggtaccacaaatattatcctggaatctatcagaaccacttatggtggttttattgattgacttaaaaggttgctttttatttaaaagcccctgtggtcttttgtattagactaaaagtaagaagttctaactttatttctgttattattgctatttgtgttttttttttaacctgtattaggcacttgcattatgtaaaatgctatgtataatcttttcctgcctttttatctaacaatttaagataatgtactcagacctgtcattacctcaggactggtctgtgtgtatgtgtacatatgtgtgtgtgtgagaccaggtaggttggaaagtaagtataagacttttcataccccttgtgggctctgcctctccccacccccacatccccataccactaatagacaaaaacagaaatgatgttttgccacctgagattgcttttgaaagtttgtagctctttgaggacattccatatatttggtttttcacctttcttccatttatccttttgcagatttggatatgtattatccagactctactctctctggaatggagtcttccagttttttttttttttttttccctcacccaggctggtctgttacgtgttatccatacatctgtttattcatttattcatccatcagcaaatatctatagagggcctactagattcaagtcatcacttagtacttactcttacttccttcccattggaattttattctgtgttttatacttcacacaatggtaactaagagtaataactttggggttatatagaggtagtcgtgcctgtttctgtcagctggtagctttatgaccctggacagatcataacctctctgaatttctgtttcttcactggtaaatccaaatggcaggtatcaggaataattgagagaatacatggatagtgatttccaagagcccaacccctaaaagcactaaaaagtgttaattacaagtttgctgtctatatctactgcatccctcttcatctcaggaaatgcattttccatctcaggaaatgcattttctatctcaggaaatggcagttccattctggattttgcctaggtcacatctacatccaatgtattagtaaattttattagttatttttgaatgtgtccagaaccagagttgtttaaactgccttaatttctctctgcttggtccaagttgctgcatctttggcaacggcttcctcagtagcttccctgcttctgttccttgccctcctttcttacaaaatattttcaaccaggaaacagacaggcctttctgtcatataagtcagattgtgtccctcctctgcttcctgtcccactcagggtgaaagcccacatacgagggcttcaaggcctgctcatgatcagatgctaccttctgtacctaatctctttcatactcccctgcacctgctccccatccagtcatactgccctccttaacgatccttaatttgctctaaatgtgcacccaacaatggcctttccaagttttgttccctctatctggatcacactttccctagatagctgctgtcttctctcccttctttcatgcctgtcttctaatgtcaccttataatgaggtcttcaacttccctcacacctgacactccctgttaacttttccttgctttaattttctctttgaactttcttaaatactgtgtttagtttttatctgtttaatatctgtttccctcaaagaaactatcagatgcatggcaacaggactttgtctggtagttaccctagcacataggccagtgcctggcaaaaaataggcaactggtaaatgttgaacaaatgaatgaatgaatgttattatggaattaacaaatctgtacatcatcacttttatatgatgatcagcactcttttgctctgaaacttttgataattctctattttcagtaaaatacagaccaacacttttggataatctttgttggactggctccaaattatccttaactctcacaggataaccccaagcacccagtgttccagccacacagaactagtgatacatctctacatcagccccaggcggtttcctttgtgcctttgcacaaaatagaagtactgtgatttttttttttaatatcagatggctttatttttctaactaacgtaaagggtaagattttagaatttatgtccttgtgtgtggaaggcattgcatggagtgttgaagccaggtggcttggatttaaattgtggctctgatataaattaattttgttattctttacaaggtacggaactctaagtctctgttgcaatatttgtaaaatgaggaaaataatattttcttcattgggttgctatgaaatttaagagatgcttgtaaagctcatcagcatagtatctggtatatagtatgtgcttaataaatgttagccttagaaatattaatttaacacctcgtgctgaaatgagagggagttgagggggggtgcattagtattgttactggccacgtcatcaatgcagtccttggactccactgcttctcttcgctttgtttgccttagcggaagttgaatggcaggttgctccaccttctcatctcacctaaacaatgagggagcttctctttgtgagtgtaccactcagctcatccagtagatgcctactgatcacccagtatgagcccagtattgtgctgtgccctggcagtaaacagccacttctctgaggagcttatgatcaagtgagggagacaaacacatacatagataatttcactatagtgagccaggagctaagataaaagctcattctcatctgtggttatagaaatgaatttttaaaaatggaaaggttttgcagactatgtgccctgtgtaacatagtccatttgaacagcctcaagcctgcatttaaattaacagtagatacaccaaatgatcatactgattgtaaagatgttttatgtgcactacagaggtgaaaacagttttggttctctggataatattggggtacctaaggaactagaaagtagggctgagaggactaggcaaacatttgcagcctgtgtacgaagtcatgaagtgaggataagcagaggtttaattcaaattattatgtaagggtttgaaatttgggaccctctagaagatatcacttcaacttcagaattatgaggcaagaataaattccagccagcttaaatgatcaataatggagtcctgttttgttctgctagttgaaattgttagtggaaataaagaatgagctgtaagcatgatgggaaatatcttactggaagaaacacttccagctttgtggtatattagaaagattaagggctaggtgtaagtctggattcaaatcctgatgtttccacttgttatataaattaaacaggcagcaactgctctgagcctttgttttcttccctgtaatgtggcagtgatagtagcattcatggcattactgtggtaattaaataagatcatgtactagtgcaggattattgctcaatgctatagttctcttccctaaataatataaatgctggagagaaacagctgtctcagaaattttttgaatgttctaatttaacttgagcatgtggacattacatagcccacgaagcaagtttccgaacttaaaaacaacaagaaaataagtatgtgctagcctccaaaatgcgtgtatttaaaaaaagagtcaagattatatgtattggaattgatctggccgtctgcaggaaatggtgatcaggccctggagtcagcctcagaggctcagatcacagctcttctgagaggtgactttgggccagttacaaagtccatgtgagcctcagtttcctctctgtaaaatgaagtgataggaatgataataatggtatttcagtagtatttctaaatcctactgccttaattctgtgtgttcatggtgggaggggaggtggtgatagcaaccatatcagaattcttcactggcgaaagaagcaacagcagcctgtaataacagcttcttaaataatactcctttctagttctgatgggcatatgggaactatttctttttcatgactcactggtgaccagtgatgaattttttttgtagtggtggtctgtggacacttccaaaactgttgtgtgaaatcgagttcaaaaccaacctattctggcattcttacacattgaatatcatgaaaacacataaaagttcattttttttgttcttcactacttgctctgctctctttgatgtgagagtcacacatataagtttctgctgctatagcaggtgatgagcctcatactgaaaaatatgaaaacaaaaacaagactcttgaggtagtcaccattcctaggtggtccaagctacagcccctggggacagatttcagagtgttcacaaagataacaagggacttaaaattgcttagaaggcttatgaatccagggcacagtcactatttgcttggctgaattctattgccaatgtttatattgccaatgtttatattgcttttgtaaaatagtcatgacaagtcctcattaactaagattgtgggttgaattggcattcgtcagcccagaatattggattgggactcaggagccttggaggctatctcagatcttccattgacttacttcaggcttgtggcatggtctttgtgatttcagtcatgtataaagtgagaatatttattaatggatactccccccaccaagtgttcagggtttataaaggattctttctcaacacacacacacacacacacgtgcacgcacacacacaatttttttttatgcattagaagtagatatattacagagttattataattgtgtctggagaagaacatgtctccagaagacatttaagggatggcatccctgggactgggacctgggcctgctctctaggcaaggaaggtgcaaggagttgatctggctgtctgcagagaatggtgatcagcacctggagtcagcctcagagattcagatcagagctctcctgctaggtgactttgggcaagttacaaaatctgtgtcagccccaatttccaccctgtaaaatgaagtgacaggaatgataataacagtatttcagggggttgttatgacaaaaatgatacaatgatacacgcagacatccagcacagagcctggcatgcaaactgctgtaggctttgtaaaggaccctcttccccctcttccccctcttccctttctgaattctaactaaactgggagagaagaaaaatgaattggcagatggcagtcaaatttttgtctgtattatttttgatatctaagatttaatcagtgttattgctgaaaaacagacatagtttagtctgagagccaaatgggctcacaaagtccaaaccccagaattagatagacataatcatccacttacaagccctggtggacccagacagatctcttcatgtggaagttacagcttgtgttctttatgggcaggccggttcccaaagaggggagaaggaggagctaagcaagactttggaggtgggcctgaacattttcattttaagacagctatgtacttccagtgcacatattcaggttaggacctactactgtgggcatattacatattttgcagtgctctgtgcctttggatgtgccgtagccactgcctagagtggcttgccttctatctgtcccttcttcactagtaaaaaaattctactaatcctccaaccttaaacttggggatatcctttgtgaaatcttcctctttattctcattcacccaatgcaaagttgcccagtcctttctgtgggctactactctactgtagacttagctatttcatagaacttactctctattgaaattatttgataactaggctgtgaacattttaataaaagtttattcacctgtatacatttgtcaatgtttagaagaagatctgaaagtaattacaccaaattcataagcaatcataactctgaggagagggatttgggcagaggagagaatattgtttaacttttgttaatatatgctcattttacctctatattgttttgattttgtaataatcaaaaagaggaggccgagtatggtggctcacacctgtaatcccagcactttgggaactttaggtgggcagatcatttgagcccagaagctcaagaccaacatggagaaaccctgtctctacagaaaatacaaaagttaaccaggcgtggtggcacatgcctgtggccacagctactggggaggctgaggtgggaggatcacttgagcccaggaggtggaggctgcaatgagccatggttgtgccacctctgcatttccgcctgggagggcctctacatgtcatcttggtcaccatcccaattttggacagtgttctgccctctcacatcccattgtctccccatactctttcattgtttttctttcctaagtccccagatgatcagaggtatgattagatgttagggaagggacagtattcgctttcctcattctcagacttgtcttggagccatgagtaggaacaggtatcatcttttccaaatacatttttatggaactgttataaacctgaactgataaaaagaagaaagccattacttgttttcctcctctaaccctatctatcttttcttatacaggtaaactacgaactgggagttctgaagaatgggtaaagactttcgttactatttccagcatccctggtctcgcatgattgtggcttacttggtgatcttctttaacttcttaatatttgcggaggacccagtttctcatagccaaacagaagccaatgttattgttgttggaaactgtttttcatttgttacaaataaataccctagaggagttggctggaggattttgaaggtgcttctatggctacttgccattctcacaggactaatagctggcaaatttctgttccatcagcgtttgtttggtaagtaccatgacccatgaaatgtaatatcactaattatttaatttctattctccaagatacaactttgctatttctaagtgccaatgtaggaggcattttagtttgtcctcctgccttaagttgttatgcatggttgtaactgggttcttcaactactctctgttaatggtttacttttcctactgtctaaggaaaattagcacgaggtaaaattagtaccaaacttcattaaaaaaaaatagcattaggccaggtgtggtggctcacgccagtaatcccaccaatttgggaggccaaggtgggcagatcacttgaggtcagaagtttgagatcagcctggcgaacatggtgaaacctcatctctactaaaaatacaaaaaatagccaggcgtggtggcacatgtttgtaatcccagctacttgagaggctgaggtgggagaatcgcttgaacctgggaggcggaggttgcagtgagccaagattgcaccgctgcactacagcctgggtgacacagcgcgactccatctcaaaaaaaaaaaaaaaaaaaaaaagagcattagagataaaatgaatatatacctagtcattttttaaaaactttttttatttttaaaattttttttattatactttaagttctagggtacaggtgcacaatgtgcaggtttgttacataggtatacatgtgccatgttggtttgctgcacccgttaactcaacatttacattaggtatttctcctaatgctatccctcccccctcccccaaccccatgacagggcctggggtatgatgttccccaccctgtgtccaagtgttgtcattgttcagctcccacctatgagcaagaacatgtggtgtttggttttctttccttgtgatagtttgctcagaatgatggtttccagctgcatccatgtccctgcaaaggacatgaactcatcttttcttatggctacatagtattccatggtgatatatacgtaatcttatttagagaagatatgaacatgaaaatagcttttcccctcataaatagtaccaaagtgttgtagagagtttataaatcataaaaaaatgcctccatatcacagcacattttcattaaatatattttacacatattgttcattcagggagttggaactataaacttttactctctctctcttttttttttgaacattggctttaggatgtttattttgagcctatccaaccaaagaatagtatattagtaagggatctcttgataatgacagaagaagagactaaattagtttaagttaaaaaggtaacttactataaggatgttaggatatttcagagactgagggtagaatgaagtgacagggacattgggacattgggataaatgaaaccaagggtttgacatctgttatgatgcgtttgtctctctctataatatctgctttattctccttttacactgaaaatgaatttttattacctagagagactgggttgactttcctggtctcaagtttaaactctcagggaagagtgtgaagttgtctcagggtttggttcccacctctgaactaaccgatttttgcctagaggtaggtggtatttattcaatagatgttcatcgcttattacatgccagacacaattctagacagtgaatcaagcaggcaaggtctttgccttcataaaaacttacttcctacaggagagagaaagactaaacaaataaatgtatactctgtatgcaatgggggaaaagaaagtagttttgagtgctgggtcaattaggaagagaatgtaataatagagctttggacttagcagtgataagataaataggtgacttactgaaggtatttttggtctagagtttgggttagaaaccatggcaatgttttaaggaataaataaataaataactatccgtacacacacacatacacgtagtattatgtatgtatttttctctgttcctcaaattattgccatctgtttctattatataaatatataagatgtacatattttatatcgtcttgtgcctatatgtatacaatgcacacatatgtatagatgcacatagtttctagacatttggtgagaaactagaagaaagaaatggagaagtgctaaaaatggaagaagggccaagggaaaattttgttgttggtggtggggcagatagttttatttgggggataagattaattgacctgctgatatttgtgggagaaggagctagattaaagtggagataaaaagatatagatgaaagatagcatctctgaaggtttctgtggtctgggacttaagacacaggtagaaatggtggcttagagaggacaagaggagagaccctggtttctcaaatataggcatgggtgagataaagattggtactatattaggtatttttgaggtatagaaacaggaaggtgaatattcttctctctgttgaacctgataacctgatatctctttaacctgataacctctgttttactgtgaaaaagaagatcccatgataaagatggaggggcttgatgatgcaatgggtttaaggaagtggtcaaggtttggaacagtggccctagggagttgggaagtgaactgactcagaacaaatgaaagggttgctgattatcatgaagattgttagccactataaatttgaatgataccaatctggattgttgagcagtgttctttttgagagctcagtcatccagaagagaatttcagcatgattcatctgggtggggactgctcaggcttgctgtattggaaacaaaggatggaaaataaatggagagttctagtaaaagcattattcatttgattgacagggggttgtggttggacatggaaaacaggtgagggagatgatggtctggtattgggggaacctgcccccaatattttaacataggttctattttccataagtgttggccggctgagaaataaagagagacagtataaagagaggaattttacagctgggccgccaggggtgacatcacatatcagtaggactgtgatgcccgcctgagtctcagaccagcaagtttttattaagggtttcaaaaggggcgggggtgtaagaacagagagtaggtacaaagatcacatgcttcaaagagcaaaaagcagaagcactgataagggtctaacaaaggtcacatggcaaagggcaaaagcagaaccactgataagggtccaacaaagatcacagggcaaagggcaaaagcagaaccactgataagggtctatgttcagcagtgcatgtattgtcttgataaacatcttaaacaacagaaaacagcatttgagagtagagaaccggtctgaccacaaatttaccagggttgagtttcctcaaccctagtaagcctgagggttcttcaggagaccagggcttatctcagtccttatctcaactgcacaagacagacattcccagagctgccgtttatagacctccccccagaaatgcattcttttcccagggtattaatattaatattccttgctaggaaaagcatttaacgatatgtttcctacttgcatgtccgtttataggctctctgcaagaagaaaatatggctctttttgcccgacccctcaggcagtcagaccttatggttgtcttcccttgttccataaaaatcactattattctgttctttttcaaggtgcactaatttcatattgttcaaacacacatgtttcacaatcaatttgtacagttaacgcaatgatcacagtggtcctgaggtgacatacatcctcagcttacgaagataacaggattaagagattaaagacgggcataagaattataaaagtattatttgagaactgataaatgtccatattaagatgaaatctttacaatttatgttcctctgccgcagctttagcccgtccctctgttcggagtccctgacttcctgtaacagtctgggaggagtgggcaggggcctaaagatttggatgaaactcaacagctgagatgggagtaagaaaggggaaaggatttgtgggtgtggtcacatgacatgttgtaacagaagtaaaccattctttagtagtgattcccaagtagggtgtggtctttagagagtgagtcctaaagtggagtggagagatggctcattgacacagagaatatttaggaactcagttggatcatccaccaaacattaaacaagcatcatgtcctacatagtaattatatggatagaagaggataagggtggatagcgaatgggagtgggtcattttccaaaaatggatggagagtgctggggagacaaaacagtagatacctgttacaagcaatggctggatgtatttggatcccattcaagaaattttctcagcataggaagctaaggcaaatttagaccaaaatatccagtttggagaaaagtcatctgtctatattgaagattgattgagaatcacaccattaagctaatggtattaattataaacaggacatttggttttgtaattgcaacattttgttaaattattctgttgcaaacttttatctcttatactaaaatcacatttcagttatggcttagattttaattctcctggtggtataagtaatcagccctgaaaaagcactttcgatttcaagtgatttattgagtacaaattattttaaaataatgcaagtgaattctctctctcttttttttttacttacagtagaaaagattatatgatgtagtcagctttatttcttctatttggcagtttctcctttttttcttactaaaaacctatgaaattatatggaatattagagaaggaatcataaccttctgtaaatcttggtgaggactcttgatttaatttcctgatgaactccgaacttgtcacctctcattctctgatccaatttcctaataaactttgaacttgtcttcttcttctgtctctgctcatggcagttgattcttcattacttcatgaactattaatcatttcctcctaatagttatctgctcctcttgttcattatggattttgctagtggaattatttttttcatattgctaaatggcttctaccactgttctgtggtgagcaggtctgtgcaaacctatccccaaagactgaggagctgagaggctgaagaaagaggctgacacatccgttttcacaggaaacaacatttaatagggccttactaacagaagccatgtctcggtacctgtgagatgatggatccttgccctgttatcctccagacgcagggcttatacaccatggggaatttgcctaagggaaggattcatggtaagtaaaaatcttagaggccttctcagaactagggttgatcagaagtcaacatgatggattagcatttaagatggagttactttgacctgcagaaccaccaacagaataaaagctaaactcctttgattgatatccgaagctatttatgatctacttcttcctcactccaaacctgatctttcacattccacatactgcagggaaatatttgctggttctcaaacttgccatgttatctcatgtcccagtgtttttttgcgtatgtgctctcccatgcccattatgctcctctctgctttgtcaccttggctagttttccattttccttcaaatctcagttcaagcattatctcctctgtgacactttctctgactccctcccgtaagacttcagttgtcttctcttcagctcctgcttgtgactacttgtaccaaagagtcacagccatgcaatgatagggaaaataattaaaaatttaatgcaaacattaatgttcttattggcttggtatatgataaatgtttctgccctggttcccaaataattagcatttattcattattcatttttaaaaggacatatttaacaatttgtacatgcaaacttctgataggtgatgatgatggtgatgatgatgatgatgatgatgttgtgtgtatgttgggaggaatgggattgctaatgacgagcacagaaatttttgttacagaaatattggaatgccttacaaaaatgatcagaatcatttcttgagatcaactaaacagcttcttttttttatataattctctaataagataccaaacacagatattatatagaatgccactatccctttcatttaatcaacttgtaagtcttccttcatttattttgttatgggaagtctcttcttagtagattccagaaggacaatacagtattgccaatttaagggatgtgtgagaaagagtgaatgattctgtgagcacatgatttaatatacttcattggttataaatttaatttttctgtgagacataaatgttatgattttgtgactctttaggtaataacataattcaggagcaattctgaaatcagaattgatatgtttagaattttttttagtttaaaatggaatctttgggtattaggatttataaaagttaaattccattggaatgtcagtttatactcttccagtacctctctctctcatttgcttggatgattctagtttttttttaaaatgtgttttaataatgcatcctagcttttggggggattatactttagacatatccatgaatagagacatccaaaattcttatgcctacaattaggacttatattcaaggagaatttaatttcttgagcttattcaagaaataatttttattccaaaaaggaattgaaattatttgcaacatacatgcataatacagtagaagtagaaaatcaggaccacggaaaaggcagaatcaaatttgttttgatttcatgggtttcaaaaccttgcttggttttgagcttcctcagagctgagcacaaggggaaactacatcactgtcgttatcagcagtgatgaaaattgtaagttcaacagaggtctttttctttgcaccaaattgtagaacttccttgctataaattttggtaaagcatttcttttttcttgtgcttggtacaagagatgctgaatggtgaagtggcaaatgcagaaatggatttcatattcttgtgtcttaaagcaaacgttcatcaaagtgtagagtataacatttaaccagctgggcgcggtggctcacgtctgtaatcccagcactttgggaggccgagatgggctgatcacgaggtcaagagatcaagaccatcctggccaacatggtgaaaccctgtctgtactaagaatacaaaaactggctgggcacggtggctcatgcctgtaatcccagcactttgggaggccgagtcgggcggatcacgaggtcaggagattgagaccatcctggctaacacggtgaaaccccgtctctactaaaagtacaaaaaattagccaggcgtgttggtgggcgcctgtagtcccagctagtggggaggctgaggcaggagattggcgtgaacccgggaggcagagctttcagtgagccgagatcacgccactgcactccaacctgggcgacagtgcaagactccatctcaaaaaaaaacaaaatacaaaaattagctgggtgtggtggcacatgcttgtagtcccagctacttgggaggctgaggcagcaaaatcacttgaacccaggaggcagaggttgcagtgagctgagattgtgccattgcactccagcctggcatggagcgagactctgtctcaaaaacaaacaaaaacaattaatcatgaaagcaagcctgtgatgctttatttcatgaaaacatttctatgaagggcaaagtgataagggttcaagttactttgactgaatagctttatctgaggatggattttagaacatcaagactgtaataatgtatttctcagacaaactcctttcctattatttaccttctctcttttacttttgttttccaacatgtgcagagatcctctattagttgtcattttctttttaacactgcccttttaacacattgtcagatgacctccaccataaggagctgtcagtctctcaacaagaatgatgttctttgtattcattgaaggtattacttagctgaaactggagtggttggaaggcaggccacctcagaatgagttggtaggtgttgcatctgaaaatgattctaaacctgttaatactgcatacttccttttccaaacatgtgtttgcttatatagttatttgtataatgtttcattaatgtctgatttcccagctatacccgaaactctatgagtgagagattatgttgatcttgcttaccttttaattttcagtgcctaaaacaatgcctggcacagtagcattccatacatttgattgaataaataaatttgtttcttcatcctttacatgttgtctttgccagtgttaccttttttattttttgagacagagtctcactctgttgccaggctggagtgcagtggtgcaatcttggctcactgcaacctctgcttcccaggttcaagctcttctcctgcctcggcctcccaagtagctggaattacaggcacctgccaccatacccagctaatttttgtatttatagtagagacagggtatcaccacgttggccaggatggtctcgatctcctgaccttgtgatccaccttgcctcggtctcctaaagtgctgggattacaggcgtgagccactgtggctggcccagtattgcctttttattgtaagatatagaaaggtatttatttgttcatttataaaaaataagacatggtctctgatctcaaggaatttaaaatctggttaaaaagacaagatatatatgcatgaaaaattaaacactcttgatgatacaagaaaatgtgtatcgagtatcaaatgaatagtatggactgtgagtgctgtgagaatttaggagagaggatcatagtgggccaggacaggggaagaaagctttgttgcccatgtgggacctaaattgagtctcaagcgtgagtgggattaaaatagtcagatatgatgaaaggtattccttatagatttcaggtcatggggtagaaagtgtgagcaaagatggagacaactcagcttttttttggagttggggtaaaagctgaagaattcatgctcattttgactgagaacaatttatgttaggaaagaggcgttgcagtgaaaaggtaggttgggccaaaattctttggtctttaaatgccagtcttctatctttagactttatctcttccattacagtctttaagtcaacgaaaatatttgaacaatgtgtgagatgatgacaagattaatcttgaagcagaatttaaggggaattggaaagggagagatttggggagtaaaacagaagtaagaagttattttgggggctgcctgcaataattctggcttatgtttgttcagactagtctaaaataaggggtggagcaaaggcaagcagattggggtatgtgaggcgatgtgaaacctccacaactgataggatatgagtaggcaagagtgagagtgaaatgaaaggtaactaggaagattaggctgggagactggaggagtgattatcctactgaaaaaaaaaaaaagtccatagtggaatctggttagagaagaagataatgagttaaggaagtgatgacagcaggtcatgagcacataagtgatggctcatttaccttgaacagttcacagaacagtaaaggtgtgtgttactaagcttagtccaggcacactttttaaaaaattttatttttatttatttatttatttattattttttttctgaacctcactctgtcaccaggctggagtgtggtggcgtgatctcggctcactgcaacctctgcctctcaggttcaagcgattctcctgcctcagcctcctgagtagctggtattacaggtgtccaccaccacacctggctaatttttgtatttttagtagagacagggtttcaccatgttggccaggttggtctcgaactcctgacttcaggtgatctgcctgccttggcctcccaaagtgctgggattacaggcgtgagccaccgctcctggcccaggcccaccacttcttatccaaaaccttgaggccagatgtgtttcagaatttagagcatttgcctttatttaaggtcaccctgctaaataccccatcatcagacatgttaatatttctgtatatatgtatacatatttacatgaagttggataagtaaagaccacagacagactcaagtaagttcaggttaggtgttgctactaaatggattcaggtttggtcaggttttgcgaataaattagttacaaaaatcagagtcttttggatctcggaactgtggaaactggattgtggacctgtacttgactatgataagcatttctttttttctttttttttttgagatggagtttcactcttgttgcccaggctggagtgcagtggtgtgatcttggctcactgcaacctccgcctgccgggttcaagggattctcctacctcagcctccctgataagcatttcatatacatctttgcttaccccaagatagccagctgcataaaaatcatgattttttaaaaatgctgtagttaaaaaaatagaataatttgataactaaatatctgccatagatgaatacatgctaaagatgtacttttcttgtgtttatattatgcaaatcattaaggggtttgctattttctatgtacctatgtctgttttagtttgaaacaggaagtttggggacaaaagcatcctcaatatatccagagatttgggaagacaaattctagtttgtatatttcattttactgtaacaaaaaggatatctcccatacaataccaagtaactcaacaatattttgtcatttaatgaatttaataaagtgaaatgcctgtttgtcttctattttcttagctttaagcttagtttgaatttttttggtatgttgaactgcacatatgattttatcatttcaaaatagaagaggttaaaagattctgaaaagcatggtcaaggtagtcatggtaatacaggaatatcaaaacatgaagaattcgacatttaggaataaaaaactattattttaatacaatgatatgggtatggtttgacttcctttgtgttaatttgagatctgaatagctgaatagtataaataaccaacaagttatcatggtcgttgagagtatattaaaactgtatttatgactactcagggcaaatgtcaacaactgattattttaataattgtattatcagagtgctaaggacttttttggggaaattatttgaacagacgctgtctatatagccaaatgccatgtagaatatctatagttttaagctttgccccctcaaaatgttatattagatactcatgacaaatatttaatgttgtgtcaccatcttcattctcaaccagtctgtatggagttctggaatcatacttcttctaggtgcttgaattgtcaagacccagtcctttttcacagagttagtaattttagagcccaaagtgaccaacagaatttaagttagagaaaaatgttatttcaaagtttggagtgaccttctggcataaggaatttaaaaaagcagttcctcatgtctatcactatgaaacagtccctcataccccatcacaatcctcctcctccctctccaaaccactcctgtcaactataaattagtttgcattgtctagaattttatataaatgaaaacatacagtatatactcttttttgtcaggcttctttcattcagcataattttgaaattcattcatgttttatgtatcaatacttcattcctttttatttctgactggtattgtgtgactgtgtcaaaatttgtttacccatggtatctgttgatagacatttctatttttttcagtttttatatatcacaaatctatgaacactcatgaaaaaaaaataaaaaagcagttccttaaaaagacatgagatagattaggaaaggtaacctggaaaattattgatatttgatgttttaaaaaattcccaggaacacccttcttcagagggagatttggtgtgttggagctactgaactttgtagcccttttcaaaaagctgatcttattactttgtgttcctgttatgttctctctcctagagcaggaaagcaaggtaaggctggaaatcccaaggacatggccatttcctcccacacctgcttattaggtgccttcattagtttgcagtgcagtcagttgcacatccattagcgctaaagggcaatgagcttcatgcagctttcagtgtgatagaatcgtctggctgctctagttcccctaggacagaggatacaaacactgtaaaaggatacctcaaggacttaataaactaacttaggttagagcattataattaagcaattatgaaccagggtgcctttctaggtacttttttttttttttattgtacttgatacaaatgagtcattcagggaccaagggactcttttcttaccaggtccaatcattgcctccacgtccttttctcatttcctacccatgggaggtaatgctagaagtttttcacaaagggggctatcacatggaattacagaaggcagactcatatacatggtgcagagggaaaccacttcactattagtgagatgtaaccagccagggtggaatttgacagctggttaaataacatatggtaaaattgaaaatgaaaagtgcttgattacttgattcatttaaaaccatattgatagaggtcttagtttgcttattcttcaaataaaggggtaatcagtcctggctgagtagagtactgtgatttgagatgatgctgccagaattttcccctgatttatttccttttatcttttattaattcctacaactagaatcatttcttgaagatattttcactgggtttaaaatattatgctacttgagaggtgtgatgaactaacaaggatgttaacaatcccatcatagagagatctgtgcccaaaggataaataagtggtggtaggtgggaggaagtaggcgaatgtgctgatatggtaactatgttgccctgcacggttctggatagaagcacgggtcaaagaaacgctgttagaagatttagggatatgcagagggtcagactggaataaggggcttctccaaagacaggctttagttgttttactgtggtggccttgacactatatctgattttgagtatcacaggtggtccaagcagtcctattgtttttaatttggattcctatcgtggctgtgacccagagttattgttgatgggtaaatagaaatgtacagggttgatctgcctgccttcaaggtcataacagtagccagcagtaaaattggaacataaaccgaagcctcctgattcccagacaggcgccttttcaggcatcccagatggcgaactggcagccggtgtgccttgtctgccttaggaccggattgtgctaggccactccctacagttttgctctgcattgcctgtgttctggcatctttttctggcaccacctcctgcctgaccagctctcacttttggttaaagaaagtcatttagtcgcccccacaagaagtcctatagtttcagggcaaagtctgtcattgctgtggagcccagagaaactcagtacaatgcttcctgtccttgtggccatcagtaacctcattttcttggctggactatactttttccccttaatttcagaggagtgaaatctagatattcttaggctactccatgcttgttatgatactttgtgtgtcgttgaggatgtagccattgaaatggacagactagctaagagtaaccagcaaatacacacaaacctgagagagtgagttggaacttgctcttcagtatctcagggaagagtgtcttttatgtcctttccactttattcctgtttgaactgtgctgtttttcaacatcatcattgacaaatgtgttgaatacctgttatttgcaagggaaagcaccaggtgccatgagcctctgccttttaggagggaaaattatcaaatatgataattgccagcactgcagtgggagtggaagggacagtctcttttgaagggggcaagaagtcaaaccgaagagaaatcatcaaataaagcttcctagagaaataggagtttgtgggaatcatagaatctcagagtgaatggaattggtgagagctttcttgttacattttcagccaatctctgagcacctccaacaaaggcgattatccccaaagaagtctctgtgttcgattactgtttctgcatttcctgtgtgtgaacctgagctttgccattacaactccagcggaattctgttggagggaggagggccttccaagctggagaagtggcaagcgcaaagttgtggggaaggaacgggcaaaatggttgcagtgtagagtgtgaacaggccagtgtttctggatcagtagttttgggtagactggcagcaggaaagagaaacttcagtgcaaattgtgaagggtctggaattccagatttgggagcttaaaattcattctgaaaatgataggaagccatggagcatatctctcccttcttgatttgtaaatgtaaaaagttatataaacctattgtgggaaaaaaaacagaatatatgaagtcaaagaagaaaaattttttgatcaaaaagatgacgagatcaaaacagtatcataggaaaatgcatgcaggcttagttggccttgaggcagggaggtgtgccacagttgctggggtataactgacctcaagtgatcaaggcttgatttagaagtggtggcaatgagaatgaaatggaggggaaggaaggaagagaatatgtgaggaagactgatagtgcaaatacagttttcttctattctaaataacatcattttaaggactcctattccctgagtccattcccatcatatactgaacataaggcataacaatctatttctaaaattggcaacttaaattatcattagatcatcttactttattctccaagtttgctgaaagaaacaaatgtgtggttctggtggttatttgtgacactagaagagactttaagaaaaaacagatttatgctcactgatactaagctatgaaggtgttaatgtcattgagtttcttcttcttattattatactttaagttctggggtacatgtgcagaatgtgcagttttgttacataggtatacacgtgccatggtggtttgctgcacccatcaacccatcacctacattaggtatttctcctaatgctatccctcccctagtccccccaccccgtgacagggcccagtttgtgaagaatttcttttttgaagcttagcatttgttgaatttgtggatcatgctcattaatttgtctcatttgcaaagtacaggagccttaatgatataggacttgattttgttcattcaataaacacttagaattttctaggccctggggatccagcattgaacccaacaaggtccctgctgtgactgagcttacagtctagtaggaaaagatggataataaacaaataaatcattatatattatatcagagggtgataaatgctgtggtgaataataaagcagggagagtctagggaggggtccagagagttcccggaattccctccctaatgagatgatctgaggaagatgaaggaacaacctatgtagctttctgggggaagacatcccaagaagagggcagggcagccctgaaagccccagagcagtggtgtgttgagagtgtttagtgaacaaggtggcaaggaggtcagtggctggagcagagggaacagaaaagagagtaggaggagaagtggagggaggtgggacagccggtcataggttttataacaaggctttataacaagccttctctccttaagtaaaagggagacaccaataaacatataaatccgtatagctttatttagtttctaaattaaatatggtatatttaaagttggtgttttagtgacgcccttgagctcattgtcttagtttattctgagagaatgcaggatccatgatttttattctggcagttcctttactcttctcagctccccattatggctcctttatggggctgtccacctcacctccctccctccagtgggacatagaagtgaaggaagatgctttttaggaaggctgatttatttaataatttttaagagagattcttctctgtgcctgttccccatccctgtccgtagtggaggcaatgctaactttgtaatagtattttcagcagtggaggtggggagcgtggtcctggaggcagccatgtggggaagtcacagttgattgtctttaaagttctcactctcagatccccccatagagtaagaaaagcatctttctttctctagggatgaatagattttctgtccatgtcggggagggggttgtagagatggaggttcacagacctctcagattctttccctgttataaccccagccatgagtctgctagatcaggcgcatgaaaatgactcttatctgtttttttctgggttgctcccctgcttctatttagagcttaaacagattactgaactctatgctatccactgaattttgtaaacacaagtgcttaacaatctatgtttaaaagaggacagagaatttgcttaacagctgaattctagatgacagatcaaattgaatatgaaagaagaatatttttactcttcttcggaacactgtcacagtgggtggaggaagatctttagatacaatactttgagcaagtctagacatattttagctttaggtatgcaagaaagggtagtaaaagagacgttatacattcattcgagagatatttctagtgtgccttttatgtgggaggattgattctatgcactagggatacagtggtgaataataataataacaaaacactcaagatttttgttcttataagttatgtattctgatgggggaaaatatacaattgtggtcggtcattcctgcaattcatcagatatttttgtctcatcatgtctgacacgtggtgaggttgtacttgtgattagttatggctggttaggtcagagcaggggtgatgtgtggcatttctgaactagagcatttgattgcacatgccagaccctccagcttctttttctcttccttggctatcagcagttttccagacagttgcttcgctgtctgcttgagtctgccagagtgaaggcaatgtggagtagggcccttaactgatcctcaatggacatatagtatgagaaggaaataaacttttgtctttttttgagatggagtcttgttcctttgcccaggctggagtgcagtggtgtgctctcggctcactgcaagctctgcctccaggattcacaccattctcctgcctcagccacgggagtagatgggactacaggcgcccgccaccatgcccagctaattttttgcatttttagtagagacagggtttcaccatggatctcgatcttctgacctcatgatccacctgccttggcctcccaaagtgctgggattacaggcgtgagccgctgcacccagaaaataaatgtttattgtttgaagccactgagattttagagttggcataactccaagcatggcataacctaacgtcctgaatgcctgactgggagaaattaaaaagtcctgactgatatagaaatttaaaaagtaacattttagaaaaagaagtacttctagctagtgatatagtctataaacaaaacaaaacagggagctgtgacagaaaatgcctggggtggagtgcagaggatactctaactagagtggttaggttagctccctcagaggaggttatattgaaacctgaaagatgagaaggagctagccaagtgaaaatctggaagaagtgcattcaaactgaaggaatagcacatgcagaatatgagtggtgaaaacatttggtacatttataaaacatctgggaggccaagacaggagaatcgcttgaacctgggaggcagaggttgcagtgagctgagattacgcactgcactccagcccgggtgacactgcgagactctgtctcaaactgaaaaacaaacaaacaaaaaaaccaagaaaaacaaaaacattggccaggcacagtggctcacacctgtaattctagcatttcaggaggcctgtggtgaaaccctgtctctactgaaatacagaaaatcagctgggcatggtggtgggtgcctgtaatcccagctactccggagcctgaggcacaagaattgcttgaacccgggaagcagaggttgcagtgagccaggattgtgccactgcactccagcctgggcaacaaagcgaaactctgtctcaaaaacagcaacaacaacaaacaaacaaacaaacaaacaaaacttcaaggaagttaatggagcctaaagagtaaggaaggaggaggtagctaggagtttagtgatgttagacttgacagatcatggtatttcattttaagaataagccatcatagagttttcagcagaacatggatatgatctgaattagatttttagagtgactctttgaaaagatcagactattacgcatggggcatctctgactctagaagaaagccacaattctcttgatttggggactcagagcatggagttcagggctgacaaaacagttggaaagtaatagagcaaatcttagaaagggcagacccacagagggaagccccaaattttatgtataaactctcctttaattcttaactggccctgaactgttcacacttgagggagtttttaagaagcccagcaaaagcaatggctgagaggtggtgagaggtgacagcgtgctggcagccctcgcagccctcactcactctcggtgcctccttggcctcagcgcccattctggccacacttgaggagcccttcagcctgccactgcaccatgggagcccttctctgggctggccgaggctggagctggctcccttggcttgcagggaggtgtggagggagaggcacaggtgggaaccggggctgcgcccggcgcttgcgggccagctagagttccgggtgggcatgggcttggcggccccacactcggagctgccggccagccagccctggacagtgaggggcttagcacccgggccagcagctgtggagggtgcgctgggtcccccagcagtgctggcccaccagcgctgcgctggatttctcacggggctttagctgcctccctggggggcagggctcaggacctgcagcctgccatgcctgagtctccctcactccccccgcagtgggttcctgcgcggcctgagcctccccgaccagcacctccccctgcttcatggcacccagtcccacccaccgcccaagggctgaggagtgcaggcacactgcgcagggactggcaggcagctctatctgcagccccagtgcgagatccactgggtgaagccagctgggcttctgagtctagtggggacttggagaacctttatgtctagctaagggattgtaaatacaccaatcagcactctgtatctagctcaaggtttgtaaacacaccaatcagcaccctgtgtctagctcggggtttgtgaatgcatcaatcggcactctgtatctagctcaaggtttgtaaatacaccaatcagcactctgtgtctagctcagggttcgtaaatacaccagttgacactgtatctagctaatctagtggggacgtggagaacttttgtgtctagctcagggattgtaaaagcaccaatcagcaccctgtcaaaacagaccaatcagctctctgtgaaatagaccaatcgactctctgtaaaatggaccaatcagcaggatgtgggttgggccagataagagaataaaagcaggctgctggagccagcagggggtccacactgtgggaactttgttcttttgctgtttgcaataaatcttgctgctgctcactgtttgggtccacactgcctttatgagctgtaacactcaccacaaaggtctgcagcttcactcctgaagccaacaagaccgcaaacccaccgggaggaacgaacaattccagacccgccaccttaagagagctgtaacactcaccgtgaaggtctgcagcttcactcctgaggcagcgagactacgaacccaccagaaggaaaaagctccgaacacatccgaacatcagaaggaaacaactccggacccgctgcctttaagaactgtaacactcactgcgagggtccgcggcttcattcttgaagtcagtgagaccaagaacccaccaattccgacacagtgggaagggttgaacagagattttagtgctgtctactgcagtaaagacagagtttggggtttgagtcataccaagttagaaggattggtaaagtccttctaactttaccttctaacttgggcattgaaaccccagaagggtgccccttagaaataaacaatacatccttgggctataggagttgccgcaggattgtgggcaaaaactaatgtagatttggccaggtatactggctcagacctgtaatcccagcactttgggaggccaaggtgggtggatcacttgaggtcaggagtttgagaccagcctggccagcatcatgaaactccatctctgctaaaaatacaaaaattagccgggcgtggtggtgcatgtctgtaattccagctactagaggggctgaggcaggagagatgcttgaacctgggaggtggaggttgtagtgagctgatatcgcaccactgcactccagcctgggtgacagaacgagactccgtcccaaaaaaagaaaaaaagaaaaaaaaaaaactaatatagactcatacataccaagtatcaaatcaagccttcacaagttcaaagtgattagccagtaattttaaatttaatttaaagtgattagccaaatcaggccttcaccaatttgaaatgattagccaataattaataataattagtaaaattaatactcttagaggaagataataaaacaatgtatcatctataaagtccagtttaaaattaaagtttattgtacatacaaaaaaccaggacagtgtgacccatagtccagagaaaaagtagttaatagaaacagcacttagatgatccagaagctggcattagcaaagactttataacagtgttcatactttgttcatgggcaaggagatagaaaaccaccaacagtttcatagtcaaactgctgaaataaaagataaagagaaaattttgaaagcagtcagaactaaggtcacatttcacataggggaatgatgatatgaatgatggttaatttcttatcacgaacaagggaggccagaagatatctttaaagtactgtaagaaataaaaatttcaacctaaaattctatatccagccaacatatacttacaaaatgaaggtaaaataaagacactttcaggcaggaggattgcttgagccaaggagttggagaccatcctgggacacatagtgagacctcatcgctaccaaaaaaaaaaaaaaaaaagttatgtgaagcggtgcacacctatagttccagctacttgggagactgaggcaggaagattaccagagcctgggaggtcgaggctgcagtgagttgtgattgcatcactgcactccagcctgggtgacagagcaagatcctgtctcttaaaaaacaaaaataaataaaagacacttttcaaacaaatcaacaagacagttatctatagcagacctgctctacaagaaatgctaaggaaagttcttcaggctgctgatgagtgaaaccatatagaaatatcaaatatacaggaaagaatgcagagcattagaaatcataaatatagggctcaattagaaagactgttttttccttaatttttttaaaagacaaaaatgtttaggttggcgcggtggcttacgcctgtaatcccaacactttgggaggctgaggcgggtggatcacctgaggtcgggaggttgagaccagcctgaccaacatggagaaacaccgtctctactaaaaatacaaaattagctgggtgtggtggtgcatgcctgtgatcccagatacttgggaggttgaagcaggagaatcgcttgaacccaggaggcagaggttgtggtgagccagattgcgccattgcactccagcctgggcaacaagagcaaaaactccatctcaagagaaaaaaaaaaaagaaaagacaacaatgtttaaaaggaaaattgtaatattgtatgtcatgattttgtaacatgatactataaaatatatgacaataatgacagattggaggcaaatggaattacactttagcaagattcttgtattttatatgaagtggcacaatgttaaccctaattaaactgtgataagttaaaaaggcatgtttcaatctttagaacaatcagtgaaaaatataaagaggatacgtaagaaacctaaataggatgtaaattattatactaataaaataatattatgccaaaagaaggcaggaaaagaggagcagaggaagagtatacagatgggacaaggataaacagcaaagtggtagacctaaatccaactgtataattttttacgcagaaaaactaaacattccaattacaaggcagagattgtcagactgaatttaaaaagtttgatccaagtatatagtgtttataaatgatgtattttaaatataacaacagagcagttgaaatcaacaggatggaaaatgaatatatcctgtaaacagttaacaaaagaaaactagtgtgaatatgttaatatcagacaaaagtaaccaaaaagatgttttaaaataatgaaagggtcaattcatctgcacaataaaacaatcatatacctatctagagaatcaaaatatctgatactaaaactaacagagcaaaaggcataatcgtaggtagataatttattgtccttctcttactaattgacagaattagctatacagaaaaatcagtaagaatatagacaattctagcacaaacaccttgagatctgatgttcacagaacattactccagaaaaagaatacacattttttcaagtacaatggaatattaatcaagatagagcatatattgatccataataaaaattttcaaaagataaaataatacaaagtatgttctctgaccacaaaggaattaaattagaaataaaaatcaaatatacacacacacacacagacacacactctgtctgctgtctctctccttctctctctctctttctgtctctccccctctctctgtctctccctccacccaacccccgccccccgccaattctctttctctctccaaatatttagaaattaaaaaacacacttcaggctatgcatggtggctcatgcctgttatcctagcactttgggaggccaaggcggttggattgcctgagctcaggagtttgagaccagcctgggcaacgtggttaaaaccctgtctctactaaaataataataataataaaaaaaaagccaggcatggtggcccgtgcctgtagtcccagctactctggaggctgaggcaggagaattgcttgaacctgggaggcggaggttgcagtgagctgagatggtgccactgcactccagcctggcgacagagtgagacaccgtctcaaaataaacaaccccaccccaccctccaaaaaaaaaaacacacacacttcaaaatgcctatggatcaaagaagaatttagaagataaattataaaatatttctaactgaatgatgaagttatataaaaatgtatgagatgtgacaaaacagtgcttagggttagtttatattttaaatgcttatattagaaaagaaaaaagttgcaaatcattgctctgtttttattgtaaggggttgggaaaagaacaaattgaatcaaaagtaagtaggaaggaggaaataataaagcaaataagagcagaaataaaaaaggaaaaggaaaaagaaaaacaatagagaaaattaataaatccacatgttgattatttgagaacattaataagactagaaatttctagaaatattggttaagaagcaaagagagaaaacacaaattaccaatgtcaagaattaaagatggaatttcattacagatctaaagagataaaaagtacagggaatgccagtttatgccaataaattctaaaaaatccactaacgaaatataatagaaaaaaattcttgatagtcataacttaacaaaactgacataagaagaaataatccacatagctatatatttatataagaaattgagttcattatcaaaaacctctttagaaagagatttcttggcataaatggttccctttttttgtgctcttggggacttgtagctgccatccttctcttaagcaaaagggagagtcaaggcttcacttatttatttactttatttaattctattgtagcatttatgatgtgccagctactgttctgagcactttataaataataacttacctgtcagagatgtgattcatagtaaggacacgaagagaaaatttcaggaatgtttattttctacaatatatgcaagtaatgtatgcttaacagaattgttttctacccactggtgacagaaacttgtgggcaaatgggaatatgcctttaaatgtgtactctgatggcaggagcaatcagtcagtggcttactctcattttctccctgtactgtgtatgccgaatagaaaacaattgttaaaacctggaatatgaggctaaactgtaatgctttctttttcctgttcttgctgcatgattttctgcctttcaggctcatgctatttccttggatctctacattttttttaaaatttgttatttccaactttttattttgagttcaggtgtacatctgcaggatgtgcaggttgttacattggtaaatgtgtgccatggtggtttgttacacagattatcccatcacccaggtattaagcccagcatccattaacttttattcctgatcctctcccttctcccaccaccccccatactctcctacaggccccagtgtgtgttgttcccctccatgtgtccatgtgttttcatcatttagctcccagttataagtgagaacatgtggtatttggttttctgttcctgcattagtttgctgaggataatggctccagctctatccatgtccctacaaaggacatgatctcattcctttttatgctgcatagtattacatggtatgtatgtaccataatttctttatccagtcagtcatgggtggacatttaggttgattccatgcctttgcttttgtgaatagtgctgcagtgaacatgtgaatagtgctgcagtgtgcatgtgtcttttttttttttttcttttttgagatggagtctaggcctgtcgccaggctggagtgcagtggtgtgatctcggctaactgcaacctccgcctcctgggttcaagtgattctcctgcttcagcctcccgagtagctgggattataggcatgcaccgccacacccagctaattttgtatttttagtagagacgggatttcaccatgttggccaggatggtctcaatctcctgacctcaggagatccacccacctcggcctcccaaagtgctgggtttacaggcgtgagccactgtgcccggccatgtgcatgtgtctttataatagaacaatttatattcttttgggtatatacccagttatatacccagtatatacccagtaatgggattgctgggttgagtggtatttctgcctctaggtctttgaggaattgccacactctcttccacaatggttgaactgacttgtactcccaccaacagtgtaaaagtgttcctttttctccacaaccccaccagcatctgtttgcttttgttttctttttgagacggagtatcgctgttgttgccagggctggagtgcaatggtgctatccccgctcactgcaacctctgcctcctgggttcaagcgattctcctgcctcagcctccccagtagctgagattacaggcacctgccatcacgcctggctagtttttatatttctagtagagacagggtttcaccatgttggccaggctggtctcgaactcctgacctcaggcgatccacccgccttggcctgtcatagtgctgggattacaggcatgagccactgcacccagccttctttttgtttttttttttttgtttgtttgtttttgagatggagtcttgctctgtcgcccaggctggagtgcagtggcacgatctcagctctctgcaacctctgcctcctgggttcaagtgattctcctgcctcagcctcctgagtagctgggattacaggcgtgcaccaccacgcccagctaatttttgtattttttagtagagatggggttttgccatgttggtcaggctggtcttaaactcctgacctcaggtgatccgcctgcctctgcctcccaaagtactaggattgcaggcatgagccactgtgcctgggctttttgactttttaatactagccattctgactggtatgagatagtatctcattgtggttttgatttgcatttctgtaatgatcagtgatcttgagcttttttcctgtttgctgtccatgtgtatgtcttcttttgagaagtgtctgttcatggttttatgtctggaaatcaactctgaataaaatatctatctttagctgtctccacaacagtgactagtatttaattacaactaggtaagccattacagagcagttttgcaatatttgagaattggattgacttgttattgatctgatttgataatttttgttaagagatgtatgctaataagaagctaataatgtttcataaaagagtatttggaagtatttttcaaacattattgaggaacctttttccctttgttcacagcacagtactaggccctatttagtccagcaatttttctaagtattgttctgatagcaaaaaaatatacatatcagttgatcagttttctgggtgctctcttaccttaaatggtagatgctcaaaggttatggatgtgagtaatcatagctcactgcagctttgaccccctgggttcaggtgatcctcccgcctcagcctcctcagtagcttggactacaggagtgagccaccatgctcagctaattccttttttactttttaatttgtagagatggggtcttgccttgttactcaggcctgtcttgaattcctggcttcaagtaatattcctgcattggtctattcctgcctttttagcggagtgagatgtgactaaggcatttcaaagcactctatcttcagaactacctgctacctatctcaattgcaggttcattattttctatttttggcttatatcctgtagtaatcaaagattggcttgaaaacaatattggcacagaccatcattatgagcacgaatactattctaaaaataaatgaaaaaggcgtctgtacctctaactacagaaaagctatgatgaaggcattttgactgttcggccagtggaactcagtgacatagcaggtattaagaaataacttttctgtaagatactttcttttgggcatctaatttgctcatttttagttgagaatttcaaatacttattttttcagagcttttgtatgtattttaatgttaccagagaattagcttattcaagaatggaagatcataaatcattacatgacatattgtacaggaagacattgagcataatttgttgataatgcccactcacaaaggtatttttgaatctttccatcttccagttatgacagttaagataatagtgtgctttcccactctaccatcaagtagtgtgtcgtgccttgtggtacaaagaaattgtcatgaaataaaattcaaccagtctttgaattcttaataccttaatagcaatatgaaatttctgtaaaatccacagattatagctttcttttttcccctcttgattcttattttgtggcaaagagagaaagataaaaaatgatgatgcaaatgagatgttttatagcactggaaaatatcttgaaataaaagataagtcagactctaaaatgtaggggcaatatgaggatgtaggaagatcggtagagaatttcatcaaaggtgccatgagaaataaaatcttaggaagaggatgctcaatagtgatggatgcttgaggagagacagaggattttgcaaactgattaaaggtgatagaaataatagtttctaattaaaactgcttctaattaaaactccttttaatggaaggataatacttagtgaatttgagttctcaaagtactgacttacagtttaaatatgaaagtctcatttttcttctaatagggttagtagagtataattaggcaaacttaagtgttgtgcagcacagagattattttaaaagttaagtatttgagaatccactttaatcaaaaccttttagtatgtgagaatataattacattttacaaatatatttgaaattctctttactatatgatggaaaggtatcaaattcatccaacattcagaggtttagtaccctaatgacgttcttatttaacaattaattttaataccaaaatgcaataaaacacatttagctatcttcttgcttgtcctggatattaataaaaatctgaggcttatgctgaggcaggaaaacattcgttaattttatgtcattaaaaaaagaaaactgtactcacttttgttctaatcttaaattttgtctttctttctgtacagtttctacctatttttactgtatctttccagttagttttaattttttcgttttattttattttattttttccttttatatttctcaaaatttcattctgagagccttttaccaagaaggttctcagaagaatactttgataagttctcttaaagctttgctattttatttttgtcttttgcattcctttttctctaccttaaagctatctgcatatacttgttttctctttcatttcttttattcttccaactgccttttgatcatttattattaaagccagtgagttataattattttttgttgtagcttgcttttaatctgagctgaaaaatccatgttttttttcatttgttatattctagtcttacattttaactcccttcttttcatttatttattctgttctattttcctatcttagtttttcccacattggtaattattgctttttttctctttggactagataaatttcttacttcagtaacattgtaggaaggaatgaaaatagtgaagacaacaagacatttaacttttgcattacaataaataggaaggaattatggaactttaatttgtctcctcatttcatgggtaagaggtcagaaagttatattaaaaaacatattaaggctgggcatggtgtctcatgcctgttagcccagcactttgggaggccaaggtgggtggatcacttgaggtcaggagtttgagaccagcctggtcaacatggtgaaaccccgtccctactaaaagtacaaaaaaaaaaaaaatttagccaggcctggtggcaggcacctgtaatcccagttactcaggaggctgaggcaggagaatcgcttgaacccaggaggcagaggttgcaatgagccgagattgcgccactgcactccagcctgggcgacaagaacaagactccgtctcaaaaaagcaagcaaacaaaaagccatattaaatcctgggagatagcctcatatagtctattttccccaaccattttgttagtctacacaggttctaggatagttgatcctgcacttttagcattctttttaatttgacatgtttttcagtttaagtcctttgtcagtatagcacagaatgagtactccgtttgtatcagttgaattaatttgagctagtatctaatgtactgagttcattaccatttaaatatgcactgaaatccttcatttctggaagagtaatggggatatcaaattagatccgcagggatgaagtgaggccagggtcactgaaatccctctggggatgcaggtgggaattacattttctcactaataaataacatttgacatttgataagtattcttaagttcaggggagctgaacttgttcatacaaactgtgttaattatcttccgtaaaaaacaggttagcctctataattttgagctgcaagtaatagatacaagtcgcccaaaattattttgtaaatgatgtatttgtaagaagttaaatacaaacagcttctttacagcagtaagatttgcttaaactcaggacagggggttgaaaagaatggtggggaagtgtgtgtgtgtgtgtgtgtgtgtgtgtgtgagaaaagagtcagaatcgggtagggcaacaggataagtagaaagggttgtgctaaaggtgtgccgggagccatctgacttgtactggagatccagtagctgaatgtcactatcaacagtagtgagggctcagaacgctgaagcaggtttacatgatatatttttattttatttttttgagatacctggaaatccacatctgagcttttgggatatgctgttgctttttgctttcagtagcttaagcaattcaacttggcttatatgtttctcatttgtaatctaaaagtcatgcaggactgtgtccaataaagtttctctcataaattcatttctctatctcttgattattttctttgccttttcctctgactgtgactttggttggattgattatctagctgcctaaaattcaaagaattaaatttgggacagggcctagaacaaaaacctgttgggctactttatttactattgaaaggaagaatgacaaattatcactccattattgggccgggctaacagtgaataagggaaagaaatcagaggctactttaccttgcactcatgtcctactcactcttctctcttccccattatatattacgtttttttttcccctgggatgatatgagtccacaagcttcatctggaaaacccgcatttagtcccacttggtccacttattcatatggaataattctgatggcttaaacttttagtcttcaaaattgaaaaccttgttgggatagttttgattggcttagttcttttgagtaaaatacttagtatctcagaattcttcttcctctcctccaagatgtcatctgaaggtacaagagaaaagtgtgcccttcatgatctgcatggtatccagtggctcatcctgttctcatgactttgtcctttcctttccggttattgttcaccttgcatttatgatgaagaacaacagctagtgtaactcatgatttgatttatctaggattgttcaggtgtggtggcattctctggctgattttgctctctgagtctctgttgtttcctagagttgagacacaccttcttgccatgcggggcccaaccagactgtgggctttcaacttggtttcctctgatattgtcttgtcatttctagggtcattcaagagcttaggttgatcttcaagatgtcgttttctaggaaactcagctcatatctagctgccagatggaggataagaggatggagaagacattcttatttgctcagtaatcttggacaatttatagaaattttgcagtgcactgaatatggtaatatctcacagccttgttagaatgattatacaatttcaaatattttttgagcctttaacctgtcctgtctaccttctgaagctcccctcccctcaccttttctgagcttccactttcttcctgcctcatagacacacaggataattttcattaaggtattgcgttttccaatgctgtgcttagcatagtttctgatatatagatactcagtaaatatttgttgaataaatgttggataaacaagacctatgaagtaaataattatacttagtttaaaatactatatagaaataagtattactagtattttgtcatatcctttccctcaatacccctctcttttaaattattttatgacagtgacatgtaattaatttttcttatttttaaacatcttactgtgtcaataagcatatattttcataatgtgtaatgtatagtataaacccaattttaatgtctgcttattgttccattgagtgtgtctaacataatttatttcatagttttcttgaatttggggtgttttctattttcctcttttataaacagagcttcaaagaatgtccatgtacatacatacattaaaaattatgctcatttgcacaatatatttaagaaaaatgcctagaattagaatttttgagtcaaagaatgtgcacatttttcacttggtatatatttccaggttgtcctatgaactttgatcttcaatttggagaaatataaatttttgaaaagaagctataatctttgacccactaattgagagaatctatctcatagaaatataagtagttttgactgggtgcggtggctcacgtctgtaatcccagcactttgggacaccgaggcaggtggaacacctgaggtcaggagttcgagaccagcctggccaacattgtgaaatcctgtctctactaaaaatacaaaaaattagctggacatagtggtgggcacctgtcatcctagctacttgggaggctgaggcaggagaatcacttgaacccgggaggtggaggttgcagtgagcagagatcgtgtcactgcactccagcccgggcgacatagtgcgactcggtctcaaaaaaaaaaaaaaaagtgtttttgtataaacatatatgtaatattttgagggcttgtagcagctaatagctgaaatcagtgtgaatgaccacatataagaaaaagtttgaataaaatgtggatcattcatgttacataatattatgtagcccttggtttagatctgttaactcatggtaatgcccatgatactaagtgagaaataccagttgcaaagtaatatggatagtatggttctttttttgtaaaaacaaaacacacacacacacacacacacacacacacacacacacagacagaataatactttatatatgtttatgatttgtttgaatgtacaggaagctgtgaaaggatacactcaagttcttaaaactgtatcttagtgtgtgcatgtatatcttaggattgtttcacgttttacaatgaaaaaaagttttgcttttgtaagaaaaagtaaataaggaagacaaagaaaaaatcagggccttaacaaaccactctgacttttctgcagccttaacaaaccactctgacttttctgcaaactgtgctttcaaactagacagcttcctgtagttctcggaggaatttcagggctttaaagagtgtgtcctgaagtcaggatcacttttatagttagcttaattggtatattattttacacaagataacagctaaactgttgcgatttctcaagtcattgatgttctcagaggtaatcatcctcagaaaggctgctgaaaatatggtcagcttacatcctggtctggttcatgtcaaacaaccaatttttttagaagaggaaatagaggatgaaatagcaaaaatgtttcaatttaagaaattgttttcagaaataatctatacttttctattgataagaggaaggaacaatttttgttacagctaaaaatatagaataaaataaggtgacaacaataggttgtagctaaatgcatgcttttattaactcactagatgtatgctgtgattttgattaaaattttgtctttctgaaggagagaagtaaatattaaaaaggaaaaaccttggtatgtcttagaaaattttaagcctagtagcactatgtaaaatcattttaaaatgagaaagtttagaaacttggagaacaaaagtgaaataaaaactttatttggaaaagtaaaattggttattgctcatggaaaaaatcttgatcattcaatgtctgtgaacagagatgttgacacagtgaattaaatatggcaggtgaccattcataaatgtgtaccaatgatatattgaaaatatctagtgaaagaagttcctggaatactgtatttatacttgattagccagtaatacttgcgttaaatgataaatgctagtcataaatgctgatgaatgaataagtttgtcaagcatgatcagatcagggatctgaaaaccctgtatgttaatattatttttaatataggtagataatggatacacatatgaacagttttatcaaaggatatactgaaattgttctattcctgtgcgagcctcagaattcaaaatcaaactataattttgacatagatcataaataagtgataataagttaatgaataaggcagattttattttatgtttgctaaaactttatcatcaaaacagtttaaagcattgtattcaatgtcaatgaaattaaatactaaaatagaaacaaaagtttccatgggggtcattggtgactactgtatatttcagtgtataattgcatatgcaactccattgctccctgttggtgaggtcagtgtgagtgccatatcactctgaagcaaacttatatgtcttctcagtgcaggcctcaaagtagtatgcaaatatattttgctattggatgagattaagtgtatcaatgcgtatagctaaccagtagaggtacaagttgtgcctcctcctaattctgggtctaatgagggctatgtcatctccatagtttgattctaaaccatcctactgtgcctgcttgctgtatttttggagagccccaactcctttctacgtatttcatcaatgtacattgtatcagcatgcatagtttgaaacactaatttattcaagtttatctaattcaactaactgttaatttgtttctgctgcctttggagtaatctatctccaggccttcctgtgttatcttgaataattgagagtgtactcgtagaaagagccacattgctgcagaaggtgctgctaagcctccaagaggttcccttcacttgagcaagattgaaagtgattccagctggctagaaaaaaattacatgaaggctgtaatagacctttaggaaggaaatctgtttctaccaagacagaagaataattcatttgtaaggaatataaattaaagctttcttcaagtcattggagtgtctctaatatttttcaggtagcatttttcatacttccctatttcatcaacttttagtacaaaattttccaagctttagttttctcatttataaaataaagtaataatgcctgtcctcaattctacgaatttatgaagatcaaataggaggatgtaaaggctcctataaattataaatttacccactatcgtaaggcattgttttctttatcagggtggcttttgcttttttattacttttcataactacttgcactatatactgttatttgaatacaataacataaaaccaaccatgttacatggttacataacttttttaaaaaaatttctttctaacttcaatttttattccttttttttttcctgtgcagaaagaaaaatcagcctgtcagctactcatgtctaatttcaaaattatcttgcagaattaagcagttaagactttgtagaaatttggggagtataaggaattgcagatgaatgccagctcctcctgggcatactgttgttcttaatgtaaaagtccggttttgcccagcatcaattaatggtgccttggaactgggtgcaggggtccctaaagatctcctgcaggctgagacagtctcccttgagccattttccacagagccagagtggtgtgacctcttgctgctgcagtatttcaaagtgattgtatttcactgctctcataaacacatcttgtaaaagaaacaaggttgtcttttaaactgtgctcttgcttgacaggaaaaataaaacccagtctactttcaggaccttatggcctaataagaagtcaacccttttcatttttgttaagaatagttttgtatcaacttgccattcttcatgtaaaagtataatttattatgaaagaagagaatctggatgataaataggacttttatgttcttgttacctgtgattcagaaaattctaactcacagagctggttgaatagagaattctaaaaccgacaacaaggagatgcttgttaaatctactttttaatgcttgtttattttattatacacatgacatgtactattcactgttcatcttatgtatatgggaacttgcaatttttggtctattatacatgcctatatattttatgtttggtgctatcaggaacatagatattattaaacaaggctaggatttattttactttactttatatttgtaggttattatgcagtccaaagattacagagatgaagggaaattagaccaattattttcatatgatatttagagaaaagcatttgtgcattcctttgtgtcagtaagcataagaactctctgtcacccaggctggagtgcagtgaatacaaagaaaatgtaagatattttactaatactttttatattgattatgtgttgacatgataatattttagatatatttgattaggtaaaataggaaattaaaatcaatttcactcttgaaagactttaagtccgggcgtggaagctcatgcctgtaatcccaacactttgggaggccaaggccagcggatcacctaaggttgggagtttgagaccagcctgaccaaaatggagaaaccccatctctactaaatctacaaaattatccaggtgtggtggtgcatgcctgtaatcccagctactcaggaggctgaggcaggagaatcgcttgaacccaggaggtggaggttgcggtgagctgagatggccccattgcactccagtctgggcaacaagagtgaaactcttgtctcaaaaaaaaaaaaaaaaaaaaaaggccaggcacagtggctcatgcctgtaatcccagcactttgggagggcgaggtgggcagaccatcctggctaacacagtgaaaccccatctctactaaaaatacaaaaaattagctgggcgtggtggcaagcgcctgtagtcccagctactcaggaggctgaggcaggagaatggcgtgaacccaggaggcggagcttgcagtgagcccagatcgagccactgcactccagcctgggagacagagcaagactccgtctcaaaaaaaacaaacaaactaaaaaacaacaacaacaacaaagactttaaaaatgtacttactaaaaaatttaaaattatgtgtgaagcttgcattatattcctcttgcacagtacttctctaagcagtcttggcatagaaatattatggaaggccaaggcgggcggatcacctgaggtcaggagttcaagatcatcctggccgacatggtgaaaccacgtctctactaaaaatacaaacattagccaggcttggtggcaggcacctgtaatcccagctactcaggaggctgaggcaggaaaatcgcttgaacccgggaggtggaagttgcagtgagccaagatcacaccattgcactccagctttggggacaagagtgaaacttcatctcaaaaaaaaaaaaaaaaagaaatattatgtttatatcctttatccttctttaccaaattacctcactttaccccatattttgaggacagtttaaagaggtctgcacgttctgcaagcactactttctgttgtctcacatcaaaaatttcattagaagtacctgaagagtttgctcttctctaagaggtttcatctataaaaagttgattttaaattcactttaggtcaatgagcataaatgttgtggagtttagctgtgcatgtatggaaaggaggctttcttccttgggcaagggcaccttctggtggtatatactgaacatagcagcttattcgatgatcagatgtagactttaagattctggaattggcaaaaaaattcatttcaggtgtttggaggaaaaaaactaagattaacgataaagatgttcatttctctgcagcatcttttataattgaagctcatctcagttctgggacttatttttcttagttacacaaggctaaggttgagacaatataataagagcattctgatttggagtgctttttaaaattgcaaagttcttatttgagtttttgggttatttttcccaaaagtttccaatggtggtttttgtatccattataaaaaggagaagagttctatatttttgttctttataatgtaaaacttgaggatgtttaggttatttagtatatacaagtaagcttcattagataaatgaggaagaagaggtataataaataagccctattacattttctcaagaagtgattttagttattttggagacatgcatttaaaaagagaaacattgttgaaaggctcaggatcatgtatttcttgtctttttctgtttcttcttgatgtattatagtacatatgattattcaagtcatatctcttcatcaccgcatttcatatacaaagcctgccaaaaataactatgaaatagctgagatcttaaatactgagaacaaaatagatttctcataatttggaattacattaaccagaaacagtaagacagttaaaatatgagccaacatccagctatcagctaaataaagatttccaaaaccacttattgcctttcaggctgatgtaagaatagttatgagtggttataagggaatgaatcagttggatttccttttaatgtagagaccctggcagcccatttctaaaattgtgctttagttatgcatattaccttctttggaacctagtaaaaatgtgaaaaacgttcagatgatgaaaacataacacaaataccattctttctttgtatgaaagacaaaaaaaaaaacaaaaaacaaaaaaaaaccccaaacaaggatctagccaagcaactctattctaagggaggaaatatagtaagagtggcctgtagccaggcatagtggctcatgcctataatctcaacactttgggaggctgaggtcagaggattgcttgagcccaagagtatgagaccagccttggcaacatggcaaaaccctgactctacaagaaatacaaaaattagctgggcgtgatggctcacgcctgtagtccagctactcaggaagctgaggtgagaggctctcttgggcacagaaggtcaaggctgcagtgagccatgatcacaccactgcactccagcctgggcaacagagtgataccatctcaaaaaaaaaaaaaaaagaaagaaagaaagattgtattactctattagtgaaaggagccaaaatttacccatattgacagcagagagctgaaatgactattttacttgtatgaaaatattgtctttgcttattaattaaaatgctttcatgagttgatatgtggtaatatacttttagatcagtatatgaaatagtatatattattatattgtattatttattaggtaaatctcaatggaataaaaaaattcattcaaactcattttcccaaaaaggctatttttagatttatagtatttgttttagtgataacttctgttcagttctctctagcatttccagaaatctatgcttgtttcatggcctccagtaaaggcttctgttgatgagggggttttgatcccatgtctgtccaaaaaagacaattggcttttcttggtagggaaggattcatttaagtggaatcttccaagcaactgtctctaccatcttccatattcttgctccactcttactgttttgtttgcctgtcgtggagtcctaattagggaaaaagtctcaggctggtgggaacaggggaaagccaaaagaaaaagcagataagctaagtctgcctttcttcctggtccaggacatgtagccctcctgcacaaataactcacaatcttcctgcattcaacttaccaccagaccctacaagttagcacactgcattcttggcattatcagtactgcacaaagctctcttcagcacacagcacaagcaccatcctataaaatccccagcaagcctttgtctccttgcagtcagctccactcttgctgacttgcccatggcacgctcgcaacgtattttcatactttctgctttctctaataaatctgcttttctttacttactaatgtcttggtaaattattctaactgcctgcgcaatacaggccccagatagtcgctacccgagacacctatcccatcccatttatgaaagtgaggcagcaagccaataaacacttcatggattcgtagcaatcacagtctcttgagagcaggatgtccacctgacctcttttggtgtgaacaattcagctttgtgtgtattggtcctagtcagggcgggctgtgtaaggacactgttttgagatcagcatgccctgtgcctgtgtaggcttgttgtcaacatgtgagtgcttcaaagagaatagagtacagcttccctcctgacttgttctcttgctttcatagagatttaagggcctcccctattttctttttcttttcttttctttttttttttgatatccagatacagtttattttcatgagaaagaactttttttaaaaaaacaaatgtgaattcattgtaaaacattagggaaacgcagccaagagggaaaaaaagaacagtatctataatttaccattttgagatgactactgttaatacttttgggagttttctttttaggcataaatatatactttattttttttttaataaagaagatttattactttttggctttttggctaagaccaagtgtaaataaaaaagctttaaccttagcgtgtgagacaaatatgtatacaataaatttcaccataatatggtagaagcagtaatacagatatgcacaggaagctctcagaatacagaagacagacatttagttcaaccagaggtaaccagtgaaggcttcctggagatggttacacaagagattaatttgaaagaataggtagaagttagctaagtacggacaagagaataagcattccaggtatgagacattttactatgaaacagtatgttgagcacagataattacaactaatgaggtatttctagaatattgagcataagttgggatagagataaaggcagtcagcatgacatgggggaaccttgtgtatcatattatatatcccatatgctatagagaggcattaaaagatcttaagcagtagagtaataatttagatagatggtatagatcactttggcagcagaaagaaggattaatggtggaaaatcctggagacaagattacaagaaaacatctaaggaggtaaagagagaggagaacagggactaaggaatataagggacatatagagggcggtgtacctgcaaagaagaggaagaagaattgctagagatggaggaaatatctaagagagtatggtgtcataggcatcaagacaagagagtatttcaacaacaacaacaacaaaatggtcaagtagggaaggactgggatgtttcacttagatttgtatgtagatcacttaagattttataaaagatatttcagtggagtggggatagaagtcagattgcagttggttcaggagtaaatagtacttaggcaaattcaaacagcttgcatagcttaaaaaattgggctttgaaggtgaggaaagagacagcaataatttgagggggacataggtttgagaaatgttttttttctggcgaggtagccatttcttttttttaacttttaagttcaggggtacatgtgcaggatgtgcaggtttgctacataggtaaatgtgtgtcaagggggtttattgtacacgttatttcattagtcaggtattaagcctagtacccattaattatttttcgtgatcctttctgtcctcccaccctccatccccagaaaggccccagtgtgaattgttccgctctatgtgtccgtgggcctcacctattttctctttttttggagacagagtctctctctcttgtctagactggtgtgctgtggcgtgatctcggttcactgcaacttctgcctcctgggttcaagcaattctcatgcctcagcctctggagtagctgggactacaggcacatgccacgacaaccagctaatttttatatgtttctgtagagatggggttttaccatgttggtgaggctggtctcgagctcctgacctcaagtgacccgccctcctaggcctcccaaactgctgggattacaggtgtgtgccaccgtgcctggcctgggcctcacttattttcagtgaggggttgggtggctgcacctgctgtcatttttacctaaagcaagaagcagaagtactgcctgggacaaagctagaatccagtgctcaggaagtttcctaggataaaatgttattgagaatcttataaatagctattccctggggagagtaatgattaatgccagttaaaagtgaagaaggtacttctcttcctgctgttttgtgcaatgtacacaaaactgagtaaaacaaattattgtaggttgttgaaatagcatcatgaaaaattaaacagttggaagacaactattgtggcatatataggggcttttacaagaaactaaactaaggatgttctttaaaatgtggaactggagtctacttagggtttagtctggtttgtgaccatgcccttcagccagtgcagacatttgatctcaggacaggtgcccctgctgcagaagaccgccagcaccctgactccaacagctctgatgcatctcactgccaaggcctggatggaaaaaaattcagcagaagttacacttatgacggcagaaagttcagcagaagttgtacttatttaggatcagatagagggctggggtagcttcaatagccagacaaggaccaatctactcaagaacaacagtgatgagaagacagattttatggactgggtgtggaaggaaaggggctgtggctgtaagagtaaattatgtggctgcaggtgagaccatttgtttgtttcatagtgaggatcaaaatagcagttacagatcccttctttctgtgctatgctgtggaagctaagatggctctatgtgtttttgtatagctggtgtgccaaagttagcctctatttggggcaaatctgtagaagagaagtaaagcaaaagagattctatagtataatacaaaagtctaggtgcagaaaaactaagttcagatgttggttgtgccacttactagatgtgtaaccttaaataatttactttctccgaacatcaccagtttcatatctgagagataggcataatacctacctcacagtattgtttcaaggattaaagaaaatacaaaatgccaaaccctccacattgtacttcatatattctaaaggctcagtaaagactaatttactattctgtatgtgattctatgtagtatgaataatcctttcccatatcttattgatcagatatgccatccattagccatacaactattttataattatgtgctctttgttagtaggggtttgcatcatcagtgcgaatgaattgcttatggaaaagcaattgtgaactcatgccccatggataatgaatggagagaagttaggggatatttattgagcccttattgtgtacttttgtgcacattagttttcttttttttttttttttttttttgagatggagtcttgctctatcacccaggctggagtgcagtggcatgatctcggctcactgcaagctccgcctctcgggttcacgccattctcctgcctcagcctcccgagtagctgggactacaggtgcctgccaccacacctggctaatttttttgtatttttagtagagacggggtttcaccacgttagccaggatggtctcgatctcctgacctcgtgatccgcccacctcggcctcccaaagtgctgggattacaggtgtgagccaccatgccttgccacattagttaattattacaacaacttaatgagatagatactattacaatttttttaaatcatgaagaaactgaggatcagagattaagttgcccaaggtaatgttgatcagcggtccccaacctttttggcaccggggtgggttttgtggaagacagttttttcagtgaccagggttaggggagcaggagatggttgcaggatgaaacttgcactttagatcctcaggcgttggattcttttttttttttttgagatggagttttgctcttgtcacccaagctggagtgcaatggcatgatcttggctcactgcaacctccgcctcccgggtacaagcaattctcctgcctcagcctcatgagtagctgggattacaggcgtctgccaccatgcctggctaatttttgtatttttagtaaagacggggtttcaccatgttggccaggcaggtcttgaactcctgacctcaagttatccacctgctttggcctcccaaagtgctgggattataggtgtgagccaccgagcctggcctggattcttaaaaggagcacacaacctagatccctcgcatgtgcagttcacaatagggttcacactcttatgagaatctaatgctgccactgatctgacaggaggtggagcccaggcagtaatgcttgctctccagccactcatctgctgcgcagtccagttcctaacaggccatggacctgtaccagtctgcgacccagaggttggggaccccaatgtagataataaatggtgtggttgaaatagttttgtttgaaagtaggatttatctttttttttactttctaatgtcgcatttacttataaataagagaactgttgagggacagactataaccactttgctgaaactatgaaaaaagcaagacatagattttgtttatatttaattcttaaaacaatgggtgattcttgcatctttcttgcaggttcattgggtagcagtctctgagaaggaggtgcaggaagttcaatggggagtggtcttgggaagggaagaaggcagagcaggataagacagaggcaccagttcggttgcaatatagtcacaacagggtccctatgagcaccacacagggagctctgaaactagaatagtccttcagagtaggcctgagtgggatgagagcttgggcttttatacagttgagagttgagatcagtcagctgacaatcttcccagcagcttggaaaatcagtcatttggtcttaaaaggggtatttgggaagtgccacccagtattcatgacatgttctataatatgtaactcataaaaaggagagaagtgacatttaatgtaggaatatagatttatttttagtgttctctttttgaagcagttataaaataaatagaaatttaatttttggtattttcctttcaaatgttaacaattctttttgcaacttctgggttaggttgacatcgtactttggtctggactgtaagaccgttagtgaaaatctgtcaataaatctcaccccatgcagtgtaaaagtaccttttctctcttcattcaaatgagaatcgtttagatgtcctgtcattctagatgggttttgaagacaaaagtagcatctttctttttcatcagattttagggctagagaaagaatttatccaagggatattttctcttcttttttgtttttttttgtttttgtttttgagacggagttttgctcgtcacccaggctggagtgtagtggtgcaatctcggctcactgcaacctccgcctcctgggttcaagggattctcctgtctcagcctcccgagtaactgggattacaggcatccgccaccacacccggctagtttttgtattttcagtagagacggggtttcaccatcttggccaggctggtcttgaactcctgacctcgtgatccaccagcctcagcctcccaaagtgctgggattacaggtgtgagccactgcgcccagccccaagggatattttcttatgaatacttttaaagaagacattgatttgtctcagttcacttagatgtcatgttatatatattctaaaagtattttaaaaattcatctgacttttttttttctaaagaggaaatctcggcagaaaaacagtacttatttttgttactttcttattgattcctaatgatttccccagaggtggtcatgcatgtggagggccatcctcctccacacccactagcttcttactttactgacagatatgatacaatcatctttgatgtgtctcaattctattcctccacatttcaggatttatctacttttaaaataatggcccttccttttcccttaccatttgacgagtatttgttgagtgcataccatgtgttaggtattcttcaaggtgcatggaatatgccagtgaacaaaacacacagaagtacctgtcctcattgagcttacagtcttaacttttccagattctgtttctgttcttaaggcatcttctaacatttcttttgggaaatacctcttgaatttttttttttttttttttttttgagatggagtctcaccctgtcacccaggctggagtgcagtggcgtgatctcagctcactgcaagctccgcctcccaggttcatgccattctcctgcctcagcctccccagtagctgggactacaggcacccaccaccatgcccggctaattttttttagtagagacagggtttcaccatgtcagtcaggatggtctcgatcccctgacctcatgatccacccgccttggcctcccaaagtgctgggattacaggcatgagccactgcgcccagccagaaatacctcttgaatttttaagctttctaactgctttctagaaaacactcatatcctcttattttatataattttctccttatcaggctaccctaaaactaccatactcatatttttttcctctattgttttaaagtagtctgcacttactctcagcttccttagttctctattattccttaacctcttgtgatccaatgtctttcattagaagtttgcaaaactgtcccgtggaaaatatactttaaaaaaatccattttttttgcctccactgctacactgtcaatatctctctcttggaccattgcaatagcctttttccaaactggcctctttgtcaataattagtcatcaaatctaccttataagctgctgtcaaaatactcctggtatcaggaggtcaagactacccctagttttaatgactcatgaggagaattcacaggcctcagcatatattaggactcatggctgggatttattatggagaaagaatctaaaagaaagtcaactaagggaaaaggtgcgtggggcaaaatcctggggaaattaggcacaaacttccagaattgtttcccagtgaaggcacacaagacacacttaattccctcagcaagggattgtgacaacacataggaaatgttgccaaccaggaaaacttgttagagactcattggccagggttcttattgggtgctggtcttgtgggcaccctctgcttggcatgttaccaaattccaggctcccagaaggaaagcaggtgttcagggtaagccatatcgtttatataaacattttaggcataatgaaccaggcttttaaattatggaatgataggaaccttccccaaatccaagttcccagatgccagccaagggccaactttgcaagcaggcttttctaaggacagcaatttaggcctgctatgttaactattttctgtacactcttcctaaagtgtagctctaatctaacttccttctttccttctggaaattccagagatatttattggaaatctgcaatgtatcagccactattttagatactggggctacagtgataaacaaaatagataaaatcctgtcatgttttgatctataagagaagatagactataaagagataaatgaaaaatgaatagtaaatgtcagatggtagtcaagattatgaaataaagcagtttaaggggaaaagaacaagggatggggtaggcactattttagataaggtcatcagggaggcttgtctgaaaaggtgagattttatcatagacttaagggaatgtctaggcagaaggaatagcaagtgaaaagcccagaggtgaaatgagctggatatgatgttccagaaacagcaagaaggacagcgtagctggagtgcagtgtggaaggtagagcatggaaggagatgaatttggtaaaataggcaacaaacagattatgttggctcttttaggaagccacgataaggagtttggattttattctaagtataatgtaaaattctcaaagcattttgaacaggaagggacatgacctaatttatatttttaattgattatattagttgctgtgtcaaaaacgaactgtaagagaacaagaatggaagcacagagacaaatcaaatgcttttctagaagtcttaagacatcatggaggcttggactagggtgagagcagtgaagaggcgaggatattatgacactttagtgcttaaaaacttaaatcactcagttggctacagtatgtagttcagataccttcaaggcattttttgaaaccaagtttcagtcttgcacttattcccactaaaaatttctcaaaattctgcctttttcagtgcatatttaaatcaacctaaatctctgtccattacttagatattctagactttcttacctccatgattcattatatactcaattctctttgtgaaaaatcacaatctcctttagccattttttccatccaaatgttacctgttcttcaaaaccaccttttcatgaacctttccctattctctactttgaaattaatttttcttctgttatcccatatatttcacttatctattactgcctaaaaccctaacccagacttactggtttagaatatcaattttaccttgcttgtgattttgtgggttagaaatacatgaaggactcgggtgcgtgactcatcagctgaagtagctgggactagaggatcaattttcaagaaggcttattcactcacaagtttggcacctcagtgcttcttggcctttctccacctctgcatggtacctcatccttctgagctttggcttttctcagcatgacaacttcttaaagccatcaggagaccaagatggaagctgccattcctcttaaaggccaggtctggaactgacataccaatacttccatggtactgtattggtcactgaaatcacaggccagctcagattcaagagtggaaagaaagtctctgctcattgccaagagcatggcatggacatacagggagagaagaaattaatggcagccaccttggggacagctaccaaagcatactcccttactcacatttccattttcaaggtgttggttggtattaaatgtattttcacagatgtctcatcttccttattaaattgtaaattctttgagggagagaatggtggctggttcatttttgcatccctagtgtcacattacagattttctttttctttcttttttttaaaatttaacttttaagtttgggggtacatatgcaggatgtgcatgtttgttacataggtaaacatgtgtcatgggggttggttgtacagattatttcatcacccaggtattaagcctggaacgtactagttatagttcctccttctctccctcccaccctccaccctccaataggccccagtgtatactgctaccctctgtgtaagtctgtgtgttctcatcatttagctcccacctagaattcgtggtatttggttttctgttcctgcattagtttgctaaggataatggcccccagctctattcatgtccctgcaaaggacttgatctcattctttttgtggctgcatagtattccatggtgtgtatgtacattttctttatcccgtctgtcattgatggacattctggttgattccacatctttgctgttgacatcacagattttcaatgccctttttttttaaatagaatttatgtggcaatattcttagaaaatatatacagaaataaaaactaactcagttgaacacataattattgcatatgtactaagttcaatgggtttattaattgtgaggattgaacattttgctttttttaacttttattttaagttcagggctataagtggagatttgttacataagtaaacttgtgtcatgggggtttgttgtgcagattatttcatcacccattattaagcctagtatccattagttatttttcctgattctcttcctcctcccactctccactctccaaaagaccttagtgtggtgggctgttcctttttatgtgtcgatgtgttctcatcctttagctcctgcttgtcaataacaacatgaggtgtttggttttgtgttcctgtgtaagtttgctaaggataatggccttcatctctatccatgtctttgcaaaggacatgatcttgttcttttttatggctgcatagtgttctgtggtgtatatgtgccacattttctttatccagtctatcactgacgcgcatttaggttgattctgtggctttgctattgtgaatagtgcagcaatgaacatatgcgtgcatgtgtcttgttatatttgaatagttttacagtttataaatgaattaaagccattatacatttactgggcaaagttctgtgatgggtgctgtggggaatacaaaggtgaatgacaccatcttcaatacaacattatttaattcacatatcaaaacaactgtctgaagtggtggagaaaatttgccagtctcatgttatacatgagaaatggtcaaggaaacttttatcagatctggtgctacaatttagtctctttgtttccagggcagtgatattccgtacaccatgctaaaggtccatgctaatgctaatgctaatgcttagtttatgttaaggcccttcataatatgtccttaaacttacccttccttttatgtctcaatagtcttcaagtactgaatattgttattttctaaacaggctcaaaacattctcataattttgctgatgaaggctgtaagactcagcaaatctgcaatttcattttctcctgcctgctttattctagccacactggcagctggttagatgggatggtgcccattcagattgagggtgggtctgcctttcccagtcctctgactcaaatgtcagtctcctttggcagcacccttaaagacacacccaagaacaatactttgcatccttcaatccaaccaagttgacacatagtattgaccatcacaatatttaataataaaatactaacattaattgagctcctaccttgcagcaatagtgtatgaggcactggagatataaaggttcgtgggaaatattccttaccctcaggaggttctcagactatcagtggagacagtgtcttctagattgtgccttctccttcccaatctccctgtttccatctcttattaaaatcttagtcatttttcagagctcagcaaaaatatcacctcttctataaagtcatttgtgtttcctctagtcatctgatcacttttatatggcagttacattgttcatagtttgttgttatgtggttgtcctcaacttgctttgtctcctactctgctgacatttgggaagacgcaacatttgagttcagtctatagcaccttgtacagggtaggcaaccccatgtttttgaacattggattcattgtaacagtcacttctaggttgcctgaaataaacacatttttttttttgtggtccacacttcctatacatgcttttgacattttttctcaggccatggcctttgctggaggctttgttggccatggttatagcatgtgactcctccctcactacagttgactggataggaatgtgcacataatccaaggctggtgaactcaattgctgacccacagcttatcattttatcatattttctaatcagtttgcattaatatgaggaggtttcagtttatggtgggtgtttgccctataatttaatatatttttgtgtcaggcaaccgtattggtctgtgtgcaagaagaggaagctgctcaagagaacaaatagagaagatgagattcatcatataaacttcgagagaatgactagacctagttgcctgagtcaagtgcctataagacaactttttctttctctgtgagattgcctctctgattattaagtaaattctccctcacttgaactatattgagtgttcttttgcaaccccaaatgctttgaataaaacattgccacattcagtcttctcagtctacattttcctcagtctctcaccatattcttaaacttctgccgagagctgctttcttgaaatgtttccttggacttttgtggtactgaattatttcaattcttttcttacctatcagttccatctatactttccttttgtaaccattctttttttttttttttttgagacagagtctcacattgtcacctgggctggggtacaatggcatgatcttggctcactgcaacttccgcctcctgggttcaagtgattctcctgcctcagtctcctgagtagctgggactacaggcatgcaccaccatggcccagctaatttttgtatttttagtagagatggggtttcaccatgttggccaggatggtgtctccatctcttgaactcgtgatccgcccgcctcagcctcccaaagtgttggaattataggcgtgagccaccgcgcctggacttttctttttttagagacagagtcttgctctgtttcccaggctggagtgcagtggcatgttattggctcactgttgcctctgcctcctgggttcaagccattctcctgcctcagcctcctgggtagctggaccacaggcgcgtgccaccatgcccagctaatttttgtattttttttttgcagaggtgaggtgtcaccatgttggccaggctggtctcaaactcctgacctcaagtgatccactccagctttggccttccaaaatgctgggattacaggcatgagccattgtgcctggcctttgccttcattttctttgtccatgctttttctctcatgacccttgtctaattcccatggcgtcggctgtcaaggctatgaatgtgactaatatactgcacacacatgcacatgcgcacacacacacacacgcacgcacacacacacacacacacacaccgatttccttcagttttagcttctctcctaatttctgctctttacttattggcatctgaaacttaacagctcaaaacagaattcctcatctttccctccagatgagtttgtagatttgggatgatgtttgaagtacttcttcactcttaatcctatgaatctgagttcttgtgactttatttcctgttaatggtgtaatttttctcttagtaatctagctagacatatgaatgcccttttaggtattttagtgtcaagctggactttcaggatatattgtgattaatatatattattaataatatatattaattaataatatattaataattaataatacacttcaggacatattgtgattaataatgattaatagaccctttctattaagaataggttaataatagaccctacttgaacctcacatttctagatctattctagatctggctgtgggatgggaggctgttttcatctcatctgtaatccactttagatatctaggatacaggaaaaaagtgccttcagtgttccaggagtgagttaatctcattgacctattatagtgtcccctgcacagttttccatggctgagagcagcatgtgatgtcggtgttaaataacttacttcacaatgtacaacacagtagttagttgtactgtaatagggtgcttctcttacatgatactttcttgaaattcaactcctgaactgattcattagcatttgcaacagaaccggagagtctaagaagatctaccgaaagtaggattggctctgagacaaaagtggccccataagttgttgaaaaagtaaccgatctgacagacttgagaacttccagattcttacttcagccaagaaagacagcggtcattttctagctgggatggagcagctgtccgtcagtggatttctgtcgaatatatgttataggcagataaccaagtgttaaggcaagatcagaaagatcttgagaatgcagcccctgcccttgcacaagaacctttcatactgctgagaattcaatacaagtcctaatctaaccacatgaaagtagctgttttctgtagattcatattgcttgaagtctgatcctaaatatgtttaattacaaaacccaaaatatttttcttagctgcaattgaaagcagcctattagcaatgaactttgtaaggtagtgaaagttggattatctagggctccttttactgaaaatctttactgatgagtactgtttataaaccacagtgacaatttatgttgataatttgtaaaagattctgaactttcttcatcgttaaaaatataaacttatttttagtatgtggttgggggttttattgtatgtacaatgtaaaacattggtagttcatatattcatttttaagtggcaataataaccagcctcctatcatgatcattctgaagaaacagtagtttgccatattgtgaattctgcatattggagtcctggggagttgtgctttgtttcctcagtaagccacttcaattaacagaagatctttgaaattcatttcaggtgtgtttccctaaatttttatttttttcaaatgagaatgtacacaagttactaacttttagcaattataaaaaagactactatttattgagcacctgcccaatacccaccacagtgcaaagtactttacatacattctctttaattgtcctcttttgaactggcaggatctttagtcctaagtagtgtattagaaagaagatgagctttggaagcagacagagctggatttgccactacctagatatgtgaccttgtgcttttcttctctctgaagaggtttataataaagatttatatatattcattttattctcatgtgtattactatgaagtgggacaaaattggtaagcattcagtgagtgttcacaccatccatgatcatttcctgctaatggtttataattgaaggtggtttataatcgaaggtaagttttaaagtttggagcccactcacaactcatttctcagcttattctcaaatctgatcctccaaactacagtaaaaatctactggtgggattagaccgctggagtttgctgcagcatattgtatttaaatagggtccttgcatatagggttttttggtttatttgcttgctaacttttgccttaacatctgctttagagatctgctgggacagtgttctgaggatgggggcagtcattacccagaggtagtttaggaagttacagcagcgaccactgctttttggaaaattacccattaatttattaaggaattaaaaagaaatcaattagatttttctttattatacttgaagaaactctcatgcccttaaattatcttacattctcggctgggcacggtggctcacacctgtaatcccagcattttgggaggccgaggcgggtggatcacaaggtcaggagttcgagatcagcctggccaatatggtgaaactctgtctctactaaaaatacaaaaattggccaggtgtggttgcacatgcctgtaatcccagctacttgggaggctgaggaaggagaatcgcttgaaccaaggagatggagtttgcagtgagctgagatcgcgccactgtactccagcctgggcgacagagtgagactttgtctcaaaaaaaaaaaaaattattttacattctcttcaattctttctttttgggggaggggttatttaaagagcaatgcatgttaagtatagaacatttggaaactacagaacagagagagagagaggaaggaagaaaagaaaagaagaggaagaacaatgaaaaaggaaaagaaaattaaaatcacctactattcgaagactcttgactaaccagagcacaatttattttctggatttccctgatttcattaagtattatagcccatcatatagatagttgtactgtgatttattgaatcaaccttcattgcttacttaggttgtttctatttttcttttgatataaatgaaacatttttgtatataaatctttgaataaatgtctaatttttttggaaagactcctagaaagagaattattgggtcaaaatgagtcgacttttaagaaagctctggaaacaaattgtgcaaaggctttctgaaaagaatgaaacaagttatgtttctgctagtagcatatgagagttatttttctccagatgctttctttttcaacaatagatcattcatttgccccgttttttgtttgtttgtttttggttttttttgtttttgagacggagtcttgctctgttgcccaggctggagtgcagtagcgtaatctcggctcactgcaacctccgcctcctgggttcaagccattcttctgcctcagcctcctgagtagctgggattataggcatgtgccaccaagcccagctaatttttgtgtttttagtaagagacggggtttcactatgttgtccaggctggtcttgaactcctgacctcaagtgatccaccatctcagcctcccaaattgctgggattacaggcgtgagccatcacacctggctggtgctgtttaacttatttacatgtgtcattttcctcaacaagaaaattataaagtgaaactgctagtgtacacaatagagcagagcatcacagcgctactaaccaactttttaggattacgaagaatagatgaagcacctgaaggcatttttaaggtctctatttcaaaaagaaaggaagtaaaatatatgtattccatgaaattatgaatctgtttgcctaatgtttttttcaagagcctgggagagaatgggatttagtattcagtaaatattgtaccatttcttataacaatatacaaaatttacattttgtggtctattctgtggtgataatggtggcatattacatagagaaaatgataatgttaacattttatggatttgggaagacatttgcttactcaacctacataaattttataggtttataaatctgtgaaaatacgctgtttgatcaattgtgcattctgttagtgaatttacaactggttgtcttatattgcaaagcagagtcacacctgacggtgttaactggaacagaagtgatctagggaacctggaagttggaactagacatgtccttgagtgagggaggctggagatgggttgggaccaaggcataactatagacactgggggaaagattatttcaggaagatactttatggtatccagagagctgacataatggttttatcagaacaaaggcccaggcacagaaggaaatgagcaagggacccagttaccacatctagaggatcagctgggacttgatttcaggaaaacaagacagaagcctgttgttagaactttgccaaagagtcagttttcagaattgaactaatagcaaggttgacttgatatctagtgctctacattgagctaaagttcccttctcgtgaggatgctgttggtccaaagcctgagataagattgaacatccaggaaagcttaagtggcttccactgtggggagacaagggataggggtaggagggtattggaaccagacagaccatggtagtatcacccaaaggtgactattaatgttttagaagtaagagggatacatgatgacccagaggagccagtcctagattcagtgctatttaacacttccatttaatggatagattagagaacaagccattagttactcaaatggcatcaagtaaaaatagttacttgcatattagtaaataagatttcagcataatcttaaaaaactggataactgattaaaacccaagagtagcttaacaaggacaaaagcacaacagtacctaaatagaaaaaaaaaatgctgcaagtaaattatttttcctaaaattatagatcaaaaaatggaagacctttattttctggttgaccttttctggaaaactcatgaggtattgatggaatttttaaactgtgacattagtaactttactcttcccagttttaaagttttctgaaatttacttgattttctagagtccagttatgcttagaaaaagaataaaatattatcagacctctcttggtgctacttgatatatacttttcagaagaagtattgtatatattttttgggtacaagtcaagaaaagtggatgccatgaaattatgaaaagtataatctgatttttctagtgtgctggatgggaaaaggtcactaagcactactattcactgcttctgctggtgttttaataaaaacttttctaagaaatcgagtgttgaggatataaaatcaattgagtccaagagggacttattgaatatagaataaagaaaaatacagattaagggacattagaatgagtcatctcacataaaaaatgggatatcagtacagcagaacattttgttagaatgatttttatgtgttgcattaataatttacattcaatttcatttaaaactggttagaatatttgaaaaatatctactgaagttggcagctttctttttagataaagataaaatgaagaggcaggtgataaaggagcatttatagcctaagatgtgggtttaggggaactctgacattaaagaaaatgttaaaatgtttgatatgtctgcactttacaagagagtttctgctagtgagctctttctcttggagattattcaacccaaggaacacttgatcttgcagtgcagctcagcctgggccatttatatgcctacccatggttatctggttatctgacctcttggaacaagaatcctctcctttctaattttcctaccaccaagaatggctgagcaagtgtttaaccctgcctcaatgactcctttatgtactcaaatgccatcattctgatggcttaactttttcttccacaaaaagaaacaaagcccaattctttaactttcatcactatcatatttaatgatcatgcattcacagagtattgtgttataagtgaatgcctggtcattttgccagatggtatcatttaagaaaagaagtattttgatttttctaagatcagtttgcatgaacaacttgacatgttcacaaattaaaaagaatgatttcttaatttcctcaaaatcgttcaataaaacagattcattaaatagttcataagaagaaagtttatttccttaaaaacaaccttttaggccagacacggtggctcatgcctgtaatcccagaactttgtaggctgatgggggaggatagcttgagcccaggagttcaaggctacagtgagctatgatggtaccactgcactccagcctaggggacagagcaagatcctgtcttttaaaacaaacagacaaaatgattcctaatgatattagtgttttaaattctatttaacttttaatatctatttaaattttaatgtccccaatcctagacctttcatcaggccctttcacaaagcagtctttctcctgaggccccagccagctcttttggaacaagaattctgtcctttctaatttttctaccaccaagagtgcttgagcaagtgcttaaccctgcctcagtgactcctttgtgtactcaatagcactacattgatctgttgatcatttatcactcccgggttggtgcctggcttccatttccctggtcctaaacatttacatctgaagaagaaaaatcagttatagaactaatattctctgtacgcaagaaaacttttttacattgttataccaagcagtttagtcccttgttgttccagtttcttcactccaaaataacatttgcatcaacatttgcttatcaaacgatctgtttttggctgggcgtggtggctcacgcctgtaatcccagcactttgggaggacaaggcaggcagatcacctgaggtcgggagttcgagaccagcctaaccaacaaggagaaaccctgtctctactaaaaatacaaaattagctgggcgtggtggtgcatgcttgtaattccagctacttgggaggctgaggcaggaggattgcttgaacccaggaggcggaggttgcggtgagccaagatggtgccattgcactccaccctgggcaacaagagcaaaactcggtctcaaaaaaaaaaaaaaatgtttttgagcatgtctgtgcctgtgtatgtctcccctatcctgaagatttctagttccccttaagttatgcagagaaagcttagaaagggcagctgcagttgcaaggcatcagatgagtttcttagtacttaatctagaatacttgagtattctttctattcattctcttattcccagtatgcactcatctgcattttctaggcactcagtgggaggggtgatggacaatcttgatggggagtggggaccagaagatgatcacccttcttctcctggcagacaccgtggctgaagacattctcccattagattatattaactgttagtcaattaacttagactttatttatttttaaatatttatttatttatttgcattttcacatagactcttaaaaccataatgggtaatagcagaaagttgtctttctgggctctttgatctgcagcttgagagtgttagaaataacctaaagtgttcagattagagaaggatggagacttatttgctcatttaacttaggaaaatgatttaggcttggagcaagaacttccttttctatgaatttctggatgtggcatatctttatatttttagagaagggagcaaactcagtcctgagtctgatgacatccttattttctgtttcctccgtgttgtgatcctgtgctcccaaatcccccaaatctttctgtagcttttgcttagatcacatgaataaatatagtttaaaagtgtactgtatattctctaagaattgtcaagcacttagtatcattactgtttatttgtatgttttggttataataattctgttcattttaaccaaatatttataccagcatgctaaacatacattgtattttgctgtcaataattttctacccaactattattttctctataaaatactttttaaactcctactttattttttctattttatttctattaacacattcatacttgtgcaatacattttagatgagttcaattgttaaacaaagatggcagaatgatacctagtgctatggctcatgcctgaaattccagcactttgggaggctgaggaaggtggatctctcgaggtctggagttcgagaccagcctggccaacatggtgaaacctcatctctactaaaaatacaaaaattagctgggcatggtggtgcatgcctgtaatcccagctactcgggaggctgaggcaggaggatcacttgaacctggatgacagaggttgcagtgagctgagattgcactactgctcttcagcctgggtgagggagtgagacgctgtctcaaaaaaaaaaaaagaaagcgggggaggagccaagatggccgaataggaacagctccggtctacagctcccagcgtgagcgatgtagaagaccagtgatttctgcatttccatctgaggtaccgggttcatctcactagggagtgccagacagtgggcgcaggtcagtgggtgcacgcaccatgcacgagccaaagcagggcaagccattgcctcactcaggaagtgcaaggggtcagggagttccctttcctagtcaaagaaagtggtgacagacagcacctggaaaatcgggtcactcccactggaatactgcacttttccgacaggcttaaaaaacggcgcaccaggagattatatcctgcacctggctcggagggtcctacccccacggagtctcgctgattgctagcacagcagtctgagatcaaactgcaaggcggcagcgaggctgggggaggggcgcctgccattgcccaggcttgcttaggtaaacaaagcagctgggaagcttgaactgggtggaggccaccacagctcaaggaggcctgcctgcctctgtaggctccacctgtgggggcagggcacagacaaacaaaaagacagcagtaacctctgcagacttaaatgtccctgtctgacagctttgaagagagcagtggttctcccagcacgcagctggagatctgagaacgggcagactgccccctcaagtgggtccctgacccctgacccctgagcagcctaactgggaggcaccccccggcaggagcagactgacacctcacacggccgggtactccaacagacctgcagccgagggtcctgtctgttagaaggaaaactaacaaacagaaaggacatccacaccaaaaacccatctgtacatcaccatcattaaagaccaaaagtagataaaaccacaaagatggggaaaaaacagagcagaaaaactggaaactctaaaaagcggagcgcctctcctcctccaaaggaacgcagttcctcaccagcaacagaacaaagctggacggagaatgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacatgaagaatgcagaagcctctggagctgatgcgatcaactggaagaaagagtatcagtgatggaagatgaaatgaatgaaatgaagcaagaagggaagtttagagaaaaaagaataaaaagaaatgagcaaagcctccaagaaatatgggactatgtgaaaagaccaaatctacgtctgattggtgtacccaaaagtgacggggagaatggaaccaagttggaaaacactcctcaggatattatccaggagaacttccccaatctagcaaggcaggccaacattcagattcaggaaatacagagaacgccacaaagatacttcttcaaaagagcaacaccaagacacataattgtcagattcaccaaagttgaaatgaaggaaaaaatgtgaagggcagccagagagaaaggtcgggttaccctcaaagggaagcccatcagactaacagcggatctctcggcagaaactctacaagccagaagagagtgggggccaatattcaacattcttaaagaaaagaattttcaacccagaatttcatatccagccaaactaagcttcataagtgaaggagaaataaaatcctttacagacaagcaaatgctgagagattttgtcaccatcaggcctgccctaaaagagctcctgaaggaagcactaaacatggaaaggaacaaccaataccagccactgcaaaatcatgccaaaatgtaaagaccatcgagactaggaagaaactgcatcaactaatgagcaaaatcaccagctaacatcataatgacaggatcagattcacacataacaatattaactttaaaatgtaaatggctaaatgctccaattaaaagacacagactggcaaattggataaagagtcaagacccatcagtgtgctgtattcaggaaacccatctcacgggcagagacacacataggctcaaaataaaaggagggaggaagatctaccaagcaaatggaaaacaaaaaaaggcaggggttgcaatcctagtctctgataaaacaggctttaagccaaaaaagatcaaaacagacaaagaaggccattacttaatggtaaagggatcaattcaacaagaagagctaactatcctaaatatatatgcacccaatacaggagcacccagattcataaagcaagtcctgagtgacctacaaagagacttagactcccacacattaataatgggggactttaacaccccactgtcaacattagacagatcaacgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatagttggaagtaaagctctcctcagcaaatgtaaaagaacagaaattacaacaaactatctctcagaccatagtgcaatcaaactagaactcaggattaagaatctcactcaaagccgctcaactacatggaaactgaacaacctgctccggaatgactactgggtacataacgaaatgaaggcagaaataaagatgttctttgaaaccaacaagagcaaagacacaacataccagaatctctgggacgcattcaaagcagtgtgtagagggaaatttatagcactaaatgcccacaagagaaagcaggaaagatccaaaattgacaccctaacatcacaattaaaagaactagaaaagcaggggcaaacacattcaaaagctagcagaaggcaagaaatagctaaaatcagagcagaactgaaggaaatagagacacaaaaaacccttcaaaaaattaatgaatccaggagctggttttttgaaaggatcaacaaaattgatagaccgctagcaagactaataaagaaaaaaagaagaatcaaatagatgcaataaaaaatgataaaggagatatcaccactgctcccacagaaatgcaaactaccatcggagaatactacaaacacctctacgcaaataaactagaaaatctagaagaaatggataaattcctcgacacatacactctcccaagactaaaccaggaagaagttgaatctctgaatagaccaataacaggagctgaaattgtgtcaataatcaatagcttaccaacgaaaaagagtccaggaccagatggattcacagccaaattctatcagaggtacaaggaggaactggtaccattccttctgaaactattccaatcaatagaaaaagagggaatcctccctaactcattttatgaggccagcatcatcctgataccaaagccaggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatatgcaaatcaataaatgtaatccagcatataagcagaaccaaagccaaaaaccacatgattatctcaacagatgcagaaaaggcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagacgacatgattgtgtatctagaaaaccccgttgtctcagcccaaaatctccttcagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatattgtgaaaatggccatactgcccaaggtaatttacagattcaatgccatccccatcaagctatcaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagtatggtactggtaccaaaacagagatatagatcaatggaacagaacagagccctcagaaataacgccgcatatctacaactatctgatctttgacaaacctgacaaaaacaagcaatggggaaaggattccctatttaataaatggtgctgggaaaactggctagccatatgtagaaagctgaaactggatccctttcttacaccttatacaaaaatcaattcaagatggattaaagacttaaacattagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaagctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacacatgaaaaaatgctcaccatcactggccatcagagaaattcaaatcaaaaccacagtgagataccatttcacaccagttagaatggcaatcattaaaaagtcaggaaagaacaggtgctggagaggctgtggagaaataggaacacttttacactgttggtgggactgtaaactagttcaaccattgtggaagtcagtgtggcgattcctcagggatctagaactagaaataccatttgacccagccatcccattactgggtacatacccaaaggactataaatcatgctgctataaagacacatgcacacgtatgtttattgtggcactattcacaatagcaaagacttggaaccaacccaaatatccaacaacgatagactggattaagaaaatgtggcacatatacaccatggaatactatgcagccataaaaaaggatgagttcatgtcctttgtagggacatggatgaaattggaaatcatcagtctcactaaactatcgcaaaaacaaaaaaccaaacactgcatattctcactcataggtgggaattgaacaatgagaacacatggacacaggaaggggaacatcacgctctggggactgttgtggggtgggggaaggggacagggatagcattgggagatatacctaatgctagatgacgagttagtgggtgcagtgcaccagcatggcacatgtatacgtatgtaactaacctgcgcgttgtgcacatgtaccctaaaacttaaagtataataataataatttatatatatatatatatatatatatatatggcagaatgaaagctccatgtgggcagggatttttatctgttttgttaactcctatatccttggcacttttaagagtgcctggtacatattacacactcagtaaatatgtgtttaatgaatgaaaataatggaaatatgtcttttttttcaccttggttaatattatccttaaagtactgatgtttttattggtgcttttccatgtgattttcaattaatatatgtgtagcctttaatgcatgtaccccaagaaaattagtctaatttatagttatattcattttatccaaaaataaactacacagtttaggcatcttcctgttgtatctgtctgccatgtttttgcatgactttaaaaattggagtcctccaagaaaggcttgtcattattgagattattcataaaagctatcctaggctttgaaacattccaaaggaaaagttcaaaaaaatattttgagcatctggaactgttttgagaagtggaatactttataagcctcaaggcagtcattcttaacttcattagggctaccaatccttttgagaatttgatatctgttgaacatatggccctgtcaaatgcacataccaacatttaaacacgctacatttatttaagggatttgtaggcttctggaagctcattcatgaactgtctatgggtccttggactccaggtaggaagcctggctttaaaggcatacctatcaagctctaaatccttgaatatagctgctgcatctgcttcattcttcaccacaggaaagtgcctcatatttaataaacattgcttgaaacaatgtctagtaacaaaaaagtcatattgttttataatcatattttgaacttcttactgtatatatattcatatagattaataaagtttgtattaagtatctgtcccatcatgttatgggataaaagatcccatttacctgaaggaaagggaactaacagagagggactatttttgcctgatagagggctggggctatctgagtgacatcccagagaaactggggacagagagaggagaagcagaccatgtccaactggcattctatttaaatctaacatccaggtgttctctgagtttatgagtcgttcctgtttttgccactgtgtgacagttgcttttacagtatgcattatattgtctctagaaaatcaatacaaactggatttatgcaaggcacagaatcacacaacatgctttaataaaagaataaaggagaattttggcatattttaattattcattttgttcactttcatcatggcagaatataagatatgttttatttttaaatttatgtttacagagaatagaagtattacacgtgaccaaatattaactatatcatgtcaagtaggacaaaagttctcatgggcttttccgtttatattgatgtattttaattgacttagttctgttaatgtttttgggataccaggtataaatgcccagatgtgaaagatagaaatgctttatcctttccatatttcctctggtgcatctgagggcagacaaagtatcacaggagaagtctttggctaaattcaatcaattaaatggaaaccgtgatgctataaccccatgtataccaatgcatgggagagtcgggggacatgcagcagcttcgggaggggatgtgcttgaaggcttggtactaggaatattcatctatggggaaaaccttgagttactaaactttctctgatactgctttggttttgcttctcttccctctattactgctttcttcctttctcagacctgcaggtctgctaagaaacttagctctaatgaacccgctcctcagtcttcccctagattgtgatcacattttgttcttctttatccctgcactaagtctgatctggcaattgaatgaactaattcatttcacaaatattcgtggtgccccttctatgtgccaaacactgtgccgggaattcagtggagaacaagacagacacaggccctgccaatggagctttcagcctccagttaaatgcatgatagagaggatgggagagaaagacagtggggaacaatgggttacttttactgtccctgactgatacgtctgcatataaaagaacagtcagattggtgagatttcatggtagccgtgcctgctctttattctcctgtctttctttcattcatgaaataaatcaaattttggattgaggagctgaccaaaaagcatttgggtatgtggaaactttgagatcaaagggagaggaagctgaaaccttcagagggtagagattgatggtatttgattttgttcatagtgtagtatttattaatagttctgtaatatttggtggtataagttctggtaccccctccttcagcaaatttatattaaaactcactgtacatctgcatatcagaaagcctagtatcttcttgggattttcttctcatcttgatttacccaagaacccctgaagcttatactgtgagaggaaaatctggctgctttctttcctcatgggaaagcactgatgtttaaacagtgttactgcgatttcttctttgcttccacatggtttcagtattgagtgttagttctttccaggcatacagacatccaggttctcaaagtctaggtcttacctataccccttggagggaggcttggccacccctcagtgacatttaccaaaggcgctccacactttagacttctccttcagttaatattcccatcatgagtcattacctcttaggatccaagcattgtgccaggtggctggaaacagaggggcagaccgaagttaaccctcctctgtggatcttgggcttcctgtcttgagtctggttcatcagtcatagttcttcttgcctcaaggttattttgtttctagagcttcattaccctttcttaccacctgaccttgtccagtccacacccataactttccttaatttcaaatatcagtgcttcttatacaaactgatcttcatccccttcagtgaccaactttgcatagctaagtactcttgcttggtcacagaagggtttattgcacttagtcccaggccagtgactatctgctggctctagaattgtctaatttaaaggcctgctcaggcgagacctaggagaatagagaaggcttgtttctattattaaaaagaaagaggaagaaaaagaaaggaggggaagaaggaaagaaggagtgaagaaagaaaaagaaagaaagaaagaggaaaaaaaaatccagtggtgtttactgagtgtagtgttttcaaactagaggaggcaagggtaagggaacactttttttatttttatttttaatatgggaggctatgaccacatttcactgccactgttgcaggtattacagcttcagcacccccctcaacctcacctcccatccccactctaacaactctcttgtctgatctagcaaaaggactgctgtggccattatggtaaatagtggcagggagagggtgatggttgggcaagaaaaaagtgggggataaattcatagtcactactaacttattcttctttttccagccacattttgagccaccttcaaatccaccagaagaggggaggcatggagggagaatgttagaaggggaaatggaatggagagaggggagggattccctgttccacctctttgttcttcattgcctaatatttttcagtgacttaatgccagccatggtaacctctttattttcttcaaaatgttgtttaaattattaaactaaaacaagaacgttgtgtagaatttagaaaatgtagcaaagttcaaagaagaaaaaattctctagtaatctgtcatctagagaacaccaccattaacattttggcagttttcttatggatatatgtttataaaacatgaatttattctgtgtattcaatatttataatgattctaccccatctagattattaaatatcatgtataagcacatcttaatggttgcatgattttattactttattgtaccaccatatttagttgaacatttaggatgttcacaggatgctgcctttattttactacttatatcactctgatgtgaacgtcttagtccatagatctttgaacattgtcagaaggagaaacacaatgaagagttgttacattactgttgctggagtatgaaactgatgagtcctgatggtgttctctcttcagttactgggactaaaaaattaaatggcatctcaaagttttcctacttcatcctaggaattgaaagggctaaacataagccaggtagatatatctgatttcttgttggcgtgaagtagatctaggcttcttttctgatgttaacaatctcactgttagagcctagactcccctctctactcctcccagtggtccatccttctcccctgctacagtcagatccatgttaaggttgcagcctcctagagcataatcagattacctgaagccattagttaccttaaccatttatttacggcctccctatgcccagttttagatgtgatgagttacatgcagagatcaaatctgatttattgatatagtgatacaataatagtactatggctgggcagagtggctcatgcctataattccaacacttttggaggccatggtgggaagattgcttgaggccaggagtttaagaccagcctgggcaagatagtgagagcctcatctctacaaaaaaaaaaaaaaaaaaaaaaaggcgtgctgtggtggcacgagcctgtagtcctagctattcaagaggccaaagcaggaggatcgcttgagctcagtagtttgaggctgcaagatcttgtctctaaaaacaaagaaagaatgctaactcaccttgagtgcatgccctgtgtcagggcactttagtaagtggtttatgtaattcacaatgtaatcttcacagcaatcttatgaagtggttactattattaccctcattttacatataaccagaagcagggagaagttatgtaactgtcaccccagtgggcagtggcaaaaccaggaattaagcctcagccatctgtctcccaagccctcacctttacccattatgcatatcataaacataaacatttttagcttttagtaacatttatttttaaaagatcttgggctgcaatattggggttcataattcttacctgaattttcaaaccaattcttttatatgtgtctaattttaggattcttttaaagatttttatcaagcaaaaggcaaacatttttatgaggatttataaactcatagaaggtgggagctggagtgagtgaccttacaatccccttgtcctgtcaccctcttgcacagacttgggttatacttttttagacattggccagttgaggttgatttaggtttctatagaaggacttgatctctattccagtcacttggtctatggcattgagtcatctttactagtttgttagactgatttcctagggctattatctggtagatagggaaatccttcagtttctatttctgctccacgagaacactcttatcatcaaggacatagcctgagatggaacataactgtcagacacacacattatttgacaaaaatatagcctacagggtgctgcagactgcctgcagagtgctgtgattataactgttacaagggggacgtcattctgtcattgcctggaacagttctttttttcttttcttaatataattactgacagtacactttttgtatatgcaggctccatctggtctagtctgattaaagttgatggctatttttatgtcatcagcaatcataattttttgtttcatttttagaacatctcttgcaggggttttgaatactttttttgacttgtcttttttaacttgtcacccagttcttgccaaggttaacagcaaagtttacaaaggttaacaaccagtctcacctgagaatcaccgcctaagcaaaaggttatttcaccatgctaattcttttggatagctttgtctagctgcttagttaattaaccaattagaagctacttctgatattatttttcaagatacatgcttgcttgtctgtaggccttttctttgaatttattttccttttttaaaaaacattaatttgatgcttccttcgtacagacgcttccagtgggtcttgttagcccttagctctatgcctgcctcttgaacactgggaattatcctgcatgctactgagttccacagctgtctgccttaccaacactcaaaagcattttaatattctcaccatgcctctgaaaatactttcttcagtctcaattgaccatcacataccaaatccacttttctgtcttaattctctaatctctgtacaatttgatactgtaactgcacttgaagttttctcatttgatttccataatgaaaattatctactatatactctgcttttttggtctcctttatcggctcttctttaatttccagtttcctgcaagtattaagtgagccacataagagagctgcttccctagttcaaaaacttcggtgttgtatctccagccctgcattctttcttctccttttctcctcattgcatgcatccactctctttttaaaaattttattttattatggtaataacactggacatgaagtataccctctttaacaaatttgtaagtgtacaatacgttattgttgactctaggtatagcgttgtacagcagatgtctagggctgattcatagttgtttaactggaactttatgcccgttgattagtatttctctatttccccgtccagaaccagacaaccacccttgtactctctgttctgtgcatttgactgttgtagatacttcatataagtggaatcatgctgtctttgtcctgtgactggcttgtttcacctggcataatgtcctgaaggttcatccatgctgtctcatatggcaggacttccttctttattaaggctgaatactatatcattgtgtgtatatattccacattttctttatcaatttatcgtatcaatttctctgtctatggacatttagcttgtttatatagcttggctgttgaaactgcagtgaacatggggatgcagatatcactttgagatcctgatttcagttcttttggataaatatccagaaattcaatagctaggtcatatggtatctatttttaattttttgagaaacctccacactgacacagtggcagcaccattttttattctcatcagtagtgtgtaaggattccagtttctccacatcctttccaacactttttgttgttgttgttaattgccattctgacaagtgtgaggtgatatctcattgtggttttgattttcatgttctttcttttggtgactttattctcaagaattgactgatcagctctaaattgatgcaattcgtatttatatctctaggtccagcatcactcatgatattttcatctctctttaggacctcttcattctgttactttaatggaaatccagattcaatcttctccctgtggcacaacccatgtcaatagttaatctctgcaacctctccttttttactggctttaccatttccccagtttcctgagtttgaaacactgaagttgctctctgacctctctctccttacactcaacaggataacagctaccaaattttatagattttatctctaaaacgtctttgcactcctctctttaaaaattactttttgttggtcaggcatggtggctcacgcctataatcccagcactttgggatgccgaggcgggcggatcacgaggtcagaagatcaagaccacggtgaaaccctgtctctactaaaaatacaaaaaattagccgggcgtggtggcaggcacctgtagtccaagctactctggaggctgaggcaggagaatcacttgaacccgggaggcggaggttgcagtgagccgagatcacaccactacactccagcctgggtgacagactgagactcaaaaaaatgactttttgtcataccagttcaaacctagagggcctttttttttttttttttttttgacaggatctcactattttgcccaggctggagtggagtggcatgatcacaactcactgcagcctcaaactcctggggctcaaggagtgatccctctgcctcagcctcctgagtagctggcaccataggtgcaccaccacacctggctctaaattgctttttactgtactatttcagtagcattttaaaatccatcctttaaaatgtggattacttcctgtaaaggataattcagagagtatctcttctctgcttgacaatctagttatttgttatgctcaaaattaagtataatatcttagccagatatttgaagtctgtcaccctcctgtggttccctccctgtatcttacacttcagtcacactcctgctttttgttagtccttgatctgcattgtgctttccacttctacgcttttacttatcatttatatctggagtagcttgttcccgttcttataaacttgtctacccttctgtgtttcctaatgtggccctattgatgctcttaaaataatgtgatcttttcttatctgagcccatggcattttctcatttttctttggtacttttcttactaagctttgcattatttgttggtttgtctctatctgtcttatctatctacccacccgtctctagcctagaagcttcaaaaatgtagaaaaatatttttctttctgattatttttccccagaacatgcatatactcaaacagagagtcaattaatatttggtggatgaaggaaagtgttttgcttgttttccagtgttcagtttcctttacatttttttagttagtatctggtagagagagaataagatttggagtctgatagatctagatttaaatcctagatatcccacttgctagctgtatgaccttagagaaatcaagtaatctctctgagcttctactctctcatctacaaaatgggagcaattatacttagttgcttattttgagatttgaagtattatgtgaaagacctttgcaaagaagagctcagtaagttttattggttctaccttctctttcttccttctgattttctctattctcatatattaaatttgttatacaactccactgttaatcacattttgttttaatgctatttaccttttcgtttctatgtatctcatcttctcaactaaatatcaagtttcctgagggaaggaaaagtttttatgttcacagctgcagttaaggttaggttctgcatagagagtcactcaatgaatattcattgaataaatgcattcccccatttgctcagctgacattctttccattccactgactccatgttggtgacttctccattgctacttctgtttggcagctttctaattattaccaggtgtcccaaatgtccactgtcaacctctaaaagtggactttcttcctgaactctaccataaaagtcctaaagcttctttctccaaattaaacctccatgtaaattgcccaccttagggtgccttcttgtcagtagaaccagcaaaaaagcacaataaggactccttggatttaactagtgagtcagatatgtcttacaaactgtggtttctcttaacacttgtgtggtctctctttctgtctctgcttctctctgtctctgtctctctctctctttcttggtattagaaggcaatacgcgtgcagtgggttctctaaatagaaagggatataacattagaaattggagcagtaattgaattgtaattatttctaggtttttaaaaattgaatttaaggatacattaagaaataaaccatccctggtgacttagtgaaagaaaggagaatgttatatgaaattaacatataggtaaatgtagcccttatttgtgcttttggtttaattatatggaataatgtaaatatttatgtgcttttgtaaggcaaaagcattacaatagagtgacacatttggtaaatttggattttatgttagcatgacttagcctcattagggcgttccgtttggcttctcaggtctgttgatggctaaaatcacctttgctttgaggtttggttaaacatgttatagtttgctaactttacacttgattaagttatttgaatctcttcattgtaacttcacacaacataggtagtttgcaagagaatgaaagttggaactcatgaaaatgctggttagtgtctggggtggttgtctttgatcattttgtagactatttgtttcttctcaccactgatgtttttaagtcccttaggaggcccaagaagaagtaccccttttctcagcctatgttttaaatatagaaagaaataagacagaaataaagcctgtggttaccaaaatatcacctttattcctaaaagactgtatactggagaatctgcaggcatgggacttcccaatactaaactccaaaattaaatagatttccctagtccctgacaatactaggttggacacacctctgctggaggagcagagcagaatttggagtgctgccaggagagatttggtctctagagaaaagatgttgacttatatatgccaaatttattctttcaaaatggtctatcagatatgttgcttctcccctggaagtggagagtgggccgttctttatctggaaggaaacacctaggactagggaatagacattccacataatagggccaatcctcttgtgtaatctagttggtagaaaaaatgaggtggcccattatagtggatttatcccaacatatttgttaaaaggaacagtcaagatttcaagtaatgctttgcatttaatagctacctaaaaatgatttttcatttgttagatgtacagaccagggtggcatctggtcacacatttttcagtttcacaaatgtgacaatactcctataacaggtatccctgttttatcttatgtgttaatgatgaaccacagtagaatatagtgtgttacaatgagtcagtatttttcatcacaaactcatcacgttattacttcttccaggcactaatggataactatttctaagactgtacaagaggctaattcaaatgatattatatttggaaagactttcctactaatctctctgaagttggaggtttgcatatttggttaagtaaaaatatataagataattttctgtcataatttcaagttagtgtacaataaaaattatcaatttctttttacagagtcatgtaaaaccattgagtacagacgatgctggaaatggaaagtattgagtaatatactaatattctaaccacagatttttcatgtccttatatgtagaaaaataaatgtcagtaatagtcagcagtgtttaattcatagatttatttgtgaagttcaggaaggaaacacaatttatactatatagatattaaatattgttatgaccatcaagtgttagaatagtggctaagtaaattactctttaataaaacacagagcctagaacacagcactatataaatgcctgttaaataggaaccaaataaaataatgaattctgtaggagtgggatttcaaacaaaaaatggcactgtgaatcttaatgggttttatatactaatctcttttctgtaaatacagtttcttggctctccagagtgtggtgtggctccttgtctattctttctataactgagacaagttacaaatctcagtagattaaaacttgggaggaatattgcctgaattcttaaagatgaaagaaccctaagcatttaaattatagtgctttattattcattgtttgcgtagacactggtcatataaaataactcctttgtctattattttattgtcaatatagacatcaacattctgactgaaaggatataaaatatggtaagaaaatatgatacattatgtgaattacagtagagataaaaaatgccattactgacatttactacataaaagttgccctttgaaattatttaattatttcaagtatttcgtgctgtgaaggttattttcacaaatgttcttttgctctgtcttaataaaatgtcaaacattttaataatgtaaaatacatatttaccctatgaatattgtactttatttctagtttgtgatctcacatctctcctcataaaaattgcattatcatattacatttttagcatgttatttccatgcttcaagttctcaagtggctcttattcattttcagaataattatagagcacaaagttatttattgctgtgtaacaaacacatccaaaactcagtggcttaaaacaagaataaacatttgttttctcatagtttctgtgcgtgaggagtttgggagcaggttggctggttctggcttgggatctctcatgaggttgttgtgactatatcagccagagctatagtcatccgaaggcttgactggaaagttaccttctaagatggatggaagatgttctctcaaatggatggcaggttggtgctagctgtttgctggatccctcagttcctcaagtggaatttttcatagggcaacttgattgtcctcgtgccgtaatagttgatttcctccagagacagcaactcgagagagggaccacggtggaaactacgataactttcacaacctacccttggaagttcctcatgtcatttcaaccatattctgttggtcacacagggaaggcataattcagtgtgtgtgggggtgtctagccagaggtgagactcattgagggccatcttgtaggctggctaccacacttgccaaaaaaaatttttttttttttgttaaaagtattgaattgggttaaatggtcacatttattatatgtgcaacccaatttcactgactctttgtaacctccaatttctaattttatttaaaatctcaaacatttatttcttatctctgagtgtatcatatgggcttataaagtcgtctgtcatattctgttctgtgccctctattgatgttgacttgccggaggctggtggaggctagtgctccgccacagctgcgggctttaggactccacctcgtcagtcatccatgccaatggtatggtttcccagggtttccacatttataagcccccaggctgctaaaatgaaggtgaattacgtgaaatccttcctatttaaaaacctgtgcttatttccacccagaagtggaaaaaatgttaccttttctacctatgaattatatatatttatcccctagtacaagatagtgtgcttctatatctggtggggcttagaccaggatccatgggctgagcttgaccctcgtgtaccatcatgtgcttcagatgcaatgttgtgttgcctatttcatttgacatttagtcggaaagtagactattgaaatgattggaattctttgctttcagtttagcaagccagtctgggtcccagctttaagctcaaactagccacttgccatgtatgtgcaacacagaacatattaaacatacatatccccagtgccattagtagctgcataaataatgtttgaggttaatctgtatgctaattaaatatatgtttagaaaaattcagtatatatctaaattttggtcttatatatcttgaagttattcgttgcatacatctgtcaaggaacttttgtactttaatagaataattcaattcaaaattggcagtgaaattcttacctgaaatcagtagaagcaccagggtgctttagtcctaaaacattggctggcatatcctttccattaatggataattgatttgttctcccttatataaagtgaagtgctatgcaactgtagattcaacactcttctcctctcttccaatcagcttactgctcctctttgtaaaatccagtagttacattgcttaaagtcttctgataaacattttcataagctagggaatatagtctgagaaaaaaataaatgtttacatcggaatttcagatttaaattcacattagtcattcttataaatatctacccttttaaatttgattttttaagtgaattataaaatcttagggaagaagagtttatgaaatattggaattaattgttacttgaatgtttgtgaaagaactcctctctcaaaccatttagacatggtgttctctttaccgaaaggtgcttgcactactgaacagaatattttttagtaatagaataactcaggtttcatacttctttaatcattttggcaaataatatctttatcaaggtatttatccattttttatctctgctatctatgtttgtagtttttcatttctaatacttttattaccttatctcttttttcttcatcagtctagtaagagatttgttggttttataaaactttaatgtttttggcttcattgatcctctatattttatttttgcctttgacttaattattttttcgtatcttttaatatcaactttcttttgctttctatgagtttattaccttgtgttatttttcttcttaagttggatatatagcttatagatattcagccttttataatctaaacaattgaagactaagtttcctattttcaactatttttgttgcattccaaaagtttgaaatgtagtctcttgataatgtttcttaatctccattgggatttttgttttattcatgaattattttgaaatgtgtttttaaattctgaagtatgaggtataaaaattatttaacattttgttactaatttctaattgattacatttgtttggaaatgtggtctgtgtgatatctaatctttgagcttcactgaggtttgttttgtcaattttaaagcttccaatgcatgttggaagagaatatgtgttctctaattgttgcatgcagggttcaatatgaagtccattaaatcaagttttaattgtagtatttaaatatactatatctttgttaattttttttgtttttggttttttttttggtttgcatgacttattaaatgagagaggaatgctaacatctcacactgattatagatttttaaattccttcctgtagtttatctgattttgttttacatacagtattttgaatctatcttatttatataatctatctcattgatcaattttaaaatcattctatttacctggagaatttattatttgttattatgtaatgattctctttattcctaacattgttttttaacttaaaatccatgttgtctgaaactaatacatattctagctttctttttgttagttttatctggtatataattttacagcctattacttccaacacttctgcattcttagtcatatctcttgcaaacacacatctttggatttgttttgctctcagttttctatcttctatctaacaattattgtcttttaactggcaagatcaatatattgaatttatattaggacttgattctgccaagtttttttgtgttttctgttagcacagcttttccttctttcttttttccctttttttttgcacagagtgaattttgtttattctttttctctttctatccctccttcactcctctactaggtttagaaattatgtattaaatatctactattttagtggctacccttgatactttactatgtatatttaaaaagctagctattctaaagctgatcaatatcttaatcacctgctaaataataaaagttctctagaacgttttaactgtaatcaacctcttcttacttccatgcgattgctgttcagggttctagttctttttttggttcaactccacaaagtagatgttaatatttttattattttatataaataatgtttgtctagatttgatacattacttactagtttatcaccatttctttttgcctcagatatgtcttctgagatcacctctggaattaggttcattctccttgaagtacttttaaatgaaggtatataggaggtatactctctcagtttttgctttttgtttttttcatttttaaaatcctgtgacaaatgtcttttagtggagtatttagtccatttgtacttacataactatcaaatatttgcatttaaatatatcactttaccatgctagttttatttatttatttattttttattattatactttaagttttagggtacatgtgcacaatgcgcaggttagttacatatgtatacatgtgccatgctggtgcgctgcacccactaactcgtcatctagcattaggtatatctcccaatgctatccctcccccctccccccaccccacaacagtccccagaatgtgatgttccccttcctgtgtccatgtgttctcattgttcaattcccacctatgagtgagaatatgcggtgtttggttttttgttcttgcgatagtttactgagaataatgatttccaatttcatccatgtccctataaaggacatgaactcatcattttttatggctgcatagtattccatggtgtatatgtgccacattttcttaatccagtctatcattgttggacatttgggttggttccaagtctttgctattgtgaatagtgccacaataaacatatgtgtgcatgtgtctttatagcagcatgatttatagtcctttgggtatatacccagtaatgggatggctgggtcaaatggtatttctagttctagatccctgaggaatggccacactgatttccacaatggttgaactagtttacagtcccaccaacagtgtaaaccatgctagttttttatttaccttctgtctttagttctttactcctttttgctttgctttggataaataaaatatttttaatattttattattactactatactaccttattaattacacatacttttattcatttagtgattaccctaaagagtaaaacacacataattgacattaaagcctacctttaattaatattgccaacaatttccaagaaccttatagcacttaactttattgaccccttctgccttgtagcttatttttgtcataaactgaaattccacatctttaacagcattattgaggtataattgacatataacaaacttcatatacttaagtatacagttttgtaagtttttgacatatgtatataactgtaaaaccaccatgacagtcaggataaccatgtctgtgtgagcttttgtaacctgcttctcttatccttccatacattcacacaatcactgtttatttgcattttctagaaatttatataaatggaataatatattatgtgcatatttaacagctattaaatctatccattggttatttctttggtaaaattcataatctttttatatatttctttgaacatgctaattgcagttttctgacttctacgttataatgccaatctttgcaccatcactgagtctgcttatgttatcaattttttcccctgcttttcagtaatttttttatgtcttgtttctttatgtgcctaatttaaaaaattgaatattagagataatatctaaagaattgtagaggttcatgatgatacaatcttccctagagaaaattttattttcttctggtctgtagatactgggttcaggctttctttggtttgatctgtttctgatttgtccttactcctatgatattgcctttcatatatcacatcctaaagcctgaactctgcccataattcttctactttgatgttccctgaattctaatttttgtttactcagcatcatgagactaaaatttatgcttagttttttttgcttatcagcagttctatgcttgatcttacctcacctacatagtttagtaggtgtcagcaaatgatctatgggaaattgtgttagaatttcgggtcatttcctgagtttccttattttttctggtattttgttccctcatgtcctgattgcatttgtggacatgaatttcaatttttatctctggcccagtgacactgcctcaagctctaagccacagttttccatatggtccctatgacactgaaaatcagcaaatctcccaaggggaaaaagatgcaataaatttggctcatctaagtgcattttctttccttagtgatcttggcctttcaagtcttgcctgccttgcttgctttttgatgccttcaaacagtggccttcattatgataaatacacttgctaggtacacagctatagattgatagttatttcctcttagcagtttgaggcactgtcttatgacatccgttgttgctgttgggaagaaatcagtataattattgttcctttcaaataatctgcctttattattgtctgattttaagatcttttttgtcttttaagataaataagccctgcagttactacagcttacttcctggagagttttttggcctcattgcaggaaggaggaaatcaggcagaggccagggtcttcctgaatggaagagatagagctgggtgtgtggggaggccaaaacagctatttcatatgtcagagtaccagagtgaaaaagagagcacagaggaataaccctagaaatctgaagatgcctcttgactcttcactgagtaatgatcaccacagggatgtgagaacccaccccaagctggggaaagtatcactcaaaaggaacacaggaaaaattcttagagctcacacaggactaagaatagtttgtgtccctacaaggcaaaaacacaaaaccttgtcatttatttgccatcaggtagagtagtcagaatggtggaagtggggcaaaattaacctgagggcttctgctgcctaataaagtttaatagaaatattcagtagcatcaaactatttccaagtaatttaaatgcatccaagaacaaaactcaagagtacttataggcatacaaaaatatcctgcacccaataaagtgaaaattcacaatgtctggcatccaatcaaaaattactagacacacaaagatgcagtaaaatatgacccataatccagaagaaaaataagtcaaaagaagagcccgggaatgatactgttgatatagttagtaacaatgatatcaaaaattataactatgttccatatgtttcagagggtagagaaatgcccgtgtgtaaattgagacacaacagatttcaaatattttacatttggtaatttcaatatttaaagttcttgtattgtctaaagttttatttgctatttctatcaactctcactcatggtagcacttctttttgagtttagtgaatttttactttgaactcatattttaataatataatctatctgaattctgaggatttaaataaagcttgtttttctctagagagtattcacatttgccaaatttggaatccaagagatacaatagtttaaggacaactttacattctttgaagggtcctgatttattctgggagacccaggcttggcatctccaccttgcagtgtccttgagcttacacttttattttctcagtgtttttatgggcgtttggtctgaaagtaagtctagattttaagtttgcttactggtactctttaaattttagctgactcttcttgcctctagcccttttgatgtgcatgaaaatctatgtttgttgtgtttcccgtatttaccatcatatttacagtacacagcactggccaggctcatagttagaattaagaatttgccatatgagttactatcattaatacaaaagcctatggtgtttaaaattatattgtttatttctagattttttaaatcttaggagtctagataaaatagagaaaatgactacctcatataataatttatataaaataacttatatttttaataaaaattctttggtagtcagatttactttgctttgatttcattaaataagtttttttttttttttttcagaactggatactttttgtttgaacacctttcaaataccctttttgatggtgatcaccaaagtgattcctgcatcctgttcttttgattctactttaacttgggcttggatagttattggagaattgtctgaaagatctttacgcttggcttaaaagaaataatgattgatagatttgtcctaactcaccttaaagtacatcaaaagagtcctggactctgccttcaaactgttgtgtgactattggtgggttatttgagctacttacacctcagctttctcatttattaatcaaaggagttgaaatacattattcttggatattactaagggattaaaaagcatagcaacttaaaattaacacctgtctatgatactcctaatctgtcatttaaacttgtatcttatgaattattaatatattttagtaaatctataaatggaatgggtagagacaatagcacatttgcaggtacaagacaccagtctgaaagacttagaggacttgtggaaagtcgtgaatgaaaatcaaattcaggataaaagggagagtcagagagatctgaatgcataggtacaaataatagcaatactgtaaatgtggatgacatggcagaatcttggccttggcatccaccccttgtgattgatcaagattgcttaagaccatggaaatcagccttcaggggactattcttgacaatttaacttttccttcttaattgcattaatataatgcctgaagttaaaggaaaacctatttaaaatcgttaagtattcttgttttttaatattggtatcagtataatgatgaagatgtaagaatttaataatggtagtaatattaactttttttttttttttcgagacggagtcttactgtcgcccaggttggagtgcagtggcacgatctcggctcactgcaggctccgccccccagggttcacgccattctcctgcctcagcctcccgagtagctgggactacaggcgccagccacctcgcccggctaatttttttgtatttttagtagagacagggtttcaccgtgtttgccaggatggtctcgatctcctgacctcgtgatctgcccgcctcggccttccaaagtgctgggattacaggcgtgagccactgtgccagcccagtaatactaatttttaacaattgggaactatactttctatctcattgcccatttcaaaatacagaatttcctttttttattgagatggagtctcactctgtcgccaggctgggattcagtgatgtgatctcggctcactgcaacctctgcctccgggttcaagctattcttctgcctcagcctcccgagtagctgggagtacaggcgcgtgccaccacacccagctaatttttgtatttttagtagagacggggtttcactgtgttggccaggatggtctcaaactcttgaccttgtgatccgccggcttcagcctcacaaagtgctgggattgcaggcgtgagccaccactcccggcccagaatttcaatagtgacaatctctaatggttcaggaaatattttgtttacttttacttgaattataaaaatggattcaaagaattttgattattaaatgttgaaataatgtttctaatataattattttaaacctattatagctagttatgtcatattaagttaagtgatatcaaattgctgatgtttggtgggttttgaccttaaaaatgctatttgatataatttcacttagtagtaaaatataggccaaattgattccgtcaaaattagagaacataatatatgtatgcataaattaagtgtgctgataaattttaccttgggctacaaggtaatatgtagtattaatatagcattctttttatttgatggctaacttttccttaaaaggaaaactaatagattctaataaatgaatacctttatttcctcttggagtcatgttttttcatgttgagcaataagcaatttgatttagttaaacttgaggatagtttaatggaaagagccaaatagtaatagtaaaatataatattcagactctctcaaatggaaggtttattactgtgttactgagactaatttatgtcaacatgtgtttatttagtaattttactaaacatttattttaatatgcacacttttgaaattgacattaactttagttaaattgacattaaactttagatctgaacacactattattcatgctgtttctaaccatgcttttattttccttttttttatagaacctcttttgaatttcacattgtaatctttgttagtattatatgagattgtatctcaatattcagtgtttgatattctgtcaaattcagtgaatagccgacatttcttgagtatgctcctattcctaataagagatgataaccatctgctcaatgtttttaaattctctttgtaccctgaaataagatttgatctgaatattaatgtaatggtactcttagagtacaaaagttttatcatcttacatttattatataaagccgtgtttgtctaactagaccatcctaaccgccataatgatactctggtgtagtttgttagataactttgttgatgtcccattcatggaataattctcatattttagttatttttattctgttaccgttttttattttttatttttttgtttgaggcaaggtctcactctgtcacccgggctggaatgcagtggcatgatcatggctcactgcagcctcaacctccttgggctcagtcgattctcccacctcaatctctggagtagctgggactacaggtgctccaccatgcctggctaattttttgtattagagacagagttttgccaggttgcccaggcttctgttaccagtttttagttagtgaatttaaacaaaaatagtcatatcatgtttttataaactataaatttacacaagcttgtgatgaattcttaatatacttattttagtctgaccggaagtgaatttcaattaattttcaactgctgtaatcaaatttcattttatcttttattctcttcttccagccataagaaatagggattacatttcttgtcaagtattctaatatttaaaatgttaaatattaagttggcctttaaagaatgttatcagtttgttacttcgggttcattttatatattagagaagcatacattgagagataaaatataaggaggaatattttttcttttagtgggtaaggataatatatatagcagattttgagctaatctctcactgacaaagcaaatcataaatctcggaattggtctggatcttaaaagtcatgtaatccagccctttaaactatgcttggcaatggccatttctccttgtctgcactgaaaggaacttactacctcctgagagagtccatcccataagctctttctataatcccagatataaaatattaacaaagaagacaacttcccagaggagatcatttctgacctgcattctaggctttataggaagtagagcagttagttgagttatggagaaggaaggaaggttatcccaggcagagggttcagcatgagcatagaaaatgcaactgcttagtgttcatggaaacagagtgaaaggatgggagtggtgagggaggagagggaagtatgggtcaaattaattcatgccttgtataccatgttagggagcttggattttatattacgggagaattgtgattattgaaagtttttttaagtgaaggggtgacttgatttgaccacataggattttagtcagatctattggctctgtggtggatggatttgagatggaaaaggttgaagtaagacaggccagttaagagggcatcgcaataggtcttatcaaaagacagtgagaacctaaattatgagagaagagtttggatgtaaggacataaaatgataggacaattgattgaaatggaaggtgtgtaggagtagatttagggatgggataggtcaagttgcaaatagtggcatattgtatgttggggcagagggtagggattttggctttgtttttgtctactgagtttgatttcctggtaggatatctaagactatagtgggcagctgacttccagtgtgaagctcaggaggaaaaatttctactggagatatgggatgttgaaaccatgggagaggatgagatcatatagtgatatgatgaagacaaggactgaggacagaccatggcacatcattatttatggggtaattggaagaagggatgcccaaaatggtgactgagaaaaatcaggaaaatagaaaaagaatggcatatttggtgttagggaacccaaggaagtagtatcaaaagagacggagaacaactgttaggtcagatgcagccaggatgtcttgccagttaaagaccaatatatttattccggatttgggagtggtggaggtcaatgcatttgccagaacaacttcagtggaatgtttgcatggcaagtaagatctcggtaagtgggtgtgataaagattactctttcttgaagtctagatgagaaaacaaggagaatgggtggaagttcaaggacattgtttttaggatcaacttaagaggcctcagaggtggagaaaaaagaatgaggagagagggagagatcagatatacaaaggagtgaaaggatggctggaccaagtcccccaagagaggagggggtgtggttttaaaaaggcacaggtagggtcttctttgggaggagtgctccatcctttgaggaataagggaaggaagttaggatagtcatgaaggtagataagtagatgaatgtgagcaggtaggaagttgagggaaaataatgtttgatgacaaggatgtcttcttgaggttgagaccaaagtcatattctaagagtgaaaagggcttagtgggagctttgagatgaaatttgaaatagatattaaggagaacaggaaagagaattgacaaggatagggaaaggcattgatgcattaatgtgcagtgctgtgatagcaactaaactctggatcatgattgtgtagtggcttctcaactgtgttgtgcaacttttttccacagtagtcaaaattggagaaaacgaactgtagctgtacatcagagttgggtgtttgctggggatgtgtaagacaaatatagggtatacagaaatgtatgtggtgttgatgaaaaggctgataaggaagcaggagcttctcgccaaataggagggaacagaatttaggaggtggcttatagatggggagaaagttggggaggagagcagcttaaagaactgaacggctcagagggcaactataataggacctagatgtagaaagataggattccatacagtggaatattatttgttcatttatttgtatagcctttttttttaaaatccactggacaaataacttaagacatactgtgtgccaggtactatgccatgaggacatagtggtaaagaagatcaatctggtctctactgtgctacagtttatagacaggtgtagcacacatatagtagacaaaaagtatacatatctttgggtctcagtgttatagaccacaggcttttaggctcccgtgtaatagaaatttacataaggccaagtagattagccagacaaggctttattttgcggcttgtgctcaagctcaagggagacagtggaggtaaaagaattctctgtctggctccctgaaaagagcccgtagggattttttattaggcaatgtgcaggaactgacatcagggggagggtgtgcaggctgggctgggtagagcatgtgagggctggggtatgcaggacagcatatctagttgtgatggtttgaggtaatgggccacctagtggtctggctgggggcaacaaggctatattatatattattatatattatatattatattatatatttattatatttaatatatatattagctaatcctaaggcttagttaaattgctcttcataactctggctagggtaattgcttcaggacccaaatgagcccgaatagaatgaatctcataattttctctagaagtgctagggcaaaagcgttatcttttcatccatggacaacaatgaagaagcagccctcaggttgttatggtcatcttgggacaacaaagggtgtgtgcatgtgtcttgggggagaaagtagtgggagcctgctaggataagacgccacactgaggaaatggagctgggaaatagagattaatcaagtcttgataatattatctgagtgctggatcaggctttgcttgaagtcattctatgcctttagttaaactagttctacaaaaattttgtttagagaacagacatgagaaaaaaagatggaaaatgtgagaagggccgggcatggtggctcatgcctgtaatcccagcactttggaaggccaaggtggatggatagctgaggtcaggagttccagaccagcctggccagcatggtgaaaccccatttctactaaaaaatacaaaaattagccaggcacggtggcgtgtgcctgtaatcccagctactcgggaggctgaggcgggagaatcacttgagcccaggcggtggaggttgcagtgagccgagattgctccattgcactccagtcagggtgacagagtgagactccgtctcaaaataaaaaaaaaaataaaaaataaaaaaagaaaagaaaatgtgagaaggaagccaataaagaatccttataatttaatctagtttaaatttagtttttgttttcgcttttgttatttgcaacaggaatattactggtatgtggaatgcctgctatgctgattttttgactattatatcttttgactccaacaaaccaaatatactcctttaagtagctgcagattctatttgtttcttgtatatatgggtgggccaaatcatatataggttggccaaatcatatataggttttagagcagaagacttaatggacagtagtgttaatttcagtttggagtcctcttgaggaatgaatcccttcatttgtccttttatatttcctagtcagggtcttatgtgtaatgccatactttttcctctaaattaaatcttactctgagtttttgcttaccaaggtaagcagagagtacaatattaataatatttcacatcaccttttctatcactaaggttttataggagttccagggctacagttactgaaaagactcctttagcttgtttttacttctgcatcccttctcctactgccacttcagtaatggtcttctaccactttggcacaatgactcagactaaggtgcctgggatctactcaggtcattgtgcacctaatagaggtgggtggctgccctaactggcaccattcccctgggactagcttagtttgataactcagacttccaaagccatgtgtattagtctgttctcattctgctaataaagatatacctaagactgggtaatttataaaggaaagagatttaatcgactcttaattccacatggctgggaaggcctcacaatcatggcagaaggcaaaggaggagcaaaatcacatcttgcatggcagcaggcaagagagagcttgtgtagaggaactcccattaataaaaccgtcagctctcatgagacttattcactaccacaagaacagcacaggaaagattcgcctccatgattcagttacctctcaccaggaccctcctacaacacttgggaattattacaattcaaggtgagatttgggtatcaacatgacccttgataccttggccttgaccaacattcatgtagtcatccccaaatgaggctctgccaccttggagacctaaatgcttgtattctttatgaacccagaagccctcggtctatctgatccctgctttaacaaccttccagaggtagggctccccacatctcctacctagaaacacaaacacttctccttctcctctgagactctttagtgtatttctttgcacaggctccatgtgaaaatcactcctaaagaaaagggacctagaactctcaatttaaaaagtctagcagtgaggtagaaaggaaattcttctttccattcttttggtgaagagaacacagcagcaaaaaggccaagaaaccaagtagtttctccataattctccctgtcacagttgtctacctctattttccacaacatatgtttgctcattttatatacactttttttttttgagatggagttttgctcttgttgtgcaagctggagtgcaatggtgtgatcttggctcactgcaacctccaactcccgggttcaagtgattctcctgcctcagcctcccaagtagctaggattacaggcgtgcaccaccacgcctggctaatatttttgtatttttagtagaaaccgggtttcaccatgttagccaggctggtctcgaactcctgacctcaggtgatccgcctgcctcggcctcccaaagtgctgggattacaggcatgagccactgcacctggcccataatatatacttttaaatatgcttttatatcattaatcttgttagaattttatgacatcttagtgatcctaaacctactgtatttccagaaaaaattctgaagttctaggccatttcacctgactttagccaacattcataatcatcaatccctgtgccctcccaccctctccttcacatatacaggtttgtgtcccactttaatgcttttgattgttctaagctgtattttctaatttctttgactgtattgaaggtaacagtctatatactccaagatggatcttattaataacataaatacacactcagatttacaaatattcatatatctgtgattaaaatagtcatgtttttggccatgtcagaaatgtatccctcttagtgatgttttcacttctgttggcctgtaaggattgttgtcacttggttgtctcctgaaactcctctaaaagaaagtcataaaattctgaattctgggacctatagacctgtaggaaaagtggcacataatttattttccaaaccagcatacctaagaaaggaaggggttactattaataattatgccaggacaacaattataaaccactactgtcccagggaaaccacatatatagtcaccctaaagggcagagacagtgtatttccatctgacatcctcaggcagttccaaggttcttggtctgattacattgcatgggagaagtccttcatgagaacagtaagctgagggcagtctatgtgtatatgtttctaacattcgagggttacttacagagttaacctttaagtagcttatgggaaatttttatagtacaatttgactgaacacttgggtcatactagttctggacttaatattttgcagcacttttattgttctcttcaaatgaatttcaagtcatgttaacctgccattttgttctaatgacactaatggctgaaattagtggcagacgatgagcttggcagtgacagcataaatggtactgccacatctctctttttgctaactttgtattatttccacctgtgtacagttagtccacaatgttttatttgcaaagcactgttaaatcaccagcattattatttgactcttaacatacatttgctagtgaatgtgtttgacatatgcttatgttaagaaagaaatttacatttaaatcttaaaggaactctaattgccggtctttgaagtgcttcattatcaactgctgaattaaataaataggtcttggtctaaagctgaaaggacttgcagcaaaggggcccctgaacaaagagagcccatgagtccaaagtaaggtcacaattccattaaatactcagatgataattgacttcaagcactgtcctgcattgcttacagttgaatctccagcacctagaactgtgtctggcatgtaataggcacacattaaatatttgttcaatgaatgaataaatattctttatagtgtaaaatatttgtagcatgtggttttactctcaagcattctgtggttaatatatttttttaatattcttgtcagtatgttgtgtggaggcttgaaaatccctggtttttcataattattgattaaattaatcagcagtttctatgatcttataatttgtgggggctagtatcatttgttttagtagaacgttttccactttcttcttttagttatacagtcacattctccctgactttcagttttaacctttgcttctcttggataggccaagaatccatggcatgatgtaaccaaatctcctccccgctcttttttttttactcttcatctcaagttttagctaggataatgtttctgttagcctagtttccaaatgaaatctaaagtactgttttcataaaggtgagatataaggaaaagttcaatagttaaatcttaaaagattatttcttcctatgctcagtgagatatatgagagatactgtttgtcgctagagagataatttccagatagaaatacatacatatatttcataactgacatatcattaaaaaagggaatattttctaacgtaagaaattttaggatgggcgtggtggctcaggcctgtaatcccagcactttgggaggccgaggagggcagatcacgaggtcaggagatcgagaccatcttggccaacacggtgaaaccccgcctctactaaaaatacaaaaaattagccaggcatggtggcgcatgcctgtaatcccagttacctgggaggctgaggcaggggaatcacttgaacccgagaggcggaagttgtggtgagctgagatcacgccactgcactccagcccagcaacagagcaagactctgtctcaaaaaaaaaaaaaaaaaaaaaaaaaatttattgtaagattcaggtctactctactctattttaattgtagttcctatatgcacatcatctccattattattcttaggaaaggaggtaagtataatagacacggtttatcttgggagaagccagggtgacctatgctcacttctttcttactcccaaggttttttaccttcctcatctttcagggtactggtgccatcatttctctttaccataaatcaaaacatttctctgatcgaattctgatattagtaatttttactttagtgttcatcttaatatatgtttcttccttaaagtgtttgcatcttaacattctctctaactttagcatttgtcttcataaatggaattttatcatcagggtgaaaattatgttttgccaggagccacaccaagcttcattaacacatacattgtcacctctcatatgcacttgtgtttgtacttgtacaggggcatgtttgttaagagtgaggctaagctgcatgttttataacagagacttaattttttctttcaagttttcatgtaccttaaacaattagaccttgtaagtaaggttggccttggttttatcatctggccagtattgggaatggatctatagaagcaaagggaaacgatataggattcatgcaacttctttactgttcgctatgaaccaaaaacatatttgtaaaataaaaaatagcaggtaagtagggctgtaattcatcttgttttcatgctagcatgatgaactatctctgaacactagattcttggattagtagtatttactctaggatgaaatgtgatatgaggatcgtcttcgactttatttatgatcacttatttacaaaacagcaaaaagaacattatattgtggcttcactcataaggcagtcttatggcaaagacttcagaatatagtgagacattaaaagattcattaaaataaagcaaagatccatgaattttgagttacagtgtacattaatttttaataatatttgtatttcaggtcagttgctccgattaaaaatgtttcgagaagatcatgggtcgtggatgacaatgttcttcagcacaattctctttctcttcatattttctcacatatacaacacgattcttctaatggatgggaacatggggtaggttttctttcccctttctactgtggtgagtgttatgtttgaaacttgtaagaatttaagagttttttagcttgtagtagtctaagtctgctttacaaatattctaccctaagaagaaggagtattttatgtatttttcttacctaagacattaacattttttttttccaggaagcatatagtacattacaatatttagattttgttctttatcctttaggacttttatatagggtggtgggagggcaggtactaatttcattatactgacaagggggtatgagaatcaggaaatcttattgatttgcatatattcaaatgattcatagagtggggctaagatgaaggtttccaggtttgcaatttcattggtctgcaatgcctggctaaataaaagtggtacaggaggcattttctttaactctcttgacagtcctgagagagagagacctttgttataaataggttgttttaaaagtgggccacagctgggcatggtggctcatgcttgtaatcccagcactttgggaggctgaggcagcggatcacaaggtcaggagatggagaccatcctagccaacatggtgaaactccatctttactaaaaatataaaaattaggtaggcgtggtggtgtaggcctgtggtcccagctacttgggaggctgaggcaggagaattgcttgaacccaggaagcggaggttgcagtgagccaagatcgtgccactgcactctagcctggcaacaaagcaagactccgtctctaaataaataaataaataaataaataaataaagtgggccaccctgtattaactcctagcttgtgatatatacttatcaaatcactaagacatgaaatatgtgccaacaagtagttgtataatttttctaactttcttcacttctttctttcattatataatgaaacacaaggattggtctttcagtataatttcctcttggtttgttctcagtaagtttatttgagaaggaatctcgctgttgtcagccagggctggagtgcagtgacgcgatctcggctcactcactgcaacctctgcctcccgggttccagcaattctccttcctcagcctccctagtagctgagattataggcgcctgccaccacacctggctaatttttgttattttttagtagaggtgggatttcaccatgttggttcgtctggtctcgaattcctgacctcaggtgatccacccgctttggcctcccaaagtgctgggattacaggcttgagccactgcatctggcctgctctcagtaagttttaaggccggaatgtaaggagattggcttagtattaaaattagatttgtgacaataataaaccactttaggtatttgttgtgtgttgaaatagttactgagaaagattttgatctattttccccaatagatcagaaagttaggtaatatccttttcttctaaatgtaggctaggcaggattattgtccagttccatgggaaacatggaactgttttgatgttacgtatagattttggctaccattgttcagtactgagagggaagctcatttagaatttcattgtttttccctcaccactaaaggagatgaatagcaaagggaaaaatacatttcacatgttttatattttagtttatactaacaagtgataaattcacgaatgtgattttagataaaatgttcaggctttagaaagttattaaaatactttgtaattatttcttggacttagaatgatagttttaataccaggtctgttttgaaggctgtaacctatggctagtcagaatatgtctcagccttggagcagtgcctgtaatactagaatgggtaatgattggagttagctaacacagccaaaggtttctctgtgagttgtttttgaactcaaagcactgagagcagaaggagaaggaacctctgtgaaaactacattttaaaagcaattgctggaaataatacatgatataatatataaaatatatcttctgctcagaagctgacttttgatataattctgttttttttttttttttgtttgtttttttatctagagctaatgaggtctgtgctaactggaaatgcttattctgaggaagggagcagatttgaaagcaataaattaaatgcaataagtaattccttgtactctgtaaagcactcaatagctggaaataaaatgagagttaatagttgttgaacatttacaccaggcatgaattatctcaattaaatctcgcagtgactccatggaataggagttattacctccattttgcagatcaagaaactgaggactagagacattttgccactttgttgtttaaaggagaacacaggtccgattgatggttgaccctgttactcattcaccatatcctattagcctttctctgtgttttattattcaagctgaatttgacaatgaaagaagcaggagatatgcttaggaaataagagaatagttagcctagaatttatgtgtagcctaactaaaattgaaagtggtcttttttattctcagactaaatacaatcttgcagatttttaggtaactgttgaactcttcaccattatgcctcatcttcataggaaaagcatcgtttactgagaggatatattaaaggtgccacattttagaaaaattcaaagcaagggacaaatggtttagttctgcagaaaaaataaatcaaggctgagcatggtgacttatgcctataatcccagtgctttgggaggctgaggcagcaggatcacttaaggccagaagtttgagaccagtctgggcaacagagtgagactttgtctcttacaaaaaataaaaaaacttagctgggggtgatggcacgccttgtagtcctagctacttggaaagctgaggcaggaggattgcttgagcttgggagttcaaggttacagtgagttatgattgtgttactgcactccagcctgggtgaaacaacaagactctgcctctaaaaagaaaaataaaaaataaaaattaaatcaccatttataaaagatgtataattaacttttatgacacatcatttgatcaagtgagcacattgaaataggagtgtaaacttggaggaaaatcagttcttagagcaagtggatacaactgtgctattggggttgtcctagaagacaccatgttttctgaggtattgcttcatcccatgtagcacagggaatgatggagccagagagtgcagaaaggacagtgagcacacagacatcacaagtaactggttttatgtcagaagattcttggtagtagagaggaattcaggattctttacactgaatctcatttgcattacactgaatttgtggggagtccaatgtgtctttgtttataggtctctctaggaatacgggcctagaattatttccaaaacagtttcaagaatatcctatgatggctagatctgtgttaatgtattttaggattcctttccaaactggaggagttcaggactagaatgaatggtgagtggctgtagggtttccaaggggaagaaggagttttcttagactggtctgcattttgtgtgcatgtatgccaattttaggaatggtataaatttaatctaaactggggtctcatgatctcttactatagagaaaagaatccctaggtttatctagaccggaacctcaagagtttttagcccagagttgcctggctcctgttcttctcattacagtggattccctgaagtatgcactaactcttatggctttagacatctctggggagccaagctgaaaggcagtcagatggagagggaaagaggtaagttagttggttgagctaaaaaggatcaaggctcagacaatccatatttgtagcaccacgaggaaaaaccttgtctcaaatttgactctctttctgcacctctgttccttataccactaaaatgctgcttattgtaacctcctttattctttttttttttgagactgagtctcactctgtcgcccaggctggagtgcagtggcatgatctcggctcactgcaagctctgcctcctgggttcatgccattctcctgcctcagcctcctaagtagctgggactacaggtgcctgccaccacacccggctaattttttgtatttttaatagagacggggtttcaccgtattagccaggatggtctcgatctcctgacctcgtgatccgcctgcctcagccttccaaagagaacctcctttattctttaagtcaccaagatgtaactaaactcatcattttataaatgttgagggttctgctgaggagaaggtgctgattctgggcatagttttgcatgtagccattttatgagtaacttctttttttttacaaggtggcagactaggtaacctgaagccttgcctactacaaaatctttagaacagctggaggagataatgcagcttggtatactcctttaaaatgcatagctgagtttacccaaaggtcaggaaaaatcccagaggacaaaaatgcagaaggatctgaaaactcgggcggtaagactaacaactgattgatactgagatgctcagtggaggtgacttaggcacttgaattttaacccttatgtagggaccagaaacaaggatttggctcatattaattgaaaaattgaaaatagaaatttccacacagatgatcccgcaatgggctacagtgggagggggaggtgaaatggaaaacatgtaactgttagcagcactgaatccatcggatctgcagcaaactggatttttgccttgttagaggaaagaattcagctaagggacataaggcagagtgagagactgagacaagtttcagagcaagagtgagagtttattaaaaattctagagcaagaatgaaaggaagtacagtacacttggaagagggccaagcggacaacttgagagatccaagtgccccatctaacctttgacttgggtttttatacattggaatggttctgaggtttgcatttcttctccgctgattcttcccttggagtggactgtttgcatgctcagtagcctgccagcacttgggaggtgctgcatgtgcagtgtgtttactgaagttgtgtgcatactcattcaaggcatttttcccttagcagtcaagtgttcccagaggaaggtcatatactagttaaactccgccattttgtcagttactgcacatgcttgagcccactagcccaacttctgagatcttgtcgggaagctgctgatcaccaagagtttgctatctgttgggagactgcctttccctggcactggctgcgaccaattattattttggagagactgtttaatgactgcctatctcctgatggtagcctgacattcctgaggagggccctctcctgccctgctcatgtctgcctagctacctactccaacaaaaccacttagcacaggcaagcatcaaggaagcttgtacttaaactgggctctgggggaaaaatatctcccggggaactgctaccataggtgcagttttgtgattttaatatacagtttcctttggattttagaacctcaaaacatccccagctattctcttctcccagtttcaggttcttacttttctctggacacccctccccaaataacttgaattcctgttttattatgtagagcaatttagtttccttttgcctcaacttctatccactttgatttatcaagggcttttcttttagtgaaaaaaatcatattgatgcattttccaatcaaaggaaccaatactctgatttgctgctttctcagaatatgaaagtgttgacctaaaaggaagaaactgaggcaaaattaatataagtagagtttgtttaggccaatcttgaggactgcaacccaggatcatagattcaaatggccctgaatatatgcttcaattaacagcagttataagtgttttgttaaaggaaaagaagaggcagattttgagctgttcaccaagaatttacattaaaataacacaagctgttgattggctatacagctggtcaggaacaaaatgactttaaacaattgcccccaggcatgggtgatgggtgtggtggaggctgggggtggggtcttgtggggttgggggcaatgactgaagtttcatactcatgtctttctgggcctgagtacctcacatagctcagactgctctgaactattttttttttctcaaaaaaaaaaagtgtacttttgttaaacagtctctccaaaataataattggtcgcagccaatgccagggaaaggcagtctcccattagatagcaaattcctggtgatcagcagcttcccgataagctctcagaagttgggctagtgggctcaagcatgtgcactaacagacaaaattttttttctcaaaagaaatattttcctcagtattttggctttgttttagaagtaacaattgtccttatttttgtaaattctactatcagtttaatgatctcttgtggaacaaagggaagatggtgggaggggccaagatggccgaatagaaacagctcgggtctgcagctcccagggagaccaacacagaaggcagatggtttctgcatttccagctgaggtacccagttcatcctactgggactggctaggcagtgggtgcgccccatggagagtgagcagaagcagggtggggcattgcttcacccaggaagtgcatggagcccagaggagtggggggacctccctcccccagccaagggaagtggcgggggactgtgctacccaccagggttactatgcttttcccatggatttttgcaatccatgaatcaagagattaccttgtgagcctacaccaccagggccctgggtctcaagcacaaaactgggtggctgttcaggcaggcactgagctgcaggagttttttacatactccagtgacacttggaactccagtgagacgcaagcgtccactcctttggaaaaggggcttaagccagggagccaagtggtcttgctcagtggctcccactcctatagagcccagtaagctaagaaccactggcttgaaatccccattaccagcacagcagtctcgaatctgcctgggatgatcaagttgccagggggaggggaagcgccattactgtggcttcagtaggtggtttgggaggtttggactgggcagaattccccgcagtgcagcaaaacagctgtgaccagactgcttctctagatccttcctcagcaggcagggcctccctgtagaaagtccaccagctccagttaggggcttacagactgaactctcatctccctgggacagagcacctgtggggaggggtggccgtggtctcaggttcagcgggcttaatctttcttgcctgccagctctgaagagattgatgagggctctgatcctgatgagggcgattccctgagcacagcacaccagctctgctaagggacagactgcctcctcaagagggtccctgaccccatgcctcctatctgggtgagacctccaaacaggagtcagcagacacctgatgcaggagagctctggctgacatcaggttggtacccctctgggaagaacctttcagaggaaggagcaggccgcaatctttgctgttctgcagcctccactggtgataacccaggcgaacagagtctggagtggacccccagcaaactgcagcagacctgcagaagaggggcctgactgttagaagacaaacaaacagaaagcaacaataacaacagcaacaacaacaaaaaagaccccacaaaaaccccatccaaaggtcatcagcctcaaagatcaaaggtagataaatccacaaaaatgaggaaaaaccaatgcaaaaatgctgaaaatcccggaagccggaatgcctcttttcctccaaatgatcacaatatctctccagcaacagcacagaacagggctgaagctgagatggatgaactgacagaagtaggctttagagagtgggttataactgatttcactgagccaaaggattatgttctaacccaattcaaagaagctaagacccatgataaaacattacaggagctgttaactagaataaacagtctgtagaggaacataaatgacctgatgggtctgaaaaacacagcaagagaactttgtgatgcagacacaagtatcaatagctgaactgaccaagcagaagagagaatatcagagcttgaagactgtcttgctgaaataaggcaggcagacaagattagagaataaagaatgtgaaaaggaatgaacaaaacctccaagaattatgggactatgtaaaaagatggaacttacaactgattgaagtacctgaaagagatggggaaaatggaactaagtggaaaaacacacttcaggatatcatccaggagaacttcaccagcctagtaagacagaccagtattcaaattcaggaaatccagagaacctcaataagatactccatgaaaagatctactccaagacacgtaatcaccagattctccagagttgaaatgaagaaaaaaatgctaagggcagcaagagaaaaaagccaggtcaccaacaaagggaagcccatcagactaacagcagacccctaagcagaaaccctgcaagccagaagagactgggggccaatattcaacattcttaaagaaaagaaattccaacccagaatttcatatccagccaaactgagcttcaaaagcaaaggagaaataaaatctttttcagacaaacaaatgctgagggattttgtcatcaccaggcctgtcttgcatatttagtgcttccttcaggaagcactaaatacggataggaaaaaccattaccagctactacaaaaacacactgaagtacacagaccaatgacactatgaaacaactacattagtaagtctgcaaaattaaccagccaccatcatgatgacaggatcaaattcatacgtaataatattaacctgaaatgtaaataggctaaatgccccattaaaagacacagaatggcaagctggatacaaagacaagacccaccggtgtgctgtcttcaagagacatatctcatgtgcgaagacacacatagactcaaaataaggggatggaggaaaatttaccaagcaaatggaaagcagaaaatagcaggagttgcaatcctagcttctgacaaaatagactttaaagcaacaaaggtcaaaaaagacaaaaaagggcattacataatgttaaaaggttcaattcaacaagaagagctaactatcctaaatatatatgcacccaatacaggagcacccagattaataaaacaagttcttagagacctacaaagagacttagacccccacacacaataatagtagaagactttaataccccactgtcagtattagacagatcattgagacagaaaattaaaaaatatattcaggacttgaactcagctctagaccaggtggacctgatagatatctacagaactctcccccccaaaacaacagaatatacatttttgttttagcaccacatggcacttactctaaaattgatcaaataactggaagtaaaacactcctcagcaaatgcaaaagaactgaaatcataacaaaagtctctcagaccacagtgaaatcaaattggaactcaagatttaaaagcctactcaaaaccacacaactacatggaaattgaacaacctgttcctgaatgacttctgggtaaataatgaaattaaggcagaaatcaagaagttgtttgaaaccaaaaagagcaaagaaacaatgtatcagaatttctgggatgcagctaaagcagtattaagagaaatgtatagcactaaatgcccacatgaaaaagctagaaagatctcaaattgacaccctaacatcacaactaaaagaactagagaaccaagaggaaacaaatctcatagttagcagaagacaggaaataaacaagctcagagtggaactgaaggagatagagatatgaaaaacccttcaaaaaatcaatgaatccaggagctggttttttgaaaaaaaatcaataaagtagattgctagtgagactaataaagaagaagagaagactcaaataaacacaatcagaaatgataaggcggataccaccactgaccccacagaaatacagacaaccctcagagaatactataagcaactctatgcacataaactggaaaatctagaagaaatggataaattcctggacccataaaccctcctaagactgaacccagaagaagttgaatccctgaatagagcaataataagttctgaaattgagggagtaataaatagcctaccaaccaaaaaaagcccaggtccagaattctaccagaggtacaaagaggagctggtaccatttcttctgaaactattccaaacaattgaaaaggagggaatcctccataactcactttatgaggccagcatcatcctgatacaaaaacctggcagagatacaacaaaaaaagaaaacttcaggccaatatccctgatgaacattcatgcaaaaattcacaataaaatattggcagcagactgaatccagcagcacatcaaaaagcttatccaccacgatcaagttggcttcgtccccaggatgcaaggctggttcaacatacgtaaatcaataatgcaattcaccacataagcagaactaaagacaaaaaccacataattatctcaatagacacagaaaaggcttttgataaaattcaacaccgcttcatgttaaaaactcaataaactaggtgttgaaggaacatgcctcaaaataataggagccatttatgacaaaaaacagtcaataacatatcaataacataccgaatgggcaaaaactggaggcattgcacttgaaaactggcacaaaacaaggatgccctgtctcactactcctattcaacatggtgttggaagttctggccagggcaatcaagcaagagaaagaaagaaagggtattcaggtaagaagagcggaagtcaatttgtctttgtttgcagatgacattatcctatatgtagaaaccctatcatctcagctcaaaagcttcttaagctgataaacaactttagtgaagtatcaggatacaaagttaatttgcagaaatcacaagcattcccatacatctactgcagacaagcagaaacccaaatcatgaatgaactcgcattcacaattgccacaaatgaataaaatatcttggaatacagctaacaagggaagtgaaggacctctttaaggaaaactacagaccggtcaaggaaatcagaaaggacacaggcagatggaaaaacattccacggtcatggataggaagaatcaatgtcatgaaaatggccatactgcccaaagcaatttatagatttaatgctattcccattaaactaccgttgacattcttcacagaattagaaaaatctattttaaaattcatatggaaccaaaaaagagctcgcatagctaaagtgacagttgtaagcaagaagaacaaagctggaggtatcatgctatgatgcctttaaacttactacaacaccacagtaatcaaaacagcatggtactggtacgaaaataggcacgtagaccattggaacagaatagagaactcagaaataaactcgcacatctacaaccatctgatcttcaacaaacatgacaaaaacaagcaatggggaaaggatttcctatttaataaatggtgctgggagaacttggtagctatatgcagaaaattgaaactggatctcttccttacaccttatacaaaaattatctcaagatggattaaagccttaaatgtaaaacccaaaactataaaaaccctagaagacaatctaggcaataccattcaggacataggcatgggcaaagactttatgatgaaattgccgaaagcaattgcaacaaaagcaaaaattgacaaatggcgtctaattaaactaaagagcttctgcacagtgaatgaaactatcatcagagtgaacagacaacttatggaatgggagaaaatctttgcaatctatccatctgactaaggtctaatatccagaatctataaggaacttaagcaaatttacaaggtaaaaacacaaccctgttaaaaagtgggcaaaggatataaacagacacttctcaaaaaaaaaaaaaaaaaaaaagacgtacatgcaaccaacaaacacatgaaaaagagctcaatgttactgatcattagagaaacgcaaatcaaaaccacaatgagataccatctcatgccagtcagaatggcagttattaaaaagtcaggaaacaacagatgctggtgaggttgtagagaaatagaaacacttttacactgttggtaatgtaaattagttcaaccattgtggaagacagtgtggtgattcctcaaagatttagaaccagaaataccattcgacccagcaatcccattactgggtatatacccaaaggatttataaatcattctattataaaggcacatgcacacctatgttcattgcagcactatttaccatagcaaagacatggaatcaacccaaatacccatcagtgatagaatggataaagaaaatgtggtacatacacaccatggaatagtatgcagacataaaaaagaacgagatcatgtcctttgtagggacatggatgaagatggaagccatcatcctcagcaaactaatgcaggaacagaaaaccaaacattgcatattctcacttataagtgggagttgaacaatgagaacacatggacacagggaggggaacaacagacactggggcctgttggggaagagtgggagtgggagagcattagagaaaagagctgatgcacgctgggcttaatacctagctgatgggttgataggtgcagcaaaccaccatggcatacatttacctatgaaacaaacctactcatcctgcacatgtaccccagaacttaaaaaaagaaaaagctataaaaaaggcaagatattcaaagaaaaaggagctaggcaaccaactatattaaaatgagaattctatagtaatcacagttgaacttttgcagtgactatacaatatgctgcattatttatatataggaatgaaggcttgagaaaatgagacatcaatagaaaactattttcttccatagtaatgggatttgacttgattaaaaattattccaaatacattttctaatttcctctcttttcaactatgtaccctgaaccagtctatttagaaattatttatttggtattaataaagagaggcatgctcccaagttcaggtcaaaatctttactgactagaaactgaaaaggtcacccagggctgggaaggatttttcagttttgggtacttcaaacactttttgaagttgtctttctgaataatttcttagtaatgtaatttttatagcatccatagtataaagccctaatttaggaaaggcttgcttggtcttttcaaatattcctgttccccaaaggatgataatgtataatgtacaaggaaggaagtggtgggggaagcagtgctagcacaccatgacgttgatcagaatattctgaaaagagccacttgatggcagcaaaaggcatgttttcagcactgattgtctcattaatgaatcacaggaaaagaagggtatcttcccccttctgaatttctgaaacttggtgttgaaatattctcctgctgtgttgttaatgggctttttgaggaaatacatagtgaactctttaataagcacttgttattttgtgatgtgcttggccccttttactttatgttccaaaacaggtttaagtaacagtatgcatagatacttatatgcttgcatatgcatctatatgtttatagacttattttcatattataatgataaatactgtgtctagcactgagggaattagacatttgactcactggtaaaaatccttctgtgaactggaatgtttccaaagagcgcatactatttggggcagaatatgaagaagctgatttttttagtgttaatcaaaaggaaaagttccatttttcttgatacaaagccttttccagagaatcaattaccaatattaatacatcactatgtgttaagtatttcagagagagaaattgagaaataagacaaagtgatacaggcaattttgaaaataaatgttactatttatttgaaaataaatgttacgtattcaggacctgaacaacgtgaaggtgaaagttaggtggtgactgtaatgagaatggaatagactctgtctctctgttctgtttcctttttgataagctttagtaagaagtcacgtggagaactcatctggctgggtgtggtgagtaccctcagtaagtgtgatctgaccaggacgactgcaccaaaggaggtggcaggagagaatatctgaaatggagactttcctaaagtgtaaaatgcatggtttctttttttgttagtttgtttgtttgtttttgagacagagtctcactctgtcgccctggctggagtgcagtggcgggatctcggctcactgcaagctccgcctcccgggttcacgccattctcctgcctcagcctcccgagtagctgggactgcaggcgcccaccaccacgcccggctaatttttttgtatttttaatagagacggggtttcaccatgttcgccaggatggtcttgatctcctgacctcgtgatccgcccgccttggcctcccaaagtgctggcattacaggcgtgagccaccgcgcccggccaaaatgcatggtttctatgtgctgagggggcagcaaaagcaagcaaggataaataggaaaaataaatgagggagagactggcatagacttcgaaggctgaaagaaattgttcaagatccaattaaagtccatgcaccaagctgacttaggccttagcctctggagctcttacatttatcccgatttttgaaagaatcactaatacagtggttcataagtatgaaaagactctctggtttgtagcttcagtttctgtcgtcacagttgtaggcttcagcacataatttttctcaaggctgatttatcatttagtggaaaaaaatcagggtgaacttttactttaagcagtagtttatttttaattaaatttttgttaagttcaccattttcaacaccttcagtaatgctttctgatcccttacacaaacttttttccttttctagtcaatattgattgagtagtagaagcccaggtgcacatttttactgataagaacagtgattttcacttcttattgctcttcaagtaataaggtggtcagcctgcttccattgtttacaccggtagcttccttccaaggaaggagtgtttgtgtgtttgcttctttgttttatttattttgggaggtgatatttgtttgttttgggaggtggtatttgtttaatttattttgggaggtggtaagaaaaaaattaaatttaataaaatataagtgacctaaactgatgaaactattgaagtacaaagctaccaactgtagcaaattaaaaaaagagatacaatatgatttccaaaggtatgtagctaaacacagcatttaggggtgggtaaagaatggacgactgggaaagggttcaggagctagtgtgggaagagagccgagttgtatgttttaatgaagcccagaactccttgattcaatagctgaaaagcttgattggctgctcatacaaggctggatgcaaattctgctggagtggtgctttagataatttgttgggttcactcttaattaggctaaacattgacttgcttgtacgattaattcacaataatagcacaattaattactaaggctgggagtaaggggcagagccagttgccgagaaagggctggtggcaagaaaggctggaaatgaatggctgattctggtcaagggggttgacccagggaggccctggagaggggggttgagtaaggggagagggagaaggagagggaagggggtaagagggaggaagaagaaagagaatgagactagacttatttagctagaggaaacagcagtagggcacagtttgctgctgttaatactattggttttgcattacttggttttaatagtacaaaggtaaaatagcacagcatatccaaattatcacgagtttagttagtgttgtttgaattggtgaagttttaaaacattagtgaaaaacatagtcaatgttggatccttgttactctgtgggagtgctttattacctattcagaatgaacactgatttgacacacttaagaggtgttctgtgatcgttattcatggttgtttactccagctctcttattaaatattttatcagcttgttagagggggaaaattctgatttggcaaataaaatacttgaatgttagccccatcttaactacatagagcaaaaataatgcggaaacgttagacagttttctcattttctagaaatgagttgttatatcatttataattaatgatattaatagtgatattaatattactattcctgacatcatcatcatcattaatctgggggaaatgcatgcttccaaggtgaagaggcaaactaaatttttaaggttgcaaaaaatcttggttgtctttggctttattttatgtgggaggcagtgtgatataatagaaacagcatggacttttgtcccagcattctttagccatgtgactctgagtaaactatactttctgagcctcagtttcctcaagtgtaaaatgaggatgttagtacccatttcagggttgttgtgacaatcaaggaagataataaatgcaaaacaattggtatgatgcccaccatataatgaactcttgataaatattagtagctattataaaaacagaaaacatatattttagttgaagtactttagctctcaataaatattaattgctgtaattaaaaacaataaataatttggccaatataatgaaatgacctaatttatggcaataatattattacgttatcatgcaattgtaatagttattattaatttcatacaaaatgcccaaatgaatacctggctccagtaggtctttaataaataggaaagtcttatgccatagtacttaatgtgtaatcttaaagatacttatagagtgaaattagcccatggaatatatggcacctggcttgaatggtattggaatgcatctttatgaatgtaaagcagttccttatttgattttccataaatgaaaagtaaatattaaaatctataatatttcattagggttcacaagttatattaactaaatgattatttgataattctttttaaaaagaggaaaaatttgatacaattatggatgatagcatgggaattaataactcagtggcctgtgtgtatgcacatgttgtgtgtgtattcgttatctagagcccatacgataatgaatatctttagatctatctgagttccttcttcccagtggtgagtatgtaggaaataattactttctagtcatggaaaattgatgtatattgatagcctgaggtttcaaggcttaccaaaagttatatagtctgatttaataaattaataagagatcgcccagcaccatctgagaaagtgatatttctgtggcaggttatcctatttgttattaactccatagttattcttgaggaattgatgaaaacagttaacagagtcctattaagaaaatattttaatatttaaatatttccctcctaaggtagcatcagtgacagtacaactgttatacattatccttgctcctgagttaggaatgtctacaaactcttctaccgttctggtaccaggtcaggaaggtaatactttttttcatagtggacttaagtaagctgcctgtgctttcttaagaagagcatcacattggaattggttaacttttctctatttcatttgcctttaggctaccaccagggtaccctgacactctactttttctttttttctggagaagcaaatatgcataacataattaagttagtgtcagaagatgtgggattatgggacttgaaagagcaaaatatttacaatagtaaagttctttagaattgggacactcaaagactgatactgatttaagtaacatactaaattaatatccttatttaattttaagaaccaccactttatgtcatttacaatagaagatcaataaaataaaaacaaaatatgaagaaagggaagtattggattttgatatatattttgtagcctacatagtttaattctctctccctaaaatacatattttaaaagattaggaggggccgggcacgtggctcacacctgtaaacccagcactttgggaggccgaggtgggcggatcacgaggtcaggagatagagaccatcctggctaacgtgaagaaaccctgtctctactaaaaatacgaaaacaaaaaaaattagccaggcatggcggcgggcgcctgtagtcccagctagttgggaggctgaggcaggagaatggtgtgaacccaggaggcagagcttgcagtgagccgagattgcaccactgcactccagcctgggtgacagagcaagactctgagactccgtttaaaaaaaaaaaaaattaggaggatagttcctaggcatattgaaaagcatacattattcagcatcctatatagtaataggaaattatatatatatcacatataagatgcttatattcttttagcaaaaaacaattggtttttattgcttcagtattgcctcagatttcaatgttgcgtcaatatttgattgcttaaatatggttaatacagctacatatgcatattctgttattttaaatatattataaattatattttaaatatattacttaatgtattctagtatacactatatatatatctctatgtgtatgtgtaatatccattattaggtaataaaatctagttattaaagcattttacttttattagagaatttgatgtacaaacttacagctgagtatccaaaataaatcactgatgataaaaagttatgagtaacaaagagatacattttgaaccctacagaggcatcttaagtgtgtggagatatagttcataaaactgagacatcaacaacatttcatagaatagatcttaaaggagcaacagatgtgttatttctgttgggatgctgtcaagttaatacagggctcagcagaaaagagatgagctaggaaatttcagctctagctgtagtttaaagacagatttccctgacatcaaacagagttggttcaagaagtaggacattgacacattttgtcatagccatacaatgagtgatgatggcttacaaaggcaaggtaagaatttaggactagaagatgcaagtcaaggttggcatgattggagatccaagtcattaagattgtcatttgtggtaatagtctaaactcatggattacttaggaattagcaataagatggagctaaagtcaggagttttggagaatttaatgaactccatggacccacttcctccagcctcccaaattttgtgtacaatgtgagagagtttacagactcccagccattgaactaagtatctcagaattaggagagtaaacaggagacctcaatgataagcacttaaaactaatatgtatcaatcaggataggttagattatgcctcagtaacaagcaaatccaacatctcagtggtctgaaacaacaaagtttatttcttgctctcactacattttcattgtgagtcagctggagggctctactgcttgtcgctgtctctctgggatcaaggctgaaatagcagttgtaatgtggaaggttgctagtagctctcggggaggtctcagagcagtcagtaattgaacattctgcctggaagtgacataaatcacttctgctcacactctgataagaactaattatttggctccacccaagcacaagggcatggtaagtgcatgggcctgggagggggagaaccagaagcattttcaggaacaactctacagactactacatgagaccactcctacctctcaactagaaagggattatatacttcctgatctctttcctaaaatttctctttcctacttctttcctacttctctttcctaaaattcttctccaccttctaacacacaatgtccttcttcctatgaaggaaatatatagaatatttaaaaaatcatcccatctatggcttgacataaaaggtgtggatgcatttcacatcaaaatctagttctttttccaactatacgtcatagtgataccagttggccagtcaggataagtgtgcaataattgaacagaggagaaatctatttcatgaggaaggtaagatgtcaggattagttagacattggactgactggtggctactacgctctggttgggttcttatctataattagtactgtatacattctgatacggtcactacattcattctgattggtacttcttatgccattttggttctaaatacttcgaatgtcatccttagttaatagaaataaattagttaagttattgaatttcgaagaaaaggaacaggtcaacagaactttatggagatatggataaaacatgtataataagtcagaggaattataaaatgttataccttcttatgtctacaaatttaaaataagtcaagaacacagttggaatttgatcatttaaaatagaggctccaactgtggctgaacttttgcactcgtcctggttgccctagtaacagggctccctttctatgctagtaatgttacagtgtgagtgaggtaataattggcagtagagacatacgcattcaagtcagctcctacttctgggtaagttaggagtttgctgaaggcaaaggatgaggtcataaagggacgaatttgagttaaaaagaaaataaggaaaagaattaagttgagccttatcttgacattttctgagcagagccccacacatcacatgcatttctcctgatcttggttgaagtcagggtagacagtaagtcatgtgattgtatatctctatgaggtcttccatcacagcccagaggaagcactagactggaaaattgtaacctgtgcaaattggcttggattagagccacctgtccgtggattactctgtctctcttagagttacccagaaagttctcatctgcccaaaaggttcaagagggagtcaaaacaggcttgctcatatttttctgtaaatgttgtttactttctgtttgatattgtccttaggcatattgtatccttgccaaatgtatctgttcgaattctgcttaatggtctgagcctttttttgctttcattaaatatatgtcaaatgtacaccactgcttggactgagattaggaagagtaagcaatgagcacttcactattttttctttttataattttgacttttattttagattcagggggtacatgtgcgggtttgttacatggtattgcgtgacactgaggtttcgggtatgattgatcttgtcacccaggtagtgagcgtagtaaccaatagttagttttttaaccctagccccactccatctctccacctgctagtagtccctaatgtctactgttgccatctttatgtccatgtatactcaatgtttagctcccacttaaaagtgaggacaagtggtatttgggtttctgttcctttgttaactcgtttaggagaatggcctctagctgcacccatgttgctgcaaaggacgtgatctcattcttttttatggctgcgtagtattccatggtatatgtgtaccacattttctttatctaatccaccattgataggcacctaggttgattgcatgtctttgctattgtgaatagctgagtacttcactctttcaatctgttttctctttatctaaaccttttccactagaaaaagaaggggataagaggtgcttcctctgttccactctttaaaattcctgaaacaaaacccaataaaactataacataaataaattaaaataatacacaacattacctaaaaataggatggtttttaatttgttattcaaatgaggacacctttgaaagtgaaagaaagtactgttaataataacacagaagaaaacacatagattatgatgttcatgcctaacttaaaaatatagtcaccatacctaaagctagtaggagagaacagagagataaggagggaaggagaattaccttgggatactctaaggggaaatcttcaccttgatgcacactgagttttcatactcacttgtaactaatttgcagccaagttcagtactattaataatagagaacatgaaattattttaagataaaagctcttttccaggaataacttgtatcaggctgactatttaagaatgagttactaggcaaagaataaagtcatagaaatccatattcatagtgaagcctcagaaatggtcttagtgattgacaaaagaattgtcaaattaaggactaactcactaatttgattgcattttctgtgcccatgacaataatttaagaaaattaaaatgaactctacttttcttaaggcaaatctgtcatgccctgcctcagatttcaataggactaaagaagagtccctagaatgtgagaaatgactataactgtgtagtgggcagcctctgagatggtctcagtgatcctacttcctggtattaagcccaatcctttattcttttccccttaagtataggtcgaacccagtggatcctgcttctaatgaatagaatttgataaaagcaatgccatgttacttcttcttctttttttttttttgagtgaggcgtcattctgtcacccagtttggaatgcgatggcgcagtcacagctcactacagccttgacctcctgctcaaatgatcttctcacctcagcctcctgggtaactgggattacaggcatgtgccaccatgcccagctaattttttgtattttgtgtagaaatgggtttcacatgtttcccaggctggtcttgaactcctggactcgagcgatcctcccacttggattcctaaagtgctgggattacaggcatgagccactgcacccagccacatgttacttctgaggttagggtggcttctgtcttgcatgctctttcttgccctctctctgggagcccttactctgggggaagcaagctgccacattgtctgtatgtcgtcctatggagaggcttatgtggcaagcaactatctccagataatagccaggaaggacctgaggcctgccaacaacctcatgagggagtggaagcagttccttcccagatcaagccatgagatgattatagcctcagccgatgtggtgattatagccttttgagagatcctcagccagaggatccagctaaattgtgctctgattcctgacccacagaaactgagataatgaatgctttctgttttaaactgatacatttggtgataatttattccctagcagtggataactaatgcactgcatataaaataaaatagtgtgttctgaatgatgaaaatacacagaaacatgcgtgtgcgtgtggacacgcacacatacacagaatggctacaaaatccttatgtgtgaaggataagagtttttcctatgctctcctgcattctctgcgctgattttattttttgccatgtgtttttctggatattttcttctatgtttatggtagggggactttaaaatggttccacagaatattagcaaataataaacagaagacttaggctcaggcatagagaccacatatgatatttattatacagcatatatttgggagaagcactattgatctttcttattgaatgcaaatttttcctgtgagttttcataaagaggattctctaaaatgtagagaacaccttcagtgacatttctaacaacatccttaccgtaaacagaacaatgaattttagccggctttcttttcaagtctgtcagtatggtctttatttgcagttttaaggactagcctaattgtagcacatggcacccaagtggaacttactagcctccaaggagaatatcttgcatatttgactttttcaacaatatcaagtgtcatgacaaaggagttcatcaaatttcttctgcagatggatggttgtcttttgggaatggtttaagttctacttgtgacaaaggaaaaaataattggcaggtaacaccatttttccggctatatagttctgtgatttgttgtctataacttaacttttaagttatttgttccaaaaaggtaaatattcagcttgaaaagctgctgaaggaagattaagtccaggctacatctcatcctattctgctataggggtagctaaaaccctttgcagaattaaaaaaaaaaaatctctttagcacaatacaaattattagagtcatcagattatagatgccatataccacattaatctaggaatagtggtgtaatgctgtttcagttatttatgagaaagtacccgtatttaaaactgtttccagaattggcagtttttactgcagcctgcacatggggaaataattcttattaaaatcacttaacacttccttatgagctttgtgtgacacgcggatttatgtgcatgtccttttagtaggaaatgagtttgaattttactttgggaagtaagatttatattgtaagcggaaatataaaaagatataataaaactgttttggctggtaatgtcacagtatcactaatcaaagaaagcacaacagagccatagaaatatctttttactttacagaatgaagtagaaaatgcactttaattgctgtcaagaaaagatagaagcaaaatattgtttgtgatagatatctgttagtgtacagtacagatttatcaaccctttaaaacttaatttaaaattggccgggcgcggtggctcatgcctgtaatcccagcacttcgggagactgaggtgggtggatcacgaggtcaggagttcaagaccagcctggccaagatggtgaaaccccgtctctactaaaaaaaaaaaaaaaaattagccaggcatgggggcgggtgcctgtaatcccagctactcagaaagctaaggcagagaattgcttgaacctgggaggcggaggttgcagtgagccaagatcgcaccactgcactccagcctgggcaacagagtgagactctgtatcaaaaaaataataataataatttaaaattatattttcatcctcgtatgaaaacccttggaggcttctggcattcaacttgtacttcttccattctgtcatctggcaacttgctgaatattccttctctctcactaaaaggtttctgtgcctgtctcacagtcttggtctttgcttcaagtcttgccatcatcttgggtgtttctaaaatccatacggtcacctagggactctgtcaaatcatccagtggatgcttcccagtcattattctccttaacctctttctctctccatcccttgacacttatcaccattcctgcctcctggaaatactgtatttccttggttcctaacaccattcactctcctcctctctttaatctctcctctaggtatagcagtatctccttatccccagtttttctttgcagtttcagttacttgtggccaaccatgatctgagaatattaaatggaaagttccataaatgaagaattcataagttataagttgtgagtcattcttagtagcttgatgaactcttgtgccatcctgcctgggatgtgaatcatccctttgttcagcatatccacattggatatgcaggaggcaggtctcggttatcaccgtcttggttatcagattgactgtcaatgtacaacagtgcttgtgttcaaggaacccttattttacttcataatgacctcagtgtgcaagagtaatgatggtggcctgttgttataattgctctcctttatttatttatttttattattaatttttttttgagatggagtcttgctctgttgcccaggctggagtgcagtggctccatctcggctcactgcaagctccgcctcctgggttcatgccattctcctgcctcagcctcctgagtagctgggactacaggcatctgccaccacacctggctaatactttatatttttagtagagacagggtttcgccatgttaaccaggatggtctcaatctcctgaccttgtgatccgcctggctcggcctctcaaagtgctgggattacagacatgagccactgcacctggcctgctctactttattataaagtattgttgttaagttcttcctctgcctaatttagaaactaaactttatcataggtatgtatatataggaaaaaacagtatatatagggttcagtattatctgtggtttcgggcgtccattggtggacaagaggggactactgtactgcttttcagttttctttgggctctcatcactcagggttttaatcttgttttcttactctagttaggctacttgtatggacctacctttctagcttgattcactgtctttatgcaggagattctaaaatatgtatgtctacccttgatttttttttcagctgaatatcatactagctactagaaacagccatttgaatatgtcaacggtattcaacctgatagtctaaaattgaactcttcacttctctcaccctacccttgccaccctctctgttccatatcaacaaatagcacagttatgtacccagtagctaaggccagacttacgtgtgttgttcattcttttttttcttctcccttacctcatgcatatagtaaatcacaaaggcttattgattctacctgctaagtatctctcaaatccatttaattagtcctaccttactgatgctctccttattatttctttcttggattactgcaacaattgcccttcctagttcaatatgttcatgtggtggtaattcctctaaaacatttatgtcctggcttctaactgttcactgaacaacttatcattgtcttcaaaattaagtccaagtccttcccgtgacttttactactctaagtaacggccccagcttatctcattattctgctcttttgtaatttttgcccaaaggctaagttccatccaaagtgaacttcttttagttctatgaagaggactttctttttcaaacctctaggtcttgatataaaccccttcagcccctaccctccacgccttcactgcctataccctggcaagctcatacttattcaggtctctgcttagacatcatttcctctgggaaaactttcctaacgccttaaggtcaggtaaaatgtttcttctgtgtgttcacatggaaccatgtgtcactcacatcataacatgtagcacaccatgtccctcccacctccagtactctagatgaaaattattgtttatgtggcaagaacacttaacatgagatctgtcctcttaacaaattttaaaatatacaatgcattattgttaactgtaggcacaatgttgtatagcagatgtctagaacctaatcatcttgaataacgaaaaccttatactcattgattagtaacttctcagttccccatccctccagcccctggcaaccactactgcactccctgcttttatgtgtttgaatattttagatacctcatataagtggaatcaagtttttttatttgccagttcttaattggattattggcttcagggtggagcccttggaggaacagggccaggataacatgcattgttagggcctaataggcacagctgaaggcaaagacaaatccccaaaattaagggtcccattttatactggatcttagatccccaacaggaaggagatactatgggagaagacagcacatatcatgcatttcataataaggcaacccaaagccaatcaacttattttgtaatcagcccatcccccatgggaatctcatctcttagtgtggggggtggggatgtttctgtgtccagagttggttccttccggtgggttcttcatctcactgacttcaagaatgaagccgtggacctttgcggtgagtgttacagctcttaaaggtggcatggacccaaagagtgagcagcagcaggatttattgtgaagagtgaaagaacaaagtttccacagcatggaaggggatgcaagtgggttgccgctggtggctggggtggccagcttttatttccttatttgtccctgctcacgtcctgctgattggtctgttttacagagtgctgattggtccattttacagagcgctgattggtccattttacagtgtgctgattggtccattttacaaacctctaggtagccacagagtgctgattggtgcgtttttacagagcacagattggtggattttacaaacctctagctagctacagagcgctgatggctgtgtttttacagagcacagatcggtacattttacaaacctctagctaggtacagagcactgattggtacattttacaaacctcttgtaagacagaaaagttctccaagtccccacttgacccaggaagtccagctggcttcacctctcatttgcatatctttcaggtgaccaagagcatgcttctgtgattcaaatgtacaaagagttaagtatccctccttaactattagttatcttttaaagtatatttcctacctagttgttacatatcaaagctctcataatatgaagtaatttgatacccccaaaactaaaaacttagataacacagtgtaaaacagaacagagcctatgattttgagagggaactctctgcttttaattcctagggtttcatgaagaaaaaaggtttttttctgaaaacaggttttttcccaaaatagggtctgtgacacctcctttgtttttcccaaggagtcccaggctaccagaatttatcttaaggcctctcatgtgtgctttaagagtggcaagacaaaaaatggagaaaaataattcagtcgactgagaaggagaaaaaaatttccagaaaaataagattcaagaagagaaaaatgtaaaggccttttaaatatacttgtaacttggatatccacttttaattaagctgagcactctttaagaaaatccttctaaatcccttgttacttgactttagccacaccaagcagttaagattttcggcttttgaactttacaaagagtaacctcacaggtgaaaccaagaagtcttaattaggttatgacttaactgcgagtgtacaaggaattttcaaaggggtgataagcagcttttgaaactgtcattgcatttggttgaaagtgtgagacaagatcagcagctctttgcaatggcatgtaatttcagattatcatatacttactgttgcaagagcctggtattcaaagctgctacagcaatttggggttcttggctttggactggtttcccagatgttataattctttctgggacacttatttagaagtctactgtcaaggaagccacatgtgaacttctttgactattcctaaatcaggatcataacccattttcatatgccacattatagtgactttaaaatcttttaagtagaaatgtttgcttgggtagtgagactttttagaagcaaaaatactattttgtatcttttttgtcagtttagattatgttaaacaagaagtcttttggattataccagaatttacttggctctttctgcaaaacttctctagtcatcagaccatagaaagagggcttgattaaattgaatcaagtaactttttctatacccttcagtgatttgactttaagccacagttggaagagaacagtttcctgcctttgtcaggttctggaaagatttatttgtttcactacctatttcttcacttgacacagagtagtggcacgttattgttttttcttggagactgcagtgtctagagaaactctaattgtacttctctagttgaatcccaatattaaagtcttttaagtattttataaaggcttttaagtattataaaggctttagcattttaaaatctgactttattcagaaaacttttccttttataggagaatattaatattatttatttaaaatgaagggatatatagctgggaattatcctttagaaagtatgttttgtaaaggacttgttctatttctgagttcttgtttctttcacatgttttaagaaagtgctgaatgattgattaaataaactttagatcggttaacacctgatagtgagaagactgctccttggaatttctgttttaatttctctttatcctcttgtctaataactatgataggcaaaatttatgatctgtctctctatctcaacttaccttgttccagatgtacatttttgatgtctgttattccagttatcatgtatttaatataatttcctcatttgctacaacatggaaataggcttttttactaaaaattataaagtaattatgtcttctatgtttatattcttaataatattgacatatctgttaataatatgtaatgctaatgaataatttagtttccttagtgatagtttccatgatgttataactaacatccctacctatgaaaatgtagggagctgtctgaagcccaggaaggtcaggaaggtgttaagaaccaggacaatgtatttaacctatcacaatcaaaatgccattcagcctttgccctcaatatttgacagcaaatgaatttgtcattttctcacaaatatcctgccttgagctaccacttgtctgccttgtaactcatcttttccatgacctagttcttaacctggtttttgtctttaagttgtcactataaaatctctaactgggagatatctttggttgcattgttcctcttattagtctcaacacctcatatttattattatatcaaagggtatggtcaggaagacaaattgtatttgctagaggaaaaataaaattagttctgtgtgcccttgactctatatatttgtagtggttttggggtcagactctgcttcaaatcctgcttctgccacttctcaaactctcttgtcccaggtataataattatagataatagttatcaagacctaactctttgccaggtgctgtgttacatgattgatgtgtatcattttatttaatgctcatgacagtttaggaggagagacagaccactaacagaggttaagtagtttgctgaccatcatgtagctgatatcatgtcaggcagagtcagaattcaaatgcaggctttctcgctccagagaactggcagtgttagctacatggagttttcctaggtataaagtaaaaatgataatatcgtatctacttcataggattagtgtggtgattaagtcatagaatatctgaaaaatacattctcttctgtttaaaataaacttttattcaccaaacattagcagactctcagggaacattgcttttatccattaaacaaaggtgatctttgctggaaacccagtggctttgtgatacaattcattatgctggactaaaaagcagaaagcattatggctttaggatgacatggaaaaacatacactgaaaagactgatagctggatgaccctccacagtatctagcagcatcccactgggctctggatctgccagattcctcagcctatcagtctttgggatgatggtgagagaagtagctaaaggaatcagaattacaaaaagtatccataggatggtgtgatggcttgaaagtaccaggactaaaatgagagacaactttaaattctacacttgtattaagtatctccccgaaaaatagagaagtttgtttttagtaaagctcttacacttctagtcgactggaggctaaatgggaatcaccagtgtgacatgactgttaaaggagctaatgagtcataggtagcattgttttctaaaataaggaaattaatagtacactgcagtatcagaccatgttgcccagtctgtcctgcagactgtggcagagcaacagatgaaaggatttctcagacacaggtatccagtaaaagagtgggctaggggactgctggcactaggggcccaagagagttagcagcccccctaagctggcaacgctcacatttatttagtacagatttaatgacaaaggcttggagcaaacacaatttgtgggtaataaacattgtcgaccccctgagtagagagcatcctaagcacgaatcatcaaaggttggtttctggagacaggagtaaacaaatttatctagatcgatttctttacattcccttattatctgccctcaccctttgccagggtaagaacagctgctttcagctcattcttccctgaagctttgcaaaacctcctggccttccaagaaggtttgcctttttccctataatttttataacttttcctaccagcctgactgatctcctacatctcccccttttctgatttttgcatcaggttttgttgattgaagagtatagatgtgtgcagcaacaggtttgtcaggtgccacggttataactcatgttctggctttgcatcctagaattagtaaataacataagacaaacatgagtataatcagtaacattcttttctaatcaaggagtgacatgtagtattacttggcacctcagttcaatgtgtgccgttactaaggaaccccccactaggggtatgttaacccctttcagctaagcagttatgttattagagactgcccaagtaacagggtggaagaaaggcagatctaagagatgagcctaatagagtgtagcaggtgcaggttgcaggcagagcgagagcataaaaaggataaataccctatgagagttgtgatgtacaacagagagtatagcaaggaacagattatctgaagtgaatggtgtctgtttctggagcaggattcactcagcctcctgagttgtcttcttcagcatttcctaggtaatgtccggggcttgtgtcatccaaggaagctgcatcatccagggctgcgggttctgcagggacatttccttcatttctgataccaggttgggtcctagccacaccatggtatgggtttgatgtgtcgtgctggaatccacagaggacctgagggggtatgaacacaagcatattctcttccccatgttagcaatttgtttggaccactacatacattactgtttacatctttccataaaactgcgggttttatgtctagagaggttttagcaaagtgcttttctatagctaattggaatttattatttaaatttaaaaaattaaaggtaaataaggcttgtgctagtagtgttgcagggtccttactcatattcccccttttttgttttctgagcatatttttaagagtggaatggacacattctactgtggcctgcccttgagagttatatgggatgcctgtggaatgttggatgttccacatgtggcaaaatagttgaaattgtgagctggcataagtcggaccattaccagttttaatttttgtgggccaccccataaatgcaaaagttgagagaagatgtttaataacatattggttggactttccaggaagagcatgtgtgctaattaggtgagaataggtgtcaatggatacatgtacatatgtagttttagttttctgaattcagggacatatgtaacatctgtttgccaaaactgattaggttctagtcctctagggttaacacttgttgaaggaggggacatgcctgtgagctggcaatctgggcattgcaggataatttgtttagctagtctttgggtaagttgaaattgttcagttaagttcctccagttttggtggaaaaattgatgtgattgggtggcttggtcaagcagtgaggtcataacttgcaggtctgcttgattattactgtaagccagtgggccaggcagtgagctgtgggcttgaatatgtgtgataaaaataggacgtgtatgttgatccagcaattgctgaagttgaagaaaaagtgcacacagggtgggctcaagagtggacttaatgagagctgtttcaaggttctgcaataaatagagtaagcagagtcattaataatattgataggctgaacggaaaaggtctccagggccaatattaaggctctaacttcagctctctgaatgttagtaagtccagaacgagtgagggaattatgtggtctccaccaaacagccacttttccatttttaccagagctgtcagtaaaaggtgttaaagctttaggtatgggggagtgaactacttttgtaggcacaactacaggagtacgagataagaactgaattagtttgtcagcagaaagggcatgctctatatggcctgtataatcagagagtgttatctgaagatctagagataggggcattattgcttaaaattgctttttacttgaagtaattcttatgacatcagggtcataacctagcaactgattgcatcatctgtggcctgtatagatgagtttactacctagctggatatagggagatagtgttttagtcccggtatgtgagcaaaaatctcattctaggaagtatagccttggggccatctgtcctattaatcttgttggggaatgtttagtaggaaaaacaaacaattggactgaatattttgggtctgtgcaatctagttgcctctgagaaatagtatgctctatttccttaatttccctttttgctgcaggagttaaatgcctgagagagtctagggttgtattgccttttgggatagaaaacaggttttgtaacttatcagtagttatgttcaaggaggggcgaagccaattaatattacccagtaatttttgataatcatttaaggtgtgtaagttgctagtatttaaccttttgaggtcttattgaccaggaagttaatatgtatccaagatacttccaaggagaagacaattttactttctcaggtactatgattaaacttcctaactgtgtgttctttatgacagaggcatataaacttaaaagtactggctccactggggctgctagtaaaatatcatccataaaatgaataatcttgcaattaggaaattttttttctactggggagcaaagcctgatttacatgatactgacacatggtaggactgtttagcattccttgaggaagtactttccaatgaaattggtgagctggcctttcattattgatagttggtattgtaaatgcaaatttttctctgtcctgttttgcaaggggaatagtataaaagcagtcttttaagtcaacaataactataggccaatcttgaggaatcgctgtgggggaagggagggcctgttgaaggggccccataggttgcaaattagcgttgatagcccataagtcatgcaaaagtctccatttgcaagatcttttgggaatgacaaaaatgggtgaattccaaaggctgtttgatattctatatggctggctttaaattgctcctcaactaattcatgggctcgtaatttctctccctttaaaggctactgttctatccaaataggactttgagagagctatgtcaggggtaggggaggaataacagtggccgttattagaaaggggtctgcagagtgacctcaattaaccctcttgtaaatgggctagcggctccattttctctaatgctttttcttatctcttgataagcgtcaaaagaaatgggttcatagaactgattgccttgttgatcttgtattactgggcaggctaagagctccccttctaatgacacttgcctaagatagggtcccacagctgtagtgtatcccttgtcttttttccaatttattggaggagggggcttaggcaaaacctgcatttcctctttgttatttttgcccagtaatggcttggctgagggagaaggaggaggtagtaaggtaggtgatagttcttcctccctttcccatttaggctcttctgtgtggagtgggatcaaagcagccctaactaaagcccataatgttagagttgttactgggaccctttgcctttgtgcatgatattgtttaagatttcttcccacttgttcccagagttctacatctagcgtaccttcttctaggaaccatgggatatgggatacaacagtttgcattaggtcccttaattgagcctatgaaactgaggctgtggtagctttaagcagctgcttcaatacttttatatactgttgctcttgagctgataactgttgtcccatgatgaaaccctagcctgaataattcccttaaacttggaaatcccgagtgggcaccaatgacttactgacttactgactgtgcagtctcttcacttccattttagagggttccattgtgatctgttgcagtattcctcacatggggtaccacctgccaagtctgtcctgcagactctggccaagcaacagatgaaagaagtactcagacacaggtatccagtgaaagagcaggctaggggactgctggcattaggggctgaagagagttagcagcccccgaagccggcgatgctcacatttatttagtacagatttaatgacaaaggcttggagcaaacacaatttgtgggtaacaaacattgttgactccctgagtagagagcagtcctgagtgtgaatgatcaaaggttggtttctggagacaggagtaaacaaatttatctagataggtttctttacattcccttattatctgccctcgccctttgccccagggtaagaacagctgccttcagctcattcttccccaaagctttgcaaagcttcccggccttccaagaaagttagtgtctttccctataatttttataacttttcccacaaccctgaccgatctcctacaccatgtctagcacattttcaccacatctcaagtctatattcttgaaggttcattggccatttgattatatttggaggccagaccacttgaataaaggcttttctgaccattttatttcaggaattgttcaatctgggttttagcttggggaatattatcactatcttcaaatacttgaagagctgtcatgtataattgggagtagacttaatctgtatagtgctggagcacagaaagaggaaggatgaatggatcatagttatagagcttcagttggggcttaatataagcaataactttttaactgttagagccacgtaaaactaaagtgcctgctttgttggtaaagcaatgagttccttactggtagaagtgttcgagaaactgtgagatagactgcctatcagggagaatatagataagatttctgctttgagtgattggttaaaccttctgacttctaatacctctacctagtccaaaattctttagtattacaaaaaagatacaagtgtttgcaatagagcaaagtattgcctcaaaatgaaatctaaatgaagagaaaatgggttctactacaaaaattaccttttcaagagatgttcactcatatatggaattgcaaagaaaaaaaatgtaggtatcatagaagcagagagtagaacagtgattaccagagataggaaggtgagggggaggagagaatggggagaggttggtcaaagagcagagagttacaattagataggaggagtaagttgtggtgttctattgcacagtagggtcatgatggttaacagtaaggtattgtatattacacaatagctagaagagagcctttgaatgttctcatcacaaagaaaggataaatgcatgagttgatggatacaccaaataccctgacttgatcattatgcaatatatatatgtatcaaaacactaaattgtaccctgtaaatatgtagaattacaatatgccaatgaaaaatttaaaaatttcattttaatgtataaataggaatgtgagttcattcttttaaggtgagactacaaatgtcagagaaaccagatgtgtgggtcagctaaaatagtttccccgaggaatacaaaatgatcagaagggtccagggtgagtgtgaatctgaataagggaaatgggtgcactactgagtggctaatgacagcaggttctaatgtatccatgttcacaaaagggagatgtctggtaggcaaactgagtctacacactggcttcacgttaggtacaggaaaatatggttactgctaagaaacccccatactctttgttttctaacctttttttttcaaattaaatgcattaaaaaataataccttctaccttttctacattatgtaattatttaatctacttccctacatatacttgacaaattattgagatggcatcttaatattttctgcttagctcattctgggagaagaccttcttttcctcttaaaaattatcttgtgtgcttatccctttcaggaaaaatcacagaacaaattcctcagtcacaatctctcctgggagataaactgtgaatagaatgactcttcttttacttgttctgtcatattgccaaatagaacacagagcgtattcacatattatgtattttgtttagaagctcagctatcaaagacttgagctatacaaatttcccggagaaggtattttgaccccttccatatgctacctcattttccctggccaatgatatccttaatctattattctaaagcagattaacagatctcatttttaaattcttattataaagttgaataaatactatgcagttaaaggagttgcatcataaaccacctcaatgtttagaagcttgaaacagcagccattttatttgattgctgatctgtgggccagcaattcaggctgggcttagctggatattcttttgcccatctcaagcagctgttttctgacatgctttaagatgaccttactcacacgtttggtggttctggctgtttgcaggactacaagtctctggtaggctttgcaggtttgtttacatggtggcagccttctaaaagtagcaagaaagagttcccagcaccaagagggcaagatccagtgcaggagcaattcttaaacttctgtttgtgtcatgttggctaatacctctttggccaaagtaagtcccatggccaagttcacagtctgtgaggaagagggccatgtagggtcatggatacagcgaggtgtaatacactaggagtcactgctgtagcctgtatcacagtttgcacatgaatttataggttggtgcaaaagtaattgtggtttttgccattacttccagtggcaaaaactgcaattacttttgcaccaaccgtgtgtgtgtgtgtgtgtgtgtgtgtgtgtgtgtgtgtgtgtgtgtatggttggcatttaatatttggctttgatcaacatagtatgaggatttactttatatataagtaacaaagagtagtgtgaacaggagggaattaatctacattgagaacttatgatatgccaagaactttacatatgttatctcatttaattttgtaaactcagagtgaaaaaaactgagatacaaggaaggtaaataacttgtccaaggtcacagttagcactttacactccagtctatgggactcaacaagcattaaaaaaatcaaaaaagaacagaataaaaaatatcagtaatgcatatattaataataggtactttttcataaactgtatttgcttttttgtgttggctcacaatgcataatagaattcttgccatgaattgtttgtttttgtttttaaactggaaagccactgttaccccatatagactcccataagcatgtgaaaccagaatggtcagaaccagaggggattaaaagtatatcatggctgaatggggtggctcacacctgtaatcccagcactttgggaggcctaggcgggtgggtcacttgaggtcaggagtttgaggccagcctggccaacatggtgaaaccccgtctctactaaaagtacaaaaattagtcaggtgcagtggtacacgtctgtagtcccagctattcgggaggctgaggcatgagaatcgcttaaacccgggatgtggaggtttcagtgagctgagatgacgtcactgcactccagcctgggcgacagagtgagactccgtaacaacaacaacaacaacaacaacaacaacaacaacaacaacagcatatcattagtttcccaatcctgatttagctgaaaggtgtaccatgactactatattacattgagatagtgttttcatcagatgaacacctgactctttccactgcagttaatctccttttatcagtatctgctaacatttctttgtgacttacagaaaatcattatcatagggagagatttgaattctgggtggaataaattagaacatcaatttcccctattgatagacccttgtaggaaccaataactagtacaagagacacttaaacaatttggatgtaatgccttgtgtttgaaccaaagcatttattactcaaatatttagtccaaagaggtaaaggaaaagtattattttgtaatctgtttttttttgttaatctcatttgtcttcagtcatgcaaaatggaacgtttgttttaaaatcagcccacataccgaaatgtcttttatttgcaaaatgaaaccatgccattaaatgttgaaggagaaagattcttttaaagaaatatcaatgaaatgggagcatttccaatagaaatttgagctgaaataagttcctgtgtgatggctttatttgcaacttctctctttgagatttttttttgtacttacctaacatgcataaagattgcatattaataaactaggaatcatttgatagaaaacaatgggagggaaatgtccataagttcctacatatctctacatgcaaagaggtcaaacggttgcttgaaattctcaagaatgttttatagattgaatagagattttttttaaagccgttatcttctgtgctcaccaagtaaagtgtgggctagaaagttattttaaagtcattttattgcaagaaaaacagcaggatcctgccaaagcccaaaagccagtaaaattgcaatgaaacattgaaaattacaaggtcaaagctttatattcatatgaaagtaatatttgaaccaaaaaaggtgatatacttttaaaaaaatttggcctattccaaagaaacactgaaaaacaaaatagctgggttatttatcattgtatattttgattgttaccccaaatttaagaaattattagtgaagagcataactttttacatattaattatgatagttattcatttaaaaagtgcttgcaaaaaataattgtggatgattatttcttactgattttattttcaaatgtttgtgtatggaacattgttttggaaggaaagatttagcagcatcactcagcttataattagtgtcagatatgttaataaaaactaatcaagatgttggtaagcaaatgctagaaactgaaaatgaaggtgattaaaagaaagtaatttctgaaacaagctaggattaactgaggatggaatcccaacaggatttctgcttttgttcattggccttgcccgtcactgctaacataatatgtcatgctgaaagaacaaaccttcactgaggggtccagaggacatacttcaagttgaaagttctatgtttgttggttcaacaatgctgagttaattacattttataattctgctatacttgaattctaaattgcagtcccacgtcttgtcttaaattgttattattatttttttggtcacacattttattgggaaagaatcaaagtctgaatgaatgatatttattctagtgggctctgagatgtaatacaccaggaaagaaaaattactgattaaagtgaagaaaatgactatgaagttattctgttcagttgtcttaacaaagatgaatgtgttttaattaatttttttgtgtaaatgtaaattgttaatgttaaaatgatagaggttaaaaaaatcaactgattacagaaatttttgaaaatacagaaaaatataaagaagaaataaaaatcatctacagttaatgtacttagaagtactcatgattaagtttttgatataaagtatttttcttttccttttgcattctcttttaaatgatagtataactggatataggattagaatttgactattattttccatcagcactttgaagacattactttgttgtcctatggcatctattattgctgatgtctttatgatttttttccttccattactgcttttaagatctccttgtatttgaagttctgcacttcactacagtacatctaaatgtggatttcttttcatttgtcttccttagaacttcgtggtattcctaaattttagaatcaatatctttcagactattggaaaattctcaaccattatctctttaactattacctctcacttctgtaacatcctttctggaatttcaatgagacataaattgaaccatctcatcctattctcagtttctcttaatcattctgtcttatccttcacctttctatttctctgtgcatattgatgttatccacaggtgttttccagttcactaattctcttttcagaactccaaactgaacttctgctgtttaacctaccaattagattttaaatttaaggctatatttttttatttccataagttttattttattcttttttaagtcatattttctcccttctatacagttatgggctaaagggctaaatcatgtccccatctcccaaattctttcgttgaagccccagcccccagtatctcagaatgtgattatatttggctacagggtctttaaagagatgattaaggtaaaatgaggtcatatggataggccccaatccaatatgacttgtgtctttataagaagagttaaggcaccagacacaagcacacatagagagaagacagtgtggaacacacaccaagaaggtggccatctgccagtcaaggagagagcctcagaagaaaccacacctgccaacaccttgatctcagacttctagtctccagaactgtgagaaaataaatttctgttggtttagttacccagtacatgggatatttcttatggcacactcaccaagtcatgcacatgctagagtgattttttaatgtgacttttatcattttttgatgtctttaattctgtttaacatattttaatctattttctagctttttatttctgttatcttgtccctatgatactcacattgtcttgtttagaatgtacattttactgtgaattaacctctcaatgaagcttttagttagttttttttttttcccttgggagtcttatgtgccctgagtcagttgaaaacatattaatctaatggacaaaaaattgagtattattttaatttgtgttattttaggtactaatgagttagaactttttcatgtgcttgttagcatatgcatttcttctttcgtaaagttaggagcagtgttcatatttatccctataaaataaaaacatgtacattaatcatggactacattttgttctgatgattcagtgttattgatttctgagctctgtaatatctgcaagttataagtctttcttggcttcctccaggaagttgaaaattaatatttatttctatatttgtcaggaaaacacatgaatgtttgaagatggggtgggatcttgtttttaactctatataatatctgcagttaatcatggcaaaccaccagtttcaatttgtcagggtattgttatcatattctaattttgtatcaactaaaataatatatttctttttggttgaaatgcctttagaatcttagaacaagccttaggaaagacattactacctatggaaaacatgaaaatttgaaatattgtaatagaaaggtttcatttaaatatctttttataatagagtaaaataagatactgtgtggtaataagccttcacagaattgggcacgttggattcacctatatattaaaaaatgtgtgtatgtattagatgcctggcagcatctagtaaaatgagatctacatgtgtgaatttgtgttatttaacccttggcttaaaagtaccactcacagaagtagaagtgtgagtgttaaggttttgcttatgtccatatatatcacacacatttttcatattttaatgaccaaaaatttggcagtgttacaattaaattacattcatatggtagtgctttatttcttctccttcaggaaagctgttattaaattgcagcaaattagaatgaaagtatgtagtcttgagaacatatggactgtaatgcattggaaaattctacaaagaacagcatgaagtatttcaatggttagcaatgggaattgcatggtgataggttggggtgtgtcagtaagagttttgtgggtacaatgtatattatttgggtgatggataccctaaaagcctctgatttcaccacgctgcactgtatccatggaacaaaattaatgtttaccccataaatttatacaaatattaaaaaacaaaatgaaataaatatgaggctgctctgaatgatcgttggtattttgcaaaacgtttacaagtatgtatttaagtgtttgctaaacataatacgtaaataagaaaccactgctttttaattataagcaccttttccttatgagtttctaagttgtagataggaaatagctgtcacctcagaacacaactacagttgataggtagtgactaagtggggcaatgttttcaaaaggattcaaaaaccctccctatactcagtgagaaactatcatttttcaataagttatgtttactgtgggcaagggaaaagggagcggtggtaccagtatgaggcatttactgactcttctccaagtgctaataagatagcacatgtcatgttcaattttttattggtcctgatgaaatatttaaaaagtaggtttacaaatagataaaactttatgccttccaactttatatttctgggacaggttttcagaatctgttcctcttgggcgtatgtttatattattcattgctttctagtcactgtgcttgattcagacctccctggaatgggaagtaggctgacaggtagttttgcagttatgctttcctgatgactcatttgtatttgaaatttagttttggtttcataaatataagacctagaatctctctactgctacatttttttttaaacggcaatcttattctacattctataatttgttctacccgtggctggtttctctcttttttcaaagaatggttgatatctgtgaaagcagagtaacatttggatattagaaatttcaattgcaagattccaatcagagatcgatgacctcttttaattcaaatgtatttatttttctggacaattgttttctctgttaggggatgctgtacttagctgtttaagccttatgagaatgtcatagctcttgttaggaatcctagatccataaaatctgttcctctgttcctccagataattattattaattattgttattattttaatttatgcctaaaattttagcctcaaacaataatctggagtaattgatcttcatttaagaacttagatcttaaaatctgtcttatcttgtggatcagtggcattttctgactctgaaacaaatgtttatttctgtgttatttctgcataccttccatacaatgcctttgaataagacagtgactgtattatctactagctctcagatggcattttagactatatttctaaaatgggaaacatgccctttggtaagatttaagctagtacataaatcaaggccagcatttcctaatatggaagctgatctgccttaggaaatattaattataagaaaattgatttaaaaaactcttaaagatagttcttgaagtagaggatattagagcaatggatcatcatcctttagtctagaactctgtcattcctggcagctgttaaccatctgcctgctttcaacccacgtgaaaaatgtagatgagcacaggaattgagggtcaaatgaatctgaggtcttttttcttgcagtttaaaaacttagactttacactattttattatccaaaaatgactttaaggtaactccagatttccttttaagatactatcatgggacatttcactatcctttgaagttttagaaaaaagatggaattgagcactactggcttttaatctaaaaggagagggcatttataaagtgatcttgtattttaatgttttcatacctcacaccgtaaaagattttttatataacttatgatatcatggtccattcctctgaaatatatacatttaataggatttgtgtgcctctttaattctttaacattaattaggatttagtgtgctggatctttcatccaaagatctcaaagcatcttgcctgtctatattagctcattattttttcagtatgtccctgtgaggtagctgttaagtattattccttattttacaaatgaggtacagatgaagctgagagaggcataagagacctgcccaaagtccccgagcatgttaatattagaaaagcaataaaggcacagttctctgatttgagagattttcaacctttccttggaatatatccctaattccattctaaaatgctacattgtccatggaaattagcatattattatacgctggtgctttagggaattaaagtggacttaagaatttaataaaatatcactgtgtctctactatactttgattaggttttcagggaaatatgtgtgatcagtgtcctgtcacacaaagctaggtatttccgtttgccctgtcatatggggagcactgaaagagggcctcagaaatagtagccagagaatatggtgactgcaagtgtgggtgacactagcgatgattttcttactggtggagaaccttgcaagctcagaggtttctcttttaatgatcaagtcatgcatcctttaaattcctccaattataaagtcgtcggaatgttagtattattaggggccttaggattttctgagaaaaacttccacacaatataggattttgtttcaaaatatccttgacaaatcgtcacatagtctccatttgagcacctcgggagataagaaattgtccaagaaattttgttccactggataataattgtaataaccaatccacaaatatttattgttatctatctatctatctatctatctatctatctatctaatctatctctgtctatctatctgtccaaaatgaaagaaatataagatattgtccctgacctcctcaaggacctcggccaagtaacttgatttcaatctgtttcctaatgtatataatgaggaactggcttgttttgaggattaaaggaatcaaatataaagcacttaggaaagagactgctacataatatatgctcagtaaatattagttctaattattatctacggacaaaatgagagagagagagagagcaagagtgagagcaagagagagattgcttattacatcttattttgttttccatactatcatcttaaatgagaccgtcatccattctcatttgaatgacggcagcagcctccaaactgctctctccgtttccagtctcagcctttgtgacccattttccacactgaagccaaactgaacttaatgcaagtttgggaggcctaggcggacgggttgcttgagcccaggagtttgagaccagcctgggcaacatggtgaaaccccatctctaccaaaaaatatacaaaaattagctgggagtggtggcacatgcctgtagtcccagctactcaggaggctgaggtgggaggatcacttgagcctgggaggtggaggttgcagtgaggtaagatcgcaccactgcactccagtacactccagtctgggtgaatgagtaagatcctgtctccaaaaaaaaaaggcaagtctgagcataataaccactgtcttaaaattcattgctctccatgtacttccgaattagtttattttaattttaacttaatttaattaatttgtttaatttagagatgaggtctcactgtattgcccaggttagaatgcagtggtgtgtttctaactgcagcctccatttcccaggctcaagtgatctcccacctcagcctcccaagtagctgggactacaggtgcatgccatcctgcctggctaatttcttttttgttttttaaactttttgtagacacgggtctcaccatgttgcccaggctggtttcgaactcctgggttcaagcaatccttccatctcagcctctcaaagtgttgggattataggcataagccaccatgcccaacctgactgcttcttcaggcttgtttataccacatatgtcctctgactttgtgtccaaattctgaaatagacagtgttccagctctccatgctctctcaggtatgcatgtgtccaggtctggcccaggcccccagcttcacttcctgcttgagctgtggcacaagttgcattattggaccccattttgcttcctttcctcaggctatgttcgactcatcattcaaggtttggtttatatgccaactccaagaagtcttccctgatcccttaggtgtaataacctttatgtccttgttcatctttaaacccaagaggcttgaggttaaagactacatcttgttcactggtatttccccagagtccaaatcttggcacaaggaagatactcactaaatatatattgaatgaataacaatacacagcagtgtggaacaaatgttcagtagttcagacaaaaagtgcaagaaaagctacagaaagtagacactgccttgattatgtaggcagagaaaaggtcacataaatgtgatactttagctaaagtcttttgcttggtctttctggaataaagacattcaagtaaacctctagggcatcagttagacaaactgtagtctttgtgccagaatgcaatcccaactgagctacttcctggctataaaatattgtacatctgtaaaatggatgttatagtaacacctactttacagatgtgttgagagaattttatagtatgaaatgtgaaacacctggcacagtgcctggcacataatggatgctcaacaacgggtgtttgttacacttatcattatcacttgtactatatgcctcagctcaattcaagggatccttaactctttcaagggacagattacatagatgtaagcatttcctaagcctaatgattgagcacacatatatccctggtgcactagactcttgtgttagggtttgggattgagaggagagacttggagaagatggaggggggtggaagatatgaggagaaaatgggagggaggtgaaaaaaacatcactatgtatctatctcaggcaggcagcagatatagaattgtttatattaaattaaaaaccacctataattcagactttttgtctcttttttctatttttttgagacagggtctcactcttttgcccaggctggagtgcagtggtacaatcttggctcactgcagcttcaacctccagggctcaagtgattctcccaactcagcctgttcagtagatgggactacaggcatgtgccaccctactcacctaatttttgtattttttgtagagacaaggttttgccatgtcgtacaggctggtcttgaactcctgggctcaagtgttccacccacctcagcctcccatagtgctgggattatgggtgtgagcaactgtgtctggacaagatttttattttctttcaaagctcatgagaatgttttcatgagaatggagatgttaatgtagaatattttgatgttcttaatcctgctaagtcagggaccaacctgagtccatggaaggcctataaatgtcttctggttcaggtcagcaatgccaaatttcatacttgcaacttgtctgtttttgaggaaagggaccatcgtattaaaagtttccatgctctttccagaggtaaagaaacattgttatttttgtgctttctccagtcagaactaaggcagtaagctacatctctgaggaatggaggcatgtttattaataatagaccccttaaaatatttggtgactatagaatatcatgattcaacaagaaaagtctttatcttatattcctatctctcattataataaaaaagagtttcctaagtgattttaagcctagcatttgatgatggccaaaatttttttcccatggaataacttttgtgcaatctttaagctttgttattttggaggatcagagattggaaagcaaaacaaacatgcaaataaacaacatcaacaaaacagtagtaaaatccaggattttgtttattagcaatagttacatggtccaaacatttcatatagttttttcttttttatctagtagtgtattttatagctactattccttttcaattaattgaaagaaaggtttataattatccttttctcatagtgaatatatatgctcaagagaaatcatgttttgcatttatttatttaacatattatgtttgatggaaaatggtcttcgttggactgggaagaggaattgggatgggagatgaaggaggaagtgaacttttgatgagtgcctattgtgtgctagaagcactacctgtgataatgagaatatcatgtgttatctcatccaatccaacagcaatcttatatgttagaagcattatctttattataggtgagaaaattgaagcttcagaaattaaggaattcggttgggtgtggtggctcatgcttgtaatcccagcactttgggaggctgaggcgggtggatcacgaggtcaggagatcgagatcatgctggcaaatatgatgaaaccccatctctactaaaatacaattagtcgggtgtggtggtgcatgcctgtagtcccagttactcaggaggctgagggaggggaattgcttggacccgggaggcggagcttgcagtgagccgagattgcaccactgcactccagcaaggctctgtcttaaaaaaaaaaaaaaaggaaattaagggatttgctgaagaccgcagagcttgcaaaactggcctttaaactttgactctgaagcctgtggtttttttccctctgactagataccttttgtaaaacctggtatctcctaaaggtgattgattttagatgccttagtgtttacacagggattgacattgttgttaccagatagattggaactctctctccatactctttgaagcactgtaaagaagccatcgctagtgattacttgtcttcttgttttttaaaatttttaagtcaatagtttttggggaacaggtggtgtttggttgcatggaaaagttcttagtggtgatttctgagattttagtgtactcatcacctgagcaatatacactgtacccaatatgtagtctttcatctctcacctccctcccattagataatgctagctagtgatctggactttgtatgatctgtggaatactgaatgctcagatatcacaggctacaagaaaacagactaataatccccacattaccaaaacaataacagtaatatgataaatttccagattataaaattaacaactgatgtgattttaatgaatcatctctgaaaactccttgttctggagttttgtctccaaataaactcatatattctctggacaactttcacaattactgtagaagtcacaagaaagcttgtagaactttgtctcattcccctggattttaactagggttatgtatgagcctgtcttaatgtgttgcagaatttaacctgaaacaaatataggtaatgttaaaaaaaaatgacaacagaaatcttttactgtttcatgctgattgtaaaagtaatacaagcttattgaagaaaaaatatagaacaagtaaaacatttagaaaaaatgaaagttattcatgattctattatccaagtaaacactattaatgttttagcgcattttcttacagtgattttggtatatattatgctttctaaagttgagattgtttcctagatacagttttatttcattttcacttaaaagttaatgaatccattttcactgaaacgtatcattaaaattttaaagaaacattattggctggggccagtggctcacacctgtaatcccagccctttgggaggccgaggtgggcagatcacaaggtcaggagatcaagaccaccctggataacacggtgaaaccctgtctctactaaaaatacaaaaaattagctgggcgtggtggcgggcgcctgtagtcccagctacttgggaggctgaggcaggagaatggcgtgaacctgggaggaggagcttgcagtgagctgagatcacgccactgcactccagcctgggccacagagcaagactccatctcaataaataaataaataaataaataaataaatttagggaatgtctgtgggattttctcccagcatgatcctttcttctgttgtctactatggttactataggagcagccatcatcttgtataaccatatcccagtggcagtctttagtcggatcagagatgggcacttgactcaaaatgagcttagtggagcactaccttaggaaaaaaattttaacttggaacctccctggtagctgaagcagtgggaactttcactgggcatatttgttggtgtcagtaagaggaaattaagttgacaatatagagagcagatacaagagtcagaaaaattatccagacagtgcctgtgattccagttgttctggcggctcagtcttaagccagtagattctttttgttgacgctagtttgagttggatttctgtggcattttacaaaatgttctaatacatttgctttagaagggtaaagattaaaaatctgaggccctgagagattgggtaagctggaaagtggtagaactaacatagaacccagatatatttgactccaaaacctgcatatgcaaccattaagattcatagtcttgaagcagagtatttctggaacttctctctccatgtggttctctccaacagaaatagcagcaagaacaggtgaaatgatgcataggtacctgcttgttttagttttgtttccatttttcttcttatttttttggtataaggacaggggacttaataagaaacaataaggagatcttcctttttttctacttgaatatctccacttctattttcaatatataccctgtccatcaagttcagactacatatttaactgggactagttatcaatttctttgctaaagatgactggtttctttctgcttcttcctttgcatcctccaattctattccccttaagttctaaaaataagaacaccttatgtagaacaccatatatagaatctgtaatttcttattttcattatcatcattaccattgtcactggcattgtatttactgagtgcttgcatgggcctcgcatgaattaggcaaatcaatattatctcatctaagttttactataaagccctgtaggcccacctcctctttgcctcctactaccattcttattattgatatgccattgttgttatggttctctccattttgtatatgaggaaactgagcctcagagagcttttctgacctttcccaagatcacatacctagtaagtgttggtgcccagatttgaatccagttcaatctccttttaaagttcatgcatgcactcatgctaatattaccacttatgccagattctgtgatagagctggttctcacaactgcatagggagagggagataaacagatagtgttcttactagtctagtagagtgtctggctgctaggctataagtccaaatcagtgtttaaagcgctatggaatcaactagggaaggtaaaatctatagcaaaaatccctcacaactggtgcaatacctagattattttgtagataggatagtggttctgcctgcaagcacaggacttaaattactgcttgggaattccagaaacaaaatcatccagacattggtagagggaaaggcaaggactggaaatgttgtcagggctccagccaagaatataactttcttttaattagtgttagcatagtatatctttatctatccatttacttttaatctatatgtctttatatttaaagtgggtttcttgtagacaacatatatttgagtcctggttttggatacaccctgataatctttcttttaattggtgtttctagaccattgatattaaagtgactactgttatagttaggttaatgtctaccatatttgttactgttttctatttattcattttggacatatcacattttatttaagaaatcaattccagatgaagtgtaagtctaaacttgtaaaataatacaactggaaaattaaaacataggaaattattttcatgattttgagtagacagttatttcttcaccagaactccaacagcactaataatgaaagaaaatatttgataaatcggactacattatgacttgaaacttcccttcatcaagggacatcattaactgagtgaaacagcaagccaggaagtaagagaagatatttgcagtatatgtatctaacaactcaaatttagaatcaaacaaatcagtaagaaaaaagatagacatagaaatatggtcaagagacttagcaggcacttcacaagagaatattcaaatacccaaacacatgaaaacacatcttaattgatcatcaaggaaatacagattataaccacaatacagtactacaattcactcactaggaaggctaaaatgaaaaagacaatctcaaatgttgacaaggataaggaaaccctcatacactgctattcggaatgtaaattggtacattttgaaaaacactttggcagtttataaagaaggtgaacatatatcaatattccagtcattccgctcctagaatgctagaatgctgctgtatgttatttttcttgatctggatgataattacaaggatgttcacttagtaagaattcactgagttttacactaaatactcctgtttgtgtgtcatgcttccaaaaaggtttcttttaaaatgcatataaatagaaaaactttcttgtgaccatgaggctaagtgctatgtttcttctgactgagctattacagttattaaatgcttttgatcaaaccagaaaaatgttatacatttaaataattatgaggaaaaattaaaatgtattaaaaatcccacttctaatgatgcagatggtttttgtttgtttgagacagagtctggctgtgttgcccgggctggagtgcagtgttacagtcttagctcactcactctgcctcctgggcggaagtgtttcctaccacctcagcctcccaagtaggtgggactacaggcacacgccaccacagccagctagtatttttgttatttgtttttctttttttgtagagacggggtttcaccatgttgcccaaccttgtgtcaaactcctgagctcaagcagtccactcgcctcagcctcccaaagtgctgggattacagatgtgagccaccgtgcccggctggatatagatggatttttgaaattagttcataccatgaattaatattagttatttccagaataaagcttggctcaccaccaattaaatctctatttcttattttcagagatggtatgttaatgggaatgaaaggaattttcttataataaggtcattcaaaattttaaatttcctttagagttatatggcacaaattaaatcctgaactatcatcaattttgcccaatgatcagctgactaattgatgaagtccttcttcagttctgttgaaaggaaaacacaggaaatcatttgctatgcaggatttccttcccagcctttcctcctttcctgggctaggatattttgaaagcccctttggctcctgggaggtggtaaactctggggcaatgtacccgggtaagttcagggaaggagaaagtggtggaagaggttagtgaaaggaaggcaggagagaacctccctcgaggtttctcttggataggtctggggaagaagtatgtatggaactgaggatttgaaaatagattcctttagaattcttcatgcccactattcccggggcagtctttgtgtactcccagaggcaagtgacccttgtttgaatacagctgactaaggacttctcaggacttgctcctcagactgcatctccagaggcctctctgggtcttaaacacctgtgcagctgctgacttgtaggggctgaggagctgcaggccccagaggtgaggactctctgaaaccactagagggagccccaactttctcagaggactttggacaggcctgggcaactgggctgagtcttactcagcacactgtcaactgtacctccgggacactggatggatctagcccttgcccacctccagaatgaagcaagggctaagagtgttcagagaaaattgaatctccctggagagaagtaggtccctgcacttccctgctacatcatttcaggcttctctgtgacctcttcccgggtcggttttcagtggggacagcgtgcaaggtgggctgagttgcagagggccaacaggtagcaaagtggaggagacacagcactagaaaagagaaaaaccagtttgcagagatgattcctgggtgttgaggtcagttccacccttagaggtcaccagatcccagaggtcctcactatgtatccagctttgaagttgtggtgactgatgtgcaagggcccagaaaagcagatggaagaagtgctagttcatgagttcctgctcatggagacccagaggtcttcgactcctcgaaggcttctggcagtcccggagacatcaggaaaattaggaagacaggcattggaagcttctacattgagggaacatatggagattttgtaccactcttaattattggtgcagatttgccaattggatgaaaataaggtacatattaagttcacatttaaccctaaaatggtcaggcccatctattcagagagtgtatatagatacctagctctgggccagcctttggtagaattactaggcttctaaggcaacccctcccctctggagaaagtacaggagaggtgctctaagatagtagttctccaagtggggttgctggaacatcagcatacctgagaacttgttagaaatgccagttttctggccctactccagaccaattgaagtagcaactgtggtatagggacccactgataggtgtttaatcaaattctggattccagaagctgttctaagaggacactatgaagtgagtttgtgggggctacacggaggaaacagggtgtgatgccaaagaaaggatttggacaggtcaggaggcaatattaggggctaaaaacaaagcataattgaagacaaattcacagcctggttcagcatctagtatatgtgagctggaacagaggagagagagtggctatcatccagggcaaggcgaagtaaggccttgaggctgaaggagggagtgggacttcaagggtatgggaactgggagctgttgcagctttacgagtggaagagtgacattgtgaccattgtatttgagaaaaattactgaatatttggcacagaaatctcaagctgggatgttttgaggattctgcctttccaggggaatttcccagtgtccatcctttcctgtgactctcctgcttcagaatgggtagaggaggggcaatcagactgtatacagggacaagaagtgctcctggaggacatggcaccacctgttaacaggccagctctttcttaaagaattcaggagtgaaacctctgctgaggggatatcctgagagaataggtttggaaccctccaagaggaacaacaacaaaaagcccagaccatcctaagaagggattcctggacttataggagacagccaagagaacacctgcacgaggcttcaacatagagaatgccaccaaaataaggtttttacactcttgtcacttacagcagaatgggcccaaggtgaagaaataaaattagaataaccccttttatggaagctgagggcctccctaatggaggccttggagatgggcagatgcacgggtacaatctgaagagacaaccccctttagggatgagatcttttgctaccaaactcagagtccctctgaagtgtctgctgcagctctcgggttggggtcagttcctttttgtcatccaaagtctcaccctgagatacccagagcctgaggagggacaagggaaatctttctaggcattgcctagctcttcctccctacttcatccctaactcccagccctggagctgggagtttgcttcccaaagctgacctggcctccttccctccctcctttccctgggttgtccagatctaagggtgacattgtccttctactgctctcaaacatggcttctgacctctcccctcatatctcatgattatcgatccttgagagtttccctggctccctgtcccttcttccttctctaccagtgtcccttgtctgaacccacagtggtaggaaggagtgggcagcatggacggagaagaggaagttaaagaagacaagaatgagaatgggagggctttgctgttgagccagggacaggactttgtaggtggctccctcctttaggttcctccccaacatggtcatcaccatgcccacctacctgccatttactatttttcaaggaataaagaggaggtagcaaggagggcctttaacttacttgacaaagactaggccatcattcttttttgtttattcttttctccccaaccctgcctgccattctcagttattgtgcccattcttctgggaacagtggaacacagtaacactcactaggccctgcctctggccccctcctcctctactgccctgggaaaatggaagtggcaaagtggcaggagcaagattggcttgtggcagagggaacaaggtaatgaaggaggaagaggtttcttgggagtggagaaaaacctagaagaaactttaaaaggcccatgggtagaagccatgtcattgtctgctgggagggaaagatggagacctgaatctagcacagggtaggcttgacccactcacatgctcttgtgcctcagccaccgcaaacaatggcattctgtgcctgaattcctgacttccaacctcaggcctcacaaatgcacacaggtggaaaaagcctgcagtcctctgctctcacagaccctttcttgtctttctccgctcagcccatcttctctgggagactgaaatatgaacccacaccccctcacacttggttcaggtcttcagttccatctctgcctgtgggatctggagttggagcattccgcctcttcactctgtcccatgcatgaataatctgtccatttctctagtccctgagcttttgtatgctgtctttctcttgtgtcctcagaaaggcaatggagtttatgtctcttagccatgtgctgaggaggtggtgggcagatatgcagtagaatgacatctttctcctttatctcattttgccatttctttccttactgcccatgtctccatggacatatgatttttctctttttctgtgatggcaaggaaatgacatgagtagtcaggatgcataggcaatgtggccctgggggactgtgtcagagggctgaaagggcagacttggcactaatgagtcagtcagaagccctgacattctggtcctgttctacaacctcagggatgagaatatgcttttttctggagcccttgtactcaaataatggtggagtatctgaacttggaataacaaatctcaattctctgtttctgctcagacacatctaaaggtaatcatttcctgccacctgccataaataattgatctctcaaatagaaccatgtttcctgctctcgaaccctgctggtaatgatgccagtgtagatggacctgcacgataagctttgaagctaacagggattataacaggggtaagcagctttgggaaaatggagtgctcttttgctgacttgtttctggggactttgctgatcctcatgaggagcaataactgctgggtccattgatctagtacatccttgaatttttgagttaacttcctttctttctaaaagctacatgaataaattctttggaatgatggtatgctagcatctatccgggatgccagcaaacatggatttacacaaagagaatggagccctctgcaggaagttgaatttccccttttaatttcaagggcataatctcagatcattgtagggaggatggtggcacagtcataatcttcagcctttgggaatataatgagatcttttcctcccagatcgcttcctcctcttggcttagcattttcattctttttagtggccagtttatatgatcacctctttcctctttcatttctactttattggcttgaggatgcacctaagagcataaatattgtctacaaaaattccacccccagccatcacctcccctccattttcaggaatgtcaagttgggggtttctagtatatttttgttttgttactcatgagcagtatacctagctgagttgggacatcagtatattgtttcaggctgactagagaggagcacctccagaaagaaatatcatgcagaaggctaccattctgaccattattagtgggcctaaataccagctagaaatgtgggaaaactcattaatgaaggatgcttaaaagccggacaagtagtagacaaagcttattttctaataactagctgaaagaagaatgaagaaagttccaaatgtttaggaaacatctactgtggccagtcattgtcaggcatgctcacatgtgtgcatttaattctcacagtagccctaggaggtaggaattattatgctcattttacaaatttgtaaacaagattagaacggattcttggtagaaaaaatacctgaagacctctgttgcaaataagtgaacattggccatttctgggtgatttggtaacaaagttttgtttaatgtctaaatttaacgtgaaacgtcattttcattaaaaagtacaattttatgaaatactaaatatatagaagccttggccaacattataaaccaggatctgacataaatccataccttccaacttcctttgacatcacattatcttttcataacagatagtcacattggctaatagggtaaagaagaaaaccaataacatcagaaaacaattccatccagccttgctctgactggggtcatcactctaggccacatgccttattttgctctgacacttcaggatgtttcctgctggtattagctgtgcatcaaggctaagaggtcacagcgctgtccttgccattctcaataaatcagttttgcaaaatctccaggccttcttgcagaggattcagacatagagggtgatataggtgatatagttttgctgtgtccccacccaaatctcattttgaattgtaactcccacaatgcccacatgttacaggagagacccagtggaaggtcattgaataatgggggcgggtctttaccatgctattcttgtgatagtgaataaatctcacaagatttgatgattatataagggggagtttaccctgtacaagatctctctttttgcctgctgccatctgtgtaagacatggctttctcctccttaccttctgccatgattgtgaggcatccccaattacgtgcaactgtaagtcaataaacctttttttcctatataaattacccagtctcgagtatgtctttatcagcagcatgaaaacggactaatacatagggttgtagcggatcagctataaagatgggcctccctttaggccctgcagcagtatggcaccagtttgaaagcctccatccagtccacataatgaaaatcagaaaaagaacattcaccacttatctgtgctttctgcaaagaaacagataccggggtgaggaccaagactgccttcttcttcatgtcattttgtatgtctgtgtagacagagtcggcaagaagggagatatgaagtgcttgcaaggtacctagatctgtccttgcattcagacattcccttgctacttgtaattccttgacagaagacattgtggtagtgggtacttaggagagaaacaactagaatggggcatttttcccaaggcaaacattgaatcctctcttgctgttacagagtaaaattccctgaggcctgggcttggtttttcatgcagattgaatgatagcttttaatactgtctctaatttagtaattctctgtgagctcccttgagaagagggcccaggtactcttattttccatctctcacaaagaatcaataatgaaactaagtattgaccattatatatgtcaagcatatgatatctgaagaatttagatggctgggggcggggaaactttgaataaccagatacatacatatagatagataggtaaagatatctcatagctccactttcatttttttttgtttataaaatattcactatgtgtaagtcttgtgctaagcactgaagatgcaatgctgaataagacagcgtggattcctttttgtgaagcataagatgtatctctcccaaatattctattgatgacagacttctatcattagaagcctcataattttgtattctttcatcacttctaaggtcaagttttacatggtaaccttcctcagtttagagacatacttgttttcttactttttagatatttgtcctagagtttgcagtatacatttacaagtaatacaagtcccctttcaaataacactataccacttgatgggtagtgcatgtaccttataataacaagatattcctaattcctccctctcaccccttgtataatggctatcatttgttttacttatacaaaactatacctaagcatatacacatgagcatacataatcaaatatgtttttgctcttattttgaacagattgtcagattaagaataagaaaaagaaattttcattttatgttcatttatttcttgatgatgctccttttttctttatgaagatcagagtttctgacctgtatcatttcccttgtctctgaaaaacttttttctaacatttcttgcaatataggtctactggcaataaatttcctctttttttttcttgcctaagaaagtctttatttctctttcgcttttgaaaaataatttcacaagacacagaattctagcttttttcaagaaaaaaagtgagtttctttctctcaacccttcattacaatggtccctcctatccataggggatacattctaagacttctagtgcatgcctgaaactgaggatagtactaagccctctaaatagtattgatatggtttggctgtgtccccacccaaatctcatcttgaattgtaactcctacaattcccatgtgtagtgggagggacccagtgggaggtaattgaatcatgggggctagtatttctggtgctgttctcgtgatagtgaataagtctcatgagatctgatggttttgtaaagaggagttcccctgcataagctctctctttttgtctactgccatccatgtaagtcatgacttgctccaccttgtcttctgccatgattgtgaggcctccccagccacgtggaactgtaagtccactaaaccctttttcccatataaattacccagtctcggttatgtctctatcaccagcatgaaaatggactaatagagttgtagctgatcagccataaatacaggcctccccttaggccctgcagcagtatggcaccagtttgaaagcctccatccagtctacataatgaaagtcagaaaaagaccattcaccacttatctgtgcttcctacaaagaaacagatacctggatgaggaccaagactgcctcccagattgaatgatagctgttaatactgtttctaacttagtaattctctgtgagctcccttgagagggcccaaatactcttactttccctctctcctgacaaagaataaagaatgagtcttgactgttatatatctgtcaaacacctgatactggaagaatttagatgactggggctggggaagcttcgaataaccagatacatacatatagatagataggtaaagatatctcatagctatactttcattttttttgtttataagatactcgttatgtataagtcttgtgctaggcactgaagatgaaatgctgaataagacagcttagattcctttttctgaagcgtaagatctatccctcccaaatgttctgttgatgacagattgctatcatcgagtgcctcataattttgtattctttcatcacttctaaggtgaagctctatgtggtaactctcagtttagcgacattaaacatgccttccttcttctgtggcttttctggtgtctaagacggttcaaccacctactaaagtttcttctgcatatgatacaagtataaggcagttcacctgtgtgggttctctggtgtttaataaggtggaagttctgaatgaatctttttccacattcatgacatttaaaggacttctctcccatatgaattatttggtatgtgtgtagatttgtgtcatgactaaagcatttcccgcaccatgagcatctatatggttttactctttgatgtgtcatgtagtgcgtattaagatctgaactccatctaaaccttgtgtcacattggtgacgcttataggtcttctgtttagtgtgaattctctggtacttaataagatcagagctaactgaagcttttcccacattcctgacatttaaaaggtttctctcctgtgtggtgtttcccatgaagacacataagttttggaagctcttgtttacaagtggcaagtttctttacttccttggaaaagctcagtgctgtttctgtaccttgtgtatatcaccatgattttccctgcctgttgttttctggacaatttcattctggtctgttttgatattttgcatcctagcatttgtatttctgatgcagaaaccgatacaggatgatcatttccagtgtcatattttagctttaaccctagagagatgacagcttcacagatactctgcattacaacatcataaagtcttctcaggaggatgcaataattgacattcttcctcagaaaaatacacaaccacttcttcaaatgtcagcaaactctgggactcaggcaggatgagctgagatgccatcttccagtctttggtgcttttctgctcagcacaggctaaaacctgttgagcatacaagactctttcatatacaggctgggtttctttgtgagtattccagcctagctgttcttgtagtacccagtatatattccaacattccttctggaacactcgctttggttagggctccgctggtttatacttgaagtctggggtcactgctgttcctcccaggagcactgccttctctcccagctcatgggctgtgaccttattctttgtttgaccaggttctctctgcaagcgtttcaccaagaccagagcctgttttgacattctgtggatgatgcttctgcacccagttctgggtatccttgtgcaaaatggtcaggaactgctctaacatcaatatttccaagatctactcttttgggtggatctctggcctcaatcactgatagcataatttctgaagtaggctgatagcctctggcgttccagttgcttcatcgtatcagaaggtctggaagtgcctgtgagtgccctcaggccgagatactctatttatgtggtgtacttcttactgggactggagttctctctcacagacccattagtctcccacatagcccccatctgggggttcaagtatgcatctgccttcagctctctcatcattgtttgctctaggaacagttttaaccctgtgtgtgacactgacacccacctggggccacctctgacaaatgagggtgcatcaggtttggtacaatatcaatgagtagatcttcctaagagcacttcagtaagctctggcttccctggaggccactttcctctttctcagcttgactaccctctgttgccatgtctccctgctgctctgggtattgaagctctgttcctgcgccacatggggaagcggtgtcaggaaagcgcactatgcctggcaagtgaagctccaagattttcggagccttggaaggggccctggaagaccagttttcccattctatccctccacctcccagagaccttacccagattcactattcctcggtcgacgtctgtctattttctctttattgcgcttgttctttgcttctgtttttgtgttccacacttttgctgccttttgtggtttaaattattttatatgattttatattctctccttagaatattaccatgcttgttttcttacctttttaggtgtttgtcctagagtttacaatatacatttataagtaatccaagtcccttttccaataacactgtaccacttgatgggtagtgcatgtaccttataataagatactcctaattcctccctctcatcccttgtataattgctatcattcattttacttatacaaaactgtatctaaacatatacacatgagcatacataatcagatacatttttgctcttgttattttgaacaaattgtcagagcaattaagaataacagaaacaaaagtctttattttaccttcatttgttccttcacaatgctctccttcatgaagattggaagttttgacctatatcatttcccttgtctctgaagaacttttttctaacatttcctgcaagataggtctactagcaacaaattttctcatttttttcttgcttaagaaagtctttatttttctttcacttttgaagaataatttcagagggtacagaattctaggtttttttctagaaaaaagagttcctttctctcaaccctttattacaatagtccctcctatctgtaggggatacattctaagacttctagcggatgcttgaaactgaggatagtaccaagccctgtatatactattgttatggtttggctgtgtcccactcaaatctcatcttgaattgtaactcccacaattctcattccaagtggaagtaattgaatcatacatggaggtctttctgttgctgctcctgtgatagtgaataaatgtcatgagatctgatggtttgataaagaggaggtctcctgcacaagctctctctgtttgcctgctcccatccatgtaagacgtgacttgcttctccttgccttccgtcatgattgtgaggcctccccagccatgtggaattgtaacttaattaaacctctttttcatcctagtcttgagtatgcctttatcagcagcatgaaaatagagtaatataactatattccttactatacatacatacatacatatgtatgaccaagtttattttataagttaggcatagtaagatattaataatattaatgaaatagaataattacaacaatatactgtaataaaagttatgtaaacatagtttctctctcagaatatcttatggtgttataccaaacttcgttttgttgtctgttctctgataagtgagaagactattaagtgactatatacatttatagcatataaacatatatacactggacaaagagatgattcacttcccaggagggatggaatgggatggtgtgagatttcttcacactacttagaatggtgcatagtttaaaacttatgaattatttatttgtagaatttttcatttaatattttcagaccactgttgacagagggcaactgaaatcgtggaaagcaaaaccatggataagggggacactgtatttcaccccagtctctttttattgcgtggtttctgaggggaagttggatatatttcttatcttttttcctttatatgtaaggtgtttttttccctctggttttcttttaagatttttttccttatctttgattttctgcagtttgaatacaatttgcccaggtgttatgtgctttttttggtacttgttctgcctggtgttctgtgagcatcgtggagctgtggtttgttgtctaacattaatttggaaaaattctcagtcattgttgcttcaaatattgtttctgtttttgttttttttttttctgttgcttctttttctgatattcccattacacagttatacctttcatggttaacccacggttcttatatattcctttttattttctttttttttcctctttgctttttagttttggagatttctattgacatattctcaaaaataaaagttccgatatttttttcctcagtcatgtccaatctattaatgagcccatcaaaagcattcttcatttctgatccacttgttttgatctgtagcatttaaaaaaaatcctttcttagaatttcatctttctgcttatgttatccatctgttcttgcaagttatttttttcgataaaagcccttagcatattaacgatagtttttaaacattcctggtctgacaattccaacattcctggcatatgggactctggttctgataccagttcagttttttcaaactggggtttttgctttataattgttttccttgtaatttcttgttgaaaggaggacatgatgtactgggtagaaagaagtgcactaaataggccttcagtgatgcagtggtagggtgtggggggaggggaagtcttttgtactcctctgattaggtatcacactttttttcttttttctctttctttcttgctttttttttttttagacagggtctcactttgtcacccaagctcatgtccagtaatggcgtgaacagggcttgctgccgctgccttaacctcccagccttaagcgatccttccgcctcagcctccaaagtagctgggtctacaggctcacaccaccacaccctagctaatgtttgtattttttgtagagatggggtttcgccatgttgcccaggttggtctcgaactcctgaggtcaagtgatcagcctgcagcctcccaaagcgctgggattacaggtgtaagtcaccgcgcccagtctaggtctcagacttttaatgagcttgtggccctgggctctgaacttcaccagtgcttcacagtttttccccaacttaggctggatatgatggctagggtggtctggagttaggtatttcccttcccccaggtaggttaggctctgataaaattccaagaggttagggtctggagggcaggccttgcaaagaacagaatatcctttctttcatatttcaaatggttcctcttccttccccactgctgaaagtacaggggaatttttctctgatagtcgctgtgagggcctggagataagactcacagaagggtgagggtcctccgtggctgggttccctggaggttttagctctcagacttgtccacaccgagcctccatcagtttatcaattgcagctcagatttatgtacctcagcattggttcctgaagaggtttctgctcatgaattcctcctttggtaagttgtgattctctgtatttgcctgtctgtctctccaatttgtggtgtagggtttgccctaagacttcacttcactgacagatctaagaagagttgttgatttttcagatcactcagctgtttgcttgctgttaggatggagtggcaacttctaaactcctgacatgttggagtggatactggaagttgaaaaagggtttgaaacctaacaaactttcaggggaggggcatagggagaacaatagacacctcagatacaactgtggactagagaaggaaagacttgtgtccttttcacggtgaagcctgggcagtgggaagccgtattcagaagtccccctgtcccccacagcacaaaagcaatagagctgaactggctctaggtagataggccattgcaggtagacgggccatggcaaccttgcagagttccagtcaccccactgtggtgcagagaataacagaatcattttatctttgtcactgagggtggtatggacatgctccctcagcagacctgatgaggccttggggttaggatgagggggataagatgagattgaaagatgaagctgatgactgtaggccaggtgcctgaggagctgagtttctcataacctaacatgaagtgtctgcttccagagaggatatgagcccgaggtagaaatagctggggtatgtcctgagaatttctaacatgttcccaggtgatgctgatgctcctaaatctgggataacactttgaaaaccactgcattgttttattccaaacttcctaacctcctattatttgttaagtataagtagatctatgcataatcaaaagatacgttacactacccaattccacaggtggtgtactctcttgtactatatggttaatcacctagatgtagcaaggaaaatgaacactggtatctcccatctgttggttactgctattttttccccttggtgttgtgcttttatgttgacacttttctttctttcttccttcattttctttgttctccttactctgatctttccttatagcctctatttgttgtaccgttttttttctatgttctgtgaaatactgtgatcggtatgtgaaaataatatcatttaattaagctttaaggcacactaccttgcatctagcctgagaacagcacaagcctgctgtaatttctatgattggcctcacttaggagattttatttgttgagaggcacctgaaaaaccttagcaaacttggttcagaaaaaaaaaatggtggctacagtaataatatataactcagagatttgagacacagatgatgtagttaccataggaaatttttttcctctttggctgttattactcgtactgtctacaagatctgtccaagaacagtgtatcatctaaaagaggggatgctggacttaaaaaaataagtgaaaaagaaaatttaaattagaagtcttaagtcagtcattgtatccatattgatattcttaactgaaaaagaacaaaacccaggaaggcttttatttatcgattccatgaagaacatatttcttttgtgtcatggtgatcagtgatttttgaatatatatatctataatatactcaaataagatttcttggtattttttggacttaaaatttttggattgtatgattctgagacttacatgcatatgttcatctcataagatggaaaagcttttgctcaaatttttttttgtccatgttgaaatgagaattaaaatcgctagagggcactgtggataagcatttgtagcaaagatacctataggagctagaacttgccagaatttagttgtacaggaagtcctcaattaccgacatgtactggtccaaaaatgtgcttataaattaactcttcggaattcaggattcagagtgtattttcctaatagaaacaataaaataagtagtagtataacaatttcccaagttgacctctaatagtctgttaaatatatatatgacacagatttgtttgttatgtgaagggaagcaacaataacaaaaacaaatattatacacctcattgagatataatgggatttaccaaacaacaaataagactatacaactcatttagatataatgggatttaagaaaattttgatgtagagagttttattttggtgtgaactggcttaattacaaaaacccactagcttggaaatattacagagttgcaatctctgtgtctcaaaaacaagaataaaacaaaatacccaggaataaactgttaatctgtgggtcacccccgttgaatggattgatagcactaccccctcctcccaactcccttcagtttttagtggagtggggttcatacggttctgcctcccctgaaccccacctggctgctttgttcttatgtccactacctctcactactgctgcttctcctcctggtgctgttcagtggcatgtttggcttctttcccttttctttaaaggcatccagatatccagccagtcccagcctctgggtgaagccattcctcctagttccaagctagcaagggtaatttagcactgtttgcttgcagacctaactttgggaattcactcagttcacctcccaggtggaaacgggaccatccctatggccacagcagagtctccctttctccctgtgtcccacctgccctaggaatggttcccctttcctctttctttcttcagctttcttccgtctaacttaattactgttttgggattatttaattttttttctctagggctttcactacgtaagtctacatttcaatcaatgagtgttttaaactagatgggaaacaatacatgacttgacagttaatttgccctgatttcttgccacacttccctttattctttagtggaaatacaaagtcacagttttctttcatcttttacgagctaatgggaatgtaggcagaggtcaatggtgaacagagtgcctgaaggtttgtggatgatgcaaagtattgggagagtaccctgagccccacaaaccacctttataatttaggttgcatcagtatcacctgggtgcctgccaaaaatacagattctgtgaggtgttaggtgggactcagaaaagtgcattttaattaagtatccttgattattctgatgagtgttattctggccacagatataaattgataaattatataatagtccctccatccttaagcctcctttcaggcaaatgtgtcatggattttagagtgttatcttttgtttatgggtttttgttttaaggtggcaaatgtgtcactatcaccaaggagatgggaaaggtatgattactttgatttttggtgaggttgtgaaaaaataatgtttagtaaagatgagcatcaatctgatctgctcatttagcaggatacatgtagtatttccacctacacttttcacaaaaggagaaagcattatttatgaagccttctgtgtgtgtgtgtgtgtgttttaggtgataaataattgaaagtaaaggttggcatcactatgccatatcaagcttttccttttctttctttcctttttttttttttttttttggtgatgagacagatggtatttttttctatagatgccaaaaaaggaaaaaccccaaacccaccaagtctcacagttgtggaaagaaatcttatatgatttctaaaagcaaggatctgctggccctcctcttaccccaaagactagggaccatgaatcacttggaaaatagatttgtgtattctgagtgcttgtcactgggttggctaacttagaggggtttttagttgaaaccagggctttctaagtatgcacttgataagcatgtaagaagtaagaacaaaatatatccagctgattaataatgatatatttcaaatatactggtgtttaaatggatattagacactatgttaccctctccaccacttcaaaatattataacattttaggctttatagtctttcatgacatcaaaggtaatgttattatttaaatagaataaggacatctgttttagaaagagaaaacaggttcttcaatgtgtgttttggctaggcaaatgatagcagaaaaaacctctaatgcatcatttttaaatagatcattgaaatgacagagttttgatttttttcaatgttctttttaacatctgacaagtctaagtacttctgtctacataagtcacatactaattagtaattaaccactgttatttaattagactctctagttggtacatcatgcattgatcactcccaatttggtatgtgctggctgctcttggtgactaggccactctgctggggttcatttcatgctgtgtgttgcagctgtgcccagacacaacctttttctgcctttgtcttgaaattagataagaaacataaaaatgtggagaattgaactaactctagttagtcaactagatttccaaaatggttacaaaaggcaaaagtgaatttttgctgattgaatgaaaaaaggactctttcgttcaaaaattcatttttttctccttttttatgcttcagattttctttcagatgatttgataatgatatgtatgctttaaggaaaggtcaaaattatattttagacctactgaatttgcaagtgttctaagcatgcaataaaaacatgtaaaatctctacactatattagatgaaacacatttgaagtaattttaattagaaatggccaaagtaatttagagacaattgttttaataaaaatggtacatttcttagattatgaaactaactttttgcactgtttattccattggttgttacataaatggagacttctgctattatgaattccttaaaccacatagtatgtcttaagcaactcctaggaccttatcaatattttatccagaaagtactcttgataattaactctactgtttttatttttctttttttctttttctttcttttttttttttttagaagaagtcttgctctgtcgccagtctggagtgcagtggcgcaatcttggctcactgcaacctccgcttcccaggttaaagcaattctcctgcctcagcctcccgagtagctggaattacaggcacacaccaccacacctagctaatgtttgtatttttagtagagatggggtttcaccgtgttggccaggatggtcttgatccgcctgcctcagcctctcaaagtgttgggattacaggcatgagccactgtgcccagccgattaactctactcttgtagctgcactcaaccctaagtggacttcacctaagtcagtggttctcagctctgggcagaggccagggaaggaggagatttatgtattcaaattgcctatagagttttttgcttgtttagttgtgtttttgtatgaaagaatgttgtctggggtggggctttatgatgaatggcagccatctagtgtgaccagaccatcattttcccaggatatgatgcacacaaaatcctgagacaaagaccatctcaggcaagtcctgtagagcaggttgcgcacttccctgaaaagactagtcacagtcaattctcactccccaggagacccattgtagtttcacagaaacgctcacttacagcagccctgacagagtggcagagggagaaacagaggcttcaggagggtactggctcattcaaatctgcaccattaataagcactggaagtaggaccaggtttcagatctttagcttcctgatctggggctctcttctctatacatttctctcctcttcctcctcatcttcctctttcttcttcttctggataaagacatttaggcaaataagtttaatgtgctcattatttcaagttttatgtaatgttatttcataaatgtaatttctgattaattttcatttattctagttggcaggttcattaatcagtgtaaatatgtgtagattataaactatgcagttggtgcctttaatattacatagatatgtggaagtccttccttttattcttaattatcaaaagatggaattctgtctctagaaagttttggaagcattctaataaaggctctatgaacgtgagtaatgaatccccccaaacttctttgatttttcctcattccacatatgacaatccccaatttgagaaaaaagctcttttaaacagaatgaaaggtctgtttgttcatattttgtaatagaatctggttgttaaaaacactcagcaaatagacattcttcctcctactacctctgtgtagcatagggaatggtttagtcagtaatggtgttttcttagaaatttctaataattgtgcatattaaaaataaattttaaattcagaacaaaccaggattaaaaaatcccaggttttttggtcaaattcaatgatcaggtctatgatatctttaataaaagaaataactctttcaatgaaaataatatggtctgtgttagcagtatccagatattgttgtcagtggatcattattccctcacagttattttatgtcttttttactatatggagccctatctgacaagggtcagcattctaaaagtactacatggggcagtggttatgcctcttactatccaccttcgatgtattctcttggtcaaagaccaactgtgaaggatttataaagtggtagcatggcatagttcaagaactcagtttgagccaagattcctgacttctcgtgtattgttactgtcatctacttttgtgtccctgggacatcatttattctgatctacgaatttaaaggacttccctaacattatcatttgtgccttttaaccctaaagttttatgtgagtatttaagcaaatatgttgaaaactttgggcatgcactaaggctatgaatgctgatttaaacctagggctagggattttttatgtaaatttcaatgattccataaacattctgtagttcttgatagggtattttatacatattttaaggagtcaacagtttgccagaaatagctagcagccagaactcagcccacaatctacacgtcatttggagaacatgctaaagacagaatagaggctacaatacatagaaatggcaaaatccaagatccagtttatacatcagttggttaagcaaataacatataccatgatttgtggtgctagctgagtttgatgataataactatagggcttgcaaaacccaggcatttatttctttctgcttgtagtgtgaaatcagggtaatgaagtagtttgttaaaaatataaagaggaggaaaactcatggatttaactattgtttttcactgtctcacagattacctgaaattcagtcagtagttgagagatttgtgtgtgtatatacgtaaataaacttattttaggatcgggggtacatgtgatgggttgttacataggtaaactcatgtcacgggggtttgttgtacagattatttcatcacccaggtattaagcccagtaccaaatagttatcttttctgctcctctttctcctcccatcctccaccctcaaatagaacctagttagtgtctgctgtttccttctttctgttcataagttcttattatttagttcccacttgtaagtgagaacgtgcgatctggctttctgtttctgcattagttttctaaggataatagcctccagcctcatccatgttcctgtgtatagtgttatagaacgggctaaagaaggccctggtgtattagcttgatttggcctctgcgttgtttacttcttcatagcaggctagggtggttagctagaaccaaactcaaattcttacacatccagttgctttaaatatagcccaaataagcatatttttagacacttagagcttgcctgttttacatagcttgtgaatctgcacccagcatctgctaaccacagataagacaaactccagcaataaagacatgaaaccctgctgccctttgatccctctaacccaaatagtttgctgctgaatgccctaacataggcatgtaagccacctctccaagttctcctcccctggagatcccttgccctattctccttctgagtagtgaccacctgccactgtctctggaagtactcttgctgggaggaacttcctctctcatgcaaccataagttgcaataaagcatgctctgtggtagtgcctcttggggtcttgccttttctgtggtcaacccccaaatccttgaacttaccacatatgtgtaatatatatctatgagtatgttatttaaaaataataagccaggtaggtttgtttctgccttggcatgaagaaaataaatctacatgaaggatgcattaaaaattgttccttcatagtatgaaattgtaatttggttcctgtttttatgtgaacattaaagacaacattatttagtgaaacactaaaggacttaaagtcagaagccttgagtttgagccttgattactcattagctgtgtgaacttagacaagccatttagcctctctgagctgtaaaataatgatgatactacctataattatttttattgaccaaactacaatacaaaggtgacagaaaggctgtaaaacaatgtaattaaaacagtgtaattaagagagtgaactctcctttgaaattctggcctcatgacttgggcgtccaaaggggaacctttttgaacttgttgttttaaccgtcaaatgaggataacaatactacctcattcatgtggttactctaagaatgaaaagatgtctcctttaaatgtttctaatgcatagacatgcatattatgtgtgtgcttcaatagtaaaatgaagtacaagtgtcatctaaagcatttacaggtgtcatgaggaatgtgagcataataaagaaggatgatgttgaggagggggtgatattcagttttaaaaaagccatcaagtctttaggcagtaattttgtattgatgtgaaaagtgtgaaatattaggaagggataacactcagcaataaaagtttccccaaatcatcaaaataattgttgtatgttcctttctcatgattcacatagatatagacttcacacatattatacttaaaccaaaaaaatactacccaagtacagagatgaatttaaaaggaaaacaaggaggtttcattttaatttaatttccagacagtggattacatcaatgaggtctggcgtctaatcaaaaactgcaaataaaggaagcagatcaattatcagactccagttcagtggcttcaacatgatgccgagtgcttttattcatgttacacagatgaacccagccctcttaacagaaaaaagcaaagactgcccttgcatgaaaacaaggtgacttagttccctaaaatccagtgggaatgatgatttccagtttcatccatgtccctacagaagacatgaactcttcattttttatggctgcatagtattccatggtgtatatgtgccacattttcttaatccagtctatcgttgttggacatttgggttggttccaagtctttgctattgtgaatagtgccgcaataaacatacgtgtgcatttgtctttattgcagcgtgatttataatcctctgggtatatacccagtaatgggatggctgggtcaaatggtatttctagttctagatccctgaggaatccccacactgacttccacaatggttgaactagtttacagtcccaccaacagtgtaaaagtgttcctatttctccacatcctctccagcacctgttgtttcctgactttttaatgatcaccattctaactggtgtgagatggtatctcattgtggttttgattcgcatttctctgatggccagtgatgatgagcattttttcatgtgtctgttggctgcataaatgtcttcttttgagaagtgtctgttcatatcctttgcccactttttgatggggttgtttgtttttttcttgtaaatttgtttgagttcattgtagattctggatattagccctttgtcagatgagtaggttgcaaaaattttacaatgagaacacatggacacaggaaggggaacatcacactccggggactgttgtggggtggggggaggggggagggatagcattaggagatatacctaatgctaaatgacgagttaatgggtacagcacaccaacatggcacatgtatacatatgtaacaaatctgcacattgtgcacatgttccctaaaacttaaagtataaaaaaaaaatccagtaggaaaacccatggatttaactattattattttccatgtcactgattaactgacatctgctcgttccacatgaagacaggaagcccttttcagaagactaacatggtaacgtgagatcagaaaagacaatgaactgtagacatttgctccttgtgagcctaagcgtaatattgctaagtgcagcactaaggagatgtgtatagtttgtcttgtgcactgcattagggtgtgacggcaaagaaaatgtagctaaaatgaagacaagtcagttgatatatctacttagattatatgctgagcagcagaaatgcctttgatggataatgaagtcataaaagtaaggtgacctcaacaatgtgtaggataaaaatatgagtgctgtatgggcagatatgaaagggagcagtcctcaccgttacagtacttatttctgtgatgagtggtacagagagcatggattgagtgcatgtactgatgagaacaagttaagaaacaagagcagggggattatttagtatctcataaacttttggggaagaaagcagggtatataactaaatgaaagaaaagaaaggaagaatggaaggaaggcaggaagggagaaaggaaagtagcaaggaaggtggggtgggaggaagagagaaggcaggaagggagggagggagggagagagagtaggaaaacagcaaatggaaacaaagtggaaggattgtggtgattgaaagtcaaatttacccaaacgtttcatattagattttcttaacataaggaaaaattattttaacgattagtcagtgtaggtataaaaatattatgcctttgaatgtatatatacacacatatatgtgtatatatgtatatctacatatatatttgtgtttgtatatatgtgtgtgcacacacatatatgtacatacatataagtacatatacatacagagagagagagagcgccttcatctattcctaagtgtaggaaggttggagtgcttgaatcaggaactagatttcatgttacaaccaaaaggtgactaagttgctccaccacatacataataggactcactgtatagtaactgagtgattgaccttaggcaagtaacttgactttgctaggctttagtctgctcctgtatagaatgcagattataatgctcaaatggttgttttgaggagtcaatgaagcaatgcctgtaaaatgttgatgtgaattaaagactccatcttgtataataataataattgtaacacaatgaaacagatgtcaagttgaacagatacggttcaggggcacctaatcaccatacgcagcgggtgtgcagctgattggattcatcctgacttttatttaagaaggaattagataaactccagatttgcttaaattaataattattcataataggcttctccttctgctaatgtggaaatagagtttaaacttctgtggaattttaggaaaataaactctataggttaatgaaagatatggaggaataggtaagtgttaaattaaccctatttaaagatagaaaaacaagaatgtagagatctattcctcttttttcacgattgtattgattggtgttgaaaggactttttataagtttaggaacatgtagtaatgaaatgctgggacaatttgtgaattcagctgttgtattttcgaaaaaaaatgttgctggcagcctgttggaacatctcattttttattctactaaatgagtattaaagagtcttctttccttaagaaaaggaacatttctagagaaaatttctgaagtttaaatatgataacagatggtatttcaagtcttctgtcaattacatatgtgatagaactccaaatttagattcattacacagctacaattcttgacgaagaatttatgaatttctggtataatcaaagaattacctatccgccccccccacccatagaggtatgtgtatatccttttggaggaaattttaggtgggccaggtcaccgttcttctcattcaaagatgactgtagttgtcagcacaaataatctttgtgctgtggaccaataatcttttctaccctctgcactggaaaccatactgactggtttgtggctatagcaggtgaccctgttatatgaattatcacatcttggtcttgtgattattctcattctttcactcaaatgagaaatttcatttcaaagacttggcttgctccttgctgtggttgttttttaaccatctgcagtggtattatcttgttggaaccatgttcatatgtccaaaataattccataggctgttctgattttatactcctgctgctctggtaccctgctgccacatttttttctgtctttccttgtaaatttagactgtgattaaaaacctggggacccacttcaagacctttgcacatgctggcccagatgcctctgttgcttttccctgggtttccacgtgcctccaaagagacgggttttcacatgtcaccttctcactgagacagtccctgaccttctcatcagtggttcccattaaaaccttcccagtcccattatttcttaattaaacactgtaggtttttttgtagcatttattatgatttataattatttattacatatttacttgtttctttatctttctgttatacttatgagagtaggactggaacacttttattttcccagatctcttaattggcaagtatgtgtttaatcattttgttaatctttaatttgaactcatttagaacttacagaaaagttgtaaatgatagtacaaaaactttcaaatattcatatttagcaattatcaccatgttttaaaatcatatttgcactattattttctgtttgtatatatccttaaatagttgtgttttctaagaacaagaacattcttgtttgtaaacacaagacaattatcaagacatttaacatggatgtggtattaataatctatattattatgtagattttgatagacatttcgataactctttcattaatgattgttctatcaactgttttaccagcccaagatgcaatatgagttgcatttagtagttagctcatttctttggtctctttaaacctcaaaccatttcttagcctattttattttattttattttattttattttatcttattattttattttatattttattttattttattttattttattttattttattttattttattttattttattttattttaattagagatggagtctctctccgctgcccaggctggagtgcagtggcacaatcttggctcattgcaacctccacctcctgggctcaagtgatacctcccaagtagctgggattacaagcattcaccaccatacccagctaatgtttgtatttttagtagagatggggtttcaccatgttggccaggctggtcttgaactcctgacctcaagttatctgcccgtgttggcctcccaaaatgctgggattacaggcatgagccatcgcatctggccttcttagcctttataacctagacattttaaaagaggatagaataggtcagtaatatagtagaatgttcctccatttgcagttatctgatgttgctacatgattggattccatgctgcatttttatgaggaatactacatgagaggtgtttccttcttactgcattacatgaagaggcacatgatgtcagatggtcacgtttaaatcatatttcttaacagtgactaaatggatggtagaggtttatattctaggactttagaactatcgtttgattgttaggataccttacaagtagtattaaataaattgtttaactatagagaggagacatgagtgtgagttcaggcctttggacccctcgtgttagtctagagttagctgttacacactcttaagttttctgtatttgaaacatatgcttattatttactgtcaaaaagctgtttgaggccgggtgcggtggctcacgcctgtaatcccagcacttagggaggccgaggtgagcggatcacgaggtcaggagatagagaccatggtgaaaccccgtctctactaaaaatacaaaaaattagctgggcatggtgatgggcacctgtagtcccagctactcgggaggctgaggcagaagaatggtgtgaatctgggaggtggagtgtgcagtgagccgagatcgcaccactgcactccagcctgggtgacagagcgagactccgtctcaaaaacaaaaagctgtttgactgagtgtagatttttttttaaaggcattaaaacccttccatcattccagtatctggaacaaaggcatggggtgaatgaatgaatgaatgagcaaatcagtgtttaagcttaacgttattttgtcagaggcatgtgaaccagagcaattccatcttgaataggagctgggtaaaataaggctgacacctactgggctgcattcccagatggttaaggcattctaagtcacacgatgagatcaaaggtcagcacaaaatacaggtcataaagactttgctaataaaacagtttgcagtaaagaagctggccaaaacccaccaaaaccaagatggccactagagtggcctcggtcgtcctcactgctacactctcaccagtgccatgacagtttacaaatgccatggcagcgtcaggaagttaccctatatggtctaaaaagaggaagcatgaatgatccgcaccttgattagcatatcatcaagaaataaccataaaaatgggcaaccagcagcccttgggactgctttgcctacggagtagtcattcttttattcctctgccttcttcataaacttgccttcacttcgcactgtggactcaccctgaattctttcttgcacaggatccaagaatggagtctggattggaactcctttcttgtaacatctttctggtgaccatggaaggtactataatgcggaaacccctgacccaaatgctaactttgggtaagtggtggggtccagtaacttctttctggagaaccctgaagggatgatactgagagacctctcacccaaaggaaatagacagcactgattggatgactttgggtatatgcatacccaggaaaagaatggaattaggttagaggcttaactcaggggagttagagtgtctcctaagagagggttaaaggcttctctcaataaaaggcaaggatgcttgactgaccttgtgttagaggcctgatttaggagggttggagttccttctaagatttagggggttagagacccctcttagtaaagtccctcttggtagagtccttctcgtttaagtccttctcggctaagaataggtttggcactatgggatgttaactgctattctctttggaataatctgcttagcactctttgcttatgactatggtaagcctaatccttaggcatgtacaggcatgtacaggattaggcatgttcaggatcatgggacatggggaactttttcctccctaaatggggaaacttgagagctattaggactgctggaaaagagtccttcactactgacaagtggctgcccgaacttttcagtgttggctgcaatggggggtctttctttggcctccctgagtgcctcgctttccccactctgccacaggcaatgctcctctctctctctctttctgcaaactggttgaaagaatggtaaaaatcattgtttattaaagttttgattaatgggaaaaaggatttgtgaggctaatcttaagctattgtgaatttggtgtgtgtgtctttctgtgttctatagtggagaggggtaccttaggatagaacacaggcttaggacacctgtaagcccacttttcaagatagcccagcaaactggtcagttaaaaactttgctgcagttccctgaaaaaactggatgaggtttccttcttgtcttgtatgtccttgggagcttgaccttgtaaccatgtggccatgctttctcttttcacaatggcggcctgcatttagggttcaattcctggtttagagatgagtcctttatcttctgtcagtatgtatatgtatatatgttgtgtgtgtgatataaaagagctttgattaattggcttaaaaataagagcttaaatcaaatattttgttagaaaagtaaaaagagtaatgctttttagttcatgtgacttaagtaatctttaggaaataaagacagttttaaagattattggtaaaataaaaatatcttcaaaaatgtaaacatttggtctaagttatgcagtttcgatattaggtttgctaaatgctttaaggtcataaactgcttctttgacttttgaaaattgttcaatttacctaccttggagcattaaattctagataaagcctggggacatgtggagttagccacgctgtctagctatgctggattcagcccttatctgcacttctgcctggtgtgtcctaggataggctccacacctagtacataattaaaatcgcttactaaccaggattttcaccaaaagtaaaagtcactaagagttaacagtgtaatgtgtatttgagactcctaaagaaacagttttacatgcaaagtgtgtaagaaaagtgaaatgtgtttttggaaatgactatggaaaggcatgggaatgtggatttttcttgcctaaattaaagggttaaaggattgttttaacctatatatgcctagtgttccattattggaacgctgagcttgtggcagttatttatatcctactgctcaaggtcaacaccaaggtctgattttccccccaaaatttgtaaccttcagcataaatgagttaagttaaataggataaagctgaaggtttaagcaagttatagaaggtttgtgagaagttaattataaaagaaattctgtgtgtgaatatattggctaaagttaaagtgccattattcagtttttctgttattgaattttgcaataaaagcacaacaggtttttcttaaagcaaaaacctgcttataatctgctctttaacaaaacttataaagggttataaaaggtttatgagaatcttaccttagggtcaaacgaattaagattaaatttgtctataaggttttattaagaattgggtttgacatcaataatgcactaatgcaacagtgacatttggcttatttggtataaaaatcatgcaggtagcattgtcaaatgtaaaatagtgtttgctttctttgggctgtatttgtataaatgtactattgatatgtgttgaaaattataggaaactcctataattctgatataacttagtgtatattaataataataattgttacataaaatcattgtgtgccacagaggtaaccaaaatttgtcaattgtgtttttgactggggctgtcctagaatgttttgccatccacagacaactgtgttgtcttgttttggtcctctttacaagatggtttatagtcaggtataggacttcgacaggtgcatttaaatgcaggtttctgataactttggaaattgtgacattagaataaaggaaacaactttcaggactctcattgatagctgaaatgttcatgaatatcaaacaggagttaaatacataaactaaactaaagaaatctgaagtaatctttttacctttttgcttaaaatgctgctgatactttgttctgtttttcagagttgagaaaacttttcttttgagctatttacagcttgtagcaattgagtaaagtatactcaagaacaaaatttggagcatatttgtttctctctacctgatttgtccataatttagaaactatttgtgagtatccttaatttatggcaatgtagttatttgcgtaagtgcaataagaatctgattccttttataacaggacacaataggaaaaactggttattttaccaaggctttggctggaatggcatgctttcctttaaggaatcaaatttgacttgtagagccaataaaagccctttggggaaatgtctcataccttgtctccacagttcctgtacagggtttctgacttgtggtaagtaaagaatgccactttctaacaagtccaggagcccaaagttatcctgggacctcataaggagaggaatttactcaactcataggtatttgatggtacaaacccatggctgtgctcagctttaaaaaagtcttaattgagattgcttctatggaacagagttccatcaaagccaatttaaaaagagcttatgtgaaaaataattattcttgctacacttcatacaaataaaatggccaagtgtaataaagcaaatcaatcttaccgtgatttgtctttagtaaagatggaaaattggagatagaaatattatgttttaagaactgtggtacacattattaaattctagtctcatcagttgattttaagtttgtttcttcaatttaggctaatgttacttattcctgtgaaccatccagtaatctctgacagcagctcaaaagaaacaagagagatgggtaatgtaaaaatctggatcagtattctaatcgtggccacatattggaatcatgtagcaaccccatatcagcttggttccaacagttgtccaattcatggaaagccttctaatttagtttatttgagataattttacttatttcactttactgttgtggaatattttgctgttgtattcttggtgtaggaatgaaggacaagcttattaaatgtttttgtaaacacttactaatctttcatacagcaccttttgtcaaaactcagagttatgaatgaccctcaccatactgatgctttctgactgagctcctctctaccttgaatacaagagaccctaatagtgaggtaggaatatcattgcccctattcagcctgaagaagttacagaagatggatcttcatccctctgcaacccgtaggattaagggttctcttataaaagggtggggaggaatgtcagaggtgtgtgaactggaacaactccatcttgaataagggcaggttaaaatgaggctgggacctaccgggctgcattctcaaatggttatggcattctaagtcacaggatgagatagaaggttggcacaaaatacaggccataaagaccttgctgataaaatgagttgcagtaaagaaaccagccaaaacccaccaaaaccaagatggtgacgagagtgaccctctggttgtcctcactgctacacacttaccagtgccaagacagtttacagatgccttggcaacatcaggaaattaccctgtatggtctgaaaaggggaaacatgaataatccaccccttgattagaatatcatcaagaaataaccataaaaatgagcaactagcagccctctgggctgctctgtctatcgagtagccattcttttattcctttactctcttaataaactttctttcactttatggactcactctgaattctttcttgcatgagatccaagaaccctctgtgggagcctggatcaggtgggacccctttcctataacgattttataataatgtgccagttttgaaaaccgatcctttatttccataatatgtccttgatagagtcataatatgtcctagctggaaagccaacaagctcagctaacagatgaaataagaggtccaggattatggagtgatttgccaaaggtcacacacatgatgtgatttggatctaaacatttcctcaatgatggtcatcaggcttttggataatcatcttaatcccttcagtagaaaaaatcttctaagtgtagaagcacattttgacatcatcttcaaagttttttctcttcaaggaggactgagtagaatctaataaaaatgcttttaatataatgtgccttgattggagatggatagtggactagacagtattctgccactggacgttactcatcctgccttcagcttaaaggtgctggtgatcttttcagagcagaatcaaagaccattaatgaagtttgatgttttcttcagttcagtggaggtggagttgtagtgactgtttcttgtgattgttgtctacctagtcaatggcaaagatcatgtatatcattcttgtggtatccatttactcttgatactgttaattttgtagagcattttatacatttctaagtccctcaacaaaagcaggatgagaaaaacatggagatggaaaacaatttctttcttaggcaacaggttaaaattcctttaattacactgtgatagattttacatctgaaaaaaccctcctgctacatacatagagaaatgctaggttagctacaacaaacatccttttatattagtagccaagaaagtaaaggaaattcacagaggctaaactatgaaaaaagagagatgtaaacagggcagtgaggggctctatcctcgggttcttatggcctcgtagggaaatcagtaacatttatctttgcgtggtatagcattggtattagatataaataattgatattaacagtataaataatagttgttaaattagtccaaatagattaaaatatatgtgtgatgtttaatgcaattaagtccgtggtgattactcctaaagtcatgttagaattctgcaaatgcagaatttacaatttttggtagctatttttagattgcagtcttgaattcagagtgggctcacaagctgtccactcaataaatcaaactcaaatgaaattaaaatttgagaaaatgaaaattcaaaatgaatgattcttttacattttgaaaaccctgtattctgtaggaaggtaatgctattatgaagtaccttttaacattgtgacagttttatgagtcagcttgaatggccataggatgcccagattaattatcagttctgggtgtgtctgtaaggatgtttttagatgagattagcacttgaatcagtggactcagtaaagtagattgccctctccagtgtgagcaggcaccagtcaatcttttgaggtcctgaatagaacaaaatggagagaaaggaggaatttgcccctgttgcttctcgccttaagctggaacatctcatctcatctcatcttctctggtcctcaaactggaatttccactatcagctcccatggttgtcaggctttcagacctggactgaattacagtgctggctttctgagtctcgcgcttgcagatggcagattgtgggacttctcaggcttcataattgtgtgagccaattccactataataaatctccgtgtgtgtatcttctactggctctgtttctattgagttctctgattagtacagtaaggatgcaaatgaaacaaccttgtagacattttgagaaatctggatggtctcgtttttctcacctgtgaaacaaaggaattgagtagatgactgcttatgtattctgtgattatatctttattcattcatttatttaatatttattgagtgttactgtatgcgcaatgctggacatttgaagatgaataaaatacatttcctttgctcaaaaaacgtatgttctagtgagagaaacaatagtaagcaagtaattaacccaatacgttatttaactggatgtatatgtagaattgactgactgaataaacttgaagcaggagaccagccaggagatgactacattagcctagggtaacactgaacgttgaatctttctattcattgctgtttaccttaatctaggttgttaacttgagtgtactcttttcttaaagtctataatctttattaatgtattgaatctggcttggattttagatgacttttacctgctgacagtgctgaagtgttgaggtcttgcaattagctaaataggttatgcttgataacaaattgatgtgaggttacaccagggagagaatgggaccatgaattttctgtcatttgattcaagatgaaaatgatgggaatcacacctgaagagaaaggaaggcaactgcaggactgctgagggcccctgagttttcttagtatcttttatcaaatgaaagatatggcaggtgttttatgacatgatagaaggacatatctcattctttcccactaagtgttttctagctctttgttctctgatatttagctctgtgcttttctacacagttttggggcactaataatataaagtagaaaagtagaaagtttctagatcacagagatcattacagatctcagtggttgtcatctcacattgcattaaaaataaatctcttccactgaagttgctatatacattatcctttttaacaatgatatatgcattttgaaatatgtaaagtaaatatagaaagaagtatataaaatatttgtaagtttaaagaataatagtgaaaggaacagttttctacctaccactcagcttaagcaactaatgtcctgaagccttctatggacatctctctgatcttctcccactcccctactgcctccttccagtggaaacttgtataattaattatgtgtttgtaattatttgccttttttatcaggtataaatgcattcaattaatatgttatttttcatttgtggaacttgatatcatactcatacactgccaagacttgcttttttcactcaactttatttttctgagatatagcaatgttgctgtttatcactaaggtatttgcttttattaccgtattctgttgaaggaaaataacataaaaaatctttttttgttcttagtggaaagtcttgttgtttgtagttttcttgccatttcaaatattgttgctaagaacattcttgtaacatgtccaaatttacagataacaaatatacctaggagtcaaattctaaggttatatgttatgtgtatcttcaactttgttacataatgccaaatgattatccaggttggttgtaccaatttatactcttatcagctgcaggtctgttcttattatgtaacagactataatttttacccatttatgtaatatgttatctcttcatggttttaattttaatttccctgattacaaatgaggttgaaatatcttttcatatttattgatctttcatattgatggcagcagcggcccacctggagtgaccgctgcaaacacactggctacagtgggggaggtgtggccagggctgcagctccatggagctggtgggagctggaaacaggtggaagccccgctcccttccaagtgggcaggttaggagccttgcacttcccaggtgaagctgcagccacccaagccgtggctgcagactcagaaatccctgtgctcttgggggctggaagcaggcaggagccgtgctgtcctggaaaacagctatagccatccagccacagctgcaggcgaggcatctttgtgttcttgacggcctgggaagccccccttccctgcagcttggaagtgcctgctcctgctgcctggcctctccccactcctgatgctcactcccatttcaagcaaacttgaggctgagcctgggtgctgtcacaacccagccatttgggataatgctaacatgctagactcctgccgcctcggcccctccagacgctgggcactgacaacctcctgtcattgcccaggctccagataggctcctaggcagaaaggggtgggtcccctgtgaagccccatcttcaaaccagggagggcctgaagcctgggggcctggctgacggacaagaatgggaacatatgatgctttttctgggcccacccatggccacccatgaaccaattagtacgcacttcctcttctttgaagcctgtgaaaactctgaactcagccagactcaagtagatgactgagatgactggatgacctgcctgtggagaggagtgacccactccagggtctcttctctgctgagatttgggcagacgtcaggactaccagctgcagagaggagctacccactacagggtctcctctctgctgagagaggagcactccagggtctcctctgctgagagttgggcagatattgggagtaccagctgcagagaggagctaccccctgggggtctcctctccactgagagctcaatacttgtcgggatgccctgcctgcagatgggagctacccactgagggtctcctcttagctgttctgtcactcactaaagcccttctttatcttgctcaccttccacttgtctgcatacctcatttttcctggacacaggacaagaactcaggacctgccaaatggtgggtggggctaaaagagcaataacacaaacagggctgaagcatgccccttgcttgccttgttgcaggtgacaagaaggagagaagagagaaggagagaaaagctgtggccccttggggagcctatacctaggagctcaccaagccagggctgtgacaccctctctggggctctgcagttcctggcatcttcaagcttctgggtgccattgtgttccccagtgccagccgtggaagctgcttgtggtacacctggtccagtcacagcctcacagggagccagcacccttctcagaacccagagctaagcaccccaccacagccagtgtgcatggctgtgcgcagtgactgcaccccatactcaattgctcacacacccctcaccactcgtgcctggcttgcccttgacaggcatgagagtcagaccagtagtgtgagctgagcacagtctgccagtctgagtgggtggaatgagcccagcaggctcgagtaaaaacttgggcaaaggtgcccctggccacagaggtttccagctggcgaatcaacacctgacggatcctgtgacaatattcctcctgtgtagaaaacatatttatatctggtggccattttcttttctactgaatcctttttttcttattaacactttaggagttgtttaaatgctttgaatattaatctttttttcagtatgtgttgtgaatgttttctgcaaattgtggccatttcaaacacatgtaaaagtagatagaatagtggtacccactgctcagctacaacagtatccatttcatcaattcatggttactcttatttcatcaaacaggtactcacaattcaccacctccctgccaagcaaatgccagacatcatataattttactgtggcttgtttttcatttcttcagtgtttcttttgataaacaaaagtttgtaattttaatgcagttgaattcctaagtttctttcctctatggattgtgtgtttcttatttaagaaattcttctgcaaaagattgtggagatatttcctaagtttttgtctaactgttttaaagctttacctagacactagttataatagcctttccccattctttcacagatttcttatgctatctctggcatatcaattttacaaatctgtgagatctgtttctgggctctgtactcctgctaataccatattttattaatcactatacccttatagtaaattaatactatatattattgtatctatagtattcttatatattattgtatatataactatattaataattattagggcaggagttcccaactttgctcttcagaaactttgacaattcttgggcttttgttctttcatgtaaattttggaattagatgatgaagttctaccaaaaacttttgagattttgactggcaatccatgtatagataaatttgtgataaagttacagattttatgaaatgcaaaagtataacacattcacagattaaaattccccaaatttgaaatattttggggttttaatctgtgaatgcgttatacttttcaatttatttagctttattcctctttttatttaggtttttaattggctttttccttctcaatgaaatctttaccatccagactatttaaaaagaaacgccaccctcttctagaatatttgtattttactaccatagttcttaaccttatattacatgttgcttctccttgatataaatgataacaaagagttttatctgcctgattatttcctggaatagaccctggtatatagtaggtgctcaataaattaattttaaataatttttttccataaaggtcttttaaatcttgtgatagatttgttctttggtttggtgatgtgccagtaaatgtttaacaataggttacctggggagtgggagaagcagaacaacttgtagatttgctgatttccatgctgtaaattctcctaccatggccaatatcaagttattgacatgacatcacggaatgggggagttgagaagagatgtggagtagtgtgccattatatagtattcccactaaacagaaacaatagatgccagtaacctcaacaatgtaaataattgcaaaatgtaataataattattagtaattataagtttatataatttaattttaaattatgatcatatttaacaactggctcacaaaattcttaaaaatttaacagcgacttcttgcgagctgtacaaactggatccagaattccactgtttagtttctttatgtttttgtgcgactgttataaatatatttccttatataagctttctaacaatttcttcttgatttataggaatgcagctaacttttatatttgttcttacatctggcaaacaggctaaaatttcttcataatttgaataatttatatgtacatctttccaggtttctttgtggactgttctatcatctgaaaaatgacagttttgtttcttcacttccaatccttatacactttatatcttattcctgtattattgcattgacatgaacttccagtataatgtttaatgttagtggtaatgaaaagcatccttgtattgcttctgattttaaatgagtgctttaagattttatgtttctttttgatattgtccttgttggacaaaataagttttcttttatttatagttagataaaaatttgtttttattattcatgagtgggtgtcagatttcatagcatgattattctctattcattgagatggtcatatactatataacgaagatgttcaacataccaagaatagtttgtggcttgcttaataacatagtgtcaaaatgcaaaaagcaatgattgacagaagtaaatggcaatgaaaaaataagcacatggaaaaaagaaatacatgtgaacaacatgactagctacttgatctactgcaaaagtacagaacactccagtgaatgcaaaaatacatagtattctttttttaaattatactgtaagttttagggtacatgtgcacaacatgcaggtttgttacatatgtatacatgtgccatgttggtgtgctgcacccattaactcgtcatttagcattaggtatatctcctaatgctatccctcccccctccccccaccccacaacaggccccagtgtgtgatgttccccttcctttgtccatgtgttctcagtattcttgagctacattaattatttacaaaaattaaccatttagcagatcagctataaagcaattttcatcaaatttcaaagaatctgtatcatgcatgcaatgttctctgaccacaattaagctgcttgcactacctctcagtaatgttttcatatatgtttttcctttccttccaacttttattttaggcttaggaggtacatatgcaggtttgttacatggataaaccgcatctggggtttggtatacacattatttcattacccagattgtcagcatagtacccaatagacttccaatcctcagcctcctgtgccagcatcattctgataccaaaacctgacagagacacagtgaaaaaagaaaacttcagaccaatatccctgatgaacatagatacaaaattcctcaaaaaatattagcaaatcgagtccaggagcacagcaaaaagccaatccaccatgatcaagtagggtttattcctgggatgtaaggttggttaatacaaatcaataaatgtgatctgtcccataaacagaactaaaaacaaaaaaccacacgatcatctcagtagtcacagaaaaggctttcaaaagctggaagcattttccttgagaaccagagcaagacagggatactcactctcattactccaattcagcagttctggtagtcctagccagagcagtcaggcaagagagagaaataaaaaagtcatccacattgaaagggattaagtcaaacttctctcttacaggtgatatgattctatacctagaaaaccccataatctctgcccaaaggctcatagatctgatgtacaacttcagcaaagtttcaagatacaagatcagtgttttaatattcatatttcatttcataaattcccttttcagctatgtgtaatctgccttttatcctattcatttttttcatgtttgataattacagttttcagtgtctgaagttgtattatgtttttggtttttttttttaatctgctgggatttacttatttatttaaaaaaacttaaaatcttaatttttttttcaaatattattaagcatagttattgtgatggttaacactgagtgtcaacttgactggattgaaggatacaaagtattgatcctgggtgtgtctgtgtgggtgttgccaaaagagattaacatttgagtcagtgggctggggaaggcagacccacccttaatctggtgggcaccatctaatcagcatccagtgaatataaaagaggcagaaaaatgtgaaaaggagagactggcctagcctcccagcttacctctttctcccatgctggatgcttcctgccctccaacatcagactccaggttcttcagttttgggactcggactggctctccttgctcttcaacttgtagacagcctattgtgggaccttgtgattgtgtaagttaatccttaataaactacacacacacacacacacacacacacacacacacacacacacacacacttattagttctgcccctctagggaatcctgagtaatattgattttggtaccaggagtagttgtagaggaacagaatattaaggatggagttctttcattggttttgggtttctggagttggcttcttaatatgattagaccccaaaatgctaaggactctacttctaatggtatggagaacactgattagtcctcagcgtgaattgtttagagagttatgcaaaataaatgcatttgacactcttctttcaccacttgtgagaggcaaggagtttagtgactccttgaccgtatgtggagaaccaaggagcgtaatgaagctggtggttgctcctaagtttagtggacaaagtgatgaaagaaaatgatgaactcagggattttgtttcctggcttcagaagcagatactaagcctcaaatctgctaagattgcccccagtgagttttatcttctgtagagaaagagctgaaattgtggaaaaacagatacaagttcttatcatgtgagtggctgacctgcaacgaaagatggatgcacagcctcaccaggtgtctactgttaaagtgaggtcattgattggaaaagaacgggaccctgaaacttggaatggggacatgtgggaggaccctgatgaagctgggggcactgagtttgtaaacgctgatgaaactttttttgccataaggaacagctgccccatcctccatagtggcaacatcccctccccgacccatgctgccatcagcctttccacttttgaggagataaaccttgcactgcctgagacaacagtgatggcctccctgagcctgtttccaggcaaaataatgttgattctcctcagaagtcacccccaacacccctatttgcttctggacctataactagactaaagtcccagtgggcccctggaagtgaggttgagagtgtgacccatgaggaggagcactacacttgaaaataactgtttgagttctctagtttatataaacagaaatctggagaacaggcatgggaatggatattaagggtttggaataatggtggaaggaacatagagttggatcgggctgaatttattgatttgggcccgctaagtagggactctgcatttagtgttgcagctcagggagttaaaaaaggttctaatagtttactttgttagctgaaaagatggcctgctgtgagtgagctggaaatgcctgccctcccttgttttaatgtagaggaaggaatccaaaggcttagggagattgggatggtggagtggattaatcactttaaacgtactcatcccagctgggaaggtccagaagatatactgttgaccaatgccttgtgaaacagatttgtgagagcagcacctgtgtctttgaagagccctgtaattgctcttcttgaggtgtcagtggcagatagggatgctgtttggagcctttggcaggcccccacaggtgaatcacaccagtgtcatctaggattttggagcaaggccctgccattcttctgcagataactgctctccttttgagagacagctcttggcctgtttctgggctttggtggaaactgaacgtttgaccatggatcatcaagtcaccatgcaacctgaatgaactgggtgctttctgacccatcctgccataatgtggagaatgcgcaacagcattccaccatcaaatggaagtggtatatacgtgatagggctcaagtaggtcctgaaggcacaagtaagttacatgaggaagtggctcaaatgcccatggtctccactcctgccaccctgccttctctccctcagcctgcacagatggcttcatggggagttctctatgatcagttgacagaggaagagaagactaggggctgactcatagatggctttgcatgatacacaggcaccaactgaaagtggacagctgcagcactacagcccctttctaggacgtccctgaaggtcaacagtgaagggaaatcttcccagtgggcagaactttgagcagtgcacctggttgtgcactttgcatgaaaggagaaatggccagatgtgcagttatatactgattcatgggctgtagccaatggtttagaacttggaagaagcatggtcagggactgggaagaagcatgactggaaaattggtgacaaagaaatttggggaagagatatgtggatggaactctctgagtggttagaaactgtgaagatatttgcatcccatgtgagtactcaccaacaggtgacctcagcagaggaggattttaataatgaagtggctaggatgacccattctgtggacaccactcaacctctttccccagtcacccctgtcattgcccaatgggtccatgaacaaagtggccatgatggcagggatggaggttacacatgggctcagcaacaacgacttccactcaccaaggctgacctggttacagccactgctgagtgcccaatttgccagcagtagagaccaacactgagcccttgatatggcaccattcttcggggtgatcagccagctagttacctggtagtaggttgactatattggacctctttcatcatggaaaggtttgtcctcgctagaatagacatttactccggatatgggtttacctatcctgcatgcaatgctccaagactaccatccgtggactcacggaatgccttatccaccatcatggtattccacacagcattgcctctgaccaaggtactcactttacggctaaagaagtgcagcagtggccgggcacagtgattcacgcttctaatctcaggactttgggaggcttgaggcggttggatcacgaggtcaggagttcaagaccagcctggccaacatggtgaaaccctgtctctactaaaaatagaaaaattagccaagcgtggtggcgggcatctgtaatcccagccactagggaggctgaggcaggagaatcccttgaacctgagaggcggaaattgcagtgagccgagatcgtgcctctgcactccagcctgggcgaccgtgcgagactcaaaaagtgcagcagtgaactcatgctaatagaattcactggtcttaccatgttccccatcatcctaaagcagctggattgatagaacagtggaatggcttttgattgatagaatggtggaatggcctttgaggtcagaattacaacatgaactaggtgacgataatttgcagggttggggcaaagttctccagaaggccaagtatgttctgaatcagcgttcaatatatggtactatttctcgcatatccctgaataacaggtccaggaatcaaggggtggaagtggaagtggcaccactcactgtcaccccagtgatccactcgcaaaatttttgctccctgttcaagttacattctgctgggctagaggtcttagttccagagggaggaacactgccaccaggagacacaacaacaattccattaaactgcaagttaagattgccacctggacactttgggctcctcctgcctttaagtcaacagactaacaagggagtttcagtgttggctggggtgattgacctggactatcaagatgaaatcagtctaccactccatattggaggttaggaagagcatgcatggaatataggtgatccattagggcatctcttagtattaccatgccctgtgattaaggtcaatgggaaactaaaacagcccaaatcaggcaggactacaaatgacccagacacttcaggaatggaggtttgggtcacttcaccagggaaaaaaaccacgacctgccaaggtgcttgctgaaggcaaagggaatacagaatgggtagtagaagaaggtagtcatcaataccagctatgaccatgtgaccagctacggaaatgaggactgtaactgtcatgagtttatttcctcctttttttgttaaaaacgtgtttgtgcatgtatagacttgcactaagaaaatatcttcattttatttccttttcctttatcatatgacataagatttattgacttcatattagcatttaagtatcactacctttatgtaatagtatttttgggttggggattgatgtgtttccagttgtatgaaggataattgtattatgttaggcataattatgacctcattattgtctttatttgaagattatgtatgatcttaagagatgtgtatggatccaagttgacacgggggtgaacttgtgatggttaatactgagtatcaacttgattggattgagggatacaaagtattaatcctggatgtgtctgtatgggtgttgccgaaatagattaatattttagtgtatatatgtgtgtgtgtgtatatatatatagttctattagttctgtccttctagattgccccgactaatatagttatattagatatctgctaaatgcagtgtcagcagtctttgattctgttattttttgctctctgcattcaggttgcttatttcctcttgtgtttgattgtatttgcatttgagctcataatccatgggattttatctgtaggaattctttgaacttcacatttaaagtgctttactgcagagagaatttgagtttgctttgtctaaaactgtaggctgtggcaaccttggattactagatattaatattttggcttggatttttttgaccacacagatcctgtgaatttagcccccaaatcacctaccttcatccatattcaagacaaagagattgtttttctcttagtttgttctgtagggtgtattttattttctagttcactatttcatagaaggtattgctttttaaaaaattcttgctttgtaaggagtcaataattttaccagctaaattgaatagtccatagactttgcatctaatcctttatatgactgtagaccataaaacccaaaatggtaggcccttagagaaaaatccccaattggtcaagatgtatcatttgttttatatattactggatatagttggctgatattttgtttaggatttttgcatttatgttcataagtgaaactgagttgaaattttccttttgcaccaatttattgttagaatgtaataccaaggttatactgacctaaaataagttgagaaaagttccctctttatctgttcactggaagagtgtacaaagttggctttgttttcctgttaaatatttggtagtattttccagtgaagctacctgggcctgaaatattttgggaaaaatttttaaatcacagatttactttataaaattattaaaactattgaaattattgaaattttttgtttattgtgtcaattttgttgtattttagaaatttatccattttctttacattttcaaattccttatcacacgttacagtacactcttatagttagagattttgtagtgatgtccctctttcatttctaacattattacttttctttttcccttttattcttcattcatcttgccaagggattatcgattttacaatcattttcaagatccaaattttagcttcattgatcctttctaagttttgtttgttttctatttctttgatttctgttcttatctttgccatctctcttttttcactttatttgcatttgttttactgttatttttgtaaatttttgagatggatttagctcattaattttcaagtttttcttccattccattatattaaaggttaaacattttcctatatactttaataacagctttagctgaatctggtaaatttttctgtgtactatcatatgcaaatatttttttggctactatggatcaaaatggtttgcagtgcacaaaataaagggcagaactgaggctacaactaaataaatagtatatgtttcagagtatgttcaactcctagtaagttagcatatccattgcgtgagagtatttttagcgtgatagagtaataccgttggccaagacagcgtgggtgtatttgtcacactaggtgtcattgactgtgaatatatgtgagtattcagaacaagagaaatacaaacacgtactggacagagtatttctttaagataaaagaaagcttttggaaatatagtattataacaaatcagtacttcaagggagtggcatttaatgctgtaatcatttttgtcattatataactataattctcactacttttttatatttatatagcaggtattaggaaatatgtctgaaatgttggataattctatcctagtttaaaaggtggtcaagaaatgcctgggttacagcaattccattactgggtatatacccaaaggaatataaatcattctactgcaaagacacatgcacacgtatgtttactgcagcactatttacattagcaaagtcacagaaccaacccaaatgcccatcaatgatagactggataaagcaaatatggtacatatacaccatggaatactacgcagccataaaaaggtattgagatcatgtcttttgcagggacatggatgaagctggaagccatcatcctcagcaaactaacacaggaacagaaaaccaaacaccacatgttctcactcataagtgggagctgaacgatgagaacacatggacacagggaggggaacatcacacacccagggcctgttgggtggtggggggcgaggggaaggaacttagaggatgggtcaataggtactgcagaccaccatggcacaggtatacctatgtaacaaacctgcacattctgcatgtgtatcccagaacttcaagtaaaataaaaaacattaaaaaaaaaaaaaagaaatgcctgggttagtccctatctatgcatttatttccttgcatgtgggacattatgtgagagcaccaaaagacaagtttatgctatatttatgtgttaagataatgatttttcattaattacaaaatcttttatctaaaattttaatagtctataaactatttttatccagaagacaaatgggttcaatcattttaaaaagtgacatcaagcataataatttgtgcccataaaataaagggctgggttagtaatagtttttcaattggagagaatggcccgaggaattaactttagattctaccactttgcaaataacagctttcccagagcaaataatgattgatacttagtgagtaataaagttttattttatttgacaaattttacagaaaagctagctgcagttagtgtttgattctgattagcctgggggatcaagggacagataaggcaaaacaatcaataattcacaattctatagcagaatgaagggaaatgaggtggggcctctggaagggtaggagctcaacacgtgagcaaagctattgggtagtggggaatccagactacagtctttgtttgctagattggatgttcagaatagcagagcttctttgtttttgagacggagtctcattctgtcacccaggctggagtgcagtggcacaatcttggctcactgcaacctctgcctcctgggcttaagtgatcctcctgccccagcctcccaagtagctgggattacaagcgtgtaccaccacgcctggctaatttttgcatttttagaagtgacggggtttcaccatgctggccaggctggtctcgaacgcctgacctcacgtgatccgcctgcctcagcctcccaaagtgctgggattacagacatgagacactgtacccggctagaatagcagagattcttaagcaggtcagaactttaagggtgatgagcaacttctaggcactgagaagttgatatggagatgaatctctttcctcatcagctctctcgactctgcctcagtctctttctctgccttgcctttaaaaataaaatctaacattgatgaaacaaacatatgttgtggcattgtgcttgttaggtacatgatcttaaggaactttcaatctggtagaagaacccttaggagatctatcgctaatatagttctaaagagtgatttcttaaaccatttttgtctgtcaacttttgtttcacaaagaatgtcttatattcccttaagttaggaatttacatcagtaaagactgaagatttaatcttactgacagccccaaggacatgcaagggcaatatcgcccatgtcctaggaagtttaggagtaagactgatggcaggtattaaggatattcagattgcagctccttctaaatgaaaatttattatttcattattcctaagacttcatttattacgatccttgggatttgagataattgaagacaacaataataatctctttatgtgttacatagtatggagtcattcattttgaaacatttccaagtgtgttgccaactgcatataaaattcagagtgggaagctcaggaatggtgaaggaaatgtgtatagacatacacatggatgcccttgaagtcctgagaggaccttgtggcctcaaaatatgataaatcctgtagcatgtttgacatgttgtaaaccctcctccaactcatagtagccatggtaatttgatgtgagagggaggatactaataataataatgacagtaataataatagacgatatccacatctgttctactgaacaacagtagcaaaaactatactatgtatatatgcaagaaatgtcagacttcctttcatttctcaagaataaatgaataataaaatatacttgaagcccaaaagtatataattaaaaattattgtgaaactaggttctgacaagactaatgttgtaagggaaattgtacattatatattctttcactaaatatttcctgtcctgtcaaatggtaaatcaggcaaccatttaaaggcatctatttaaattagccatgatcaaattatatgacagtggaaatcacaccatcttgataaagaaattgagatgcataaaatggtaacgagactgtgtgaataggggcagtgctaagagagaggtgggaatttgtcttctcaatggccatgtctcacatgcaccctattcattattgaaagttaccccactcattattcaaagtacaagctaatgaacttaagtatataataacaacttcaaaaggaatcatatgggcttaaccatcattatgcaatttgtcaatacgattttaaaaacctgtatgcagtgggcaagtcaacatgatgcattaaataagggcactatctctgggtcagtaaggtctgggttcatataccagctctactcctcagtcatgtgcaatattggtaagctatttcatttctttaagttttagttttcttatcaaatacaaagatgataatagtacctatagttgatagggttatcatgtagattaaatatgtgtggcacataataaaacaatacatattagcaatgctgacaaatttgaggaagatctttatctcattgaataactaggtttcttcaaagtattctatttttagcttcagtactattgggcttgttcgccctttcccaccttctttgaccaaaaagaggccatatctcatgacttttctggcatcttttaggtataaatacatttatttatctggttacttttagtgcccccagagcagtctcaatccagtccagggcaataatccagcctcccaatgcactggctcctgcagaaaagaaagaacaaggagggtaaggaacaggagaagtcataattgagtgtggcagtcacagacagcccctcagggacactccaggcagttgtgggtgtttttgtgggttctttggagaccttctgtagtgttgctgggaatctctctcctgagttccgtgatgtgggtgaataaacctctttggctggtcacttatgtttctaccctcatttcccagacactgctggtgtctctaccctgtctcaaggaccctcgggcagcatttaaggcaacaactgctggccctgtcaagtgtggcccacgtctgacccaggggaaatagtcccatgccctttgccccacacattgtgtaattgctttcttcccccagtgcagggaccactcttggcaatgttgtcagagcaggttgccagacagtctcttccgctttagatttctcaggtgtaggctcactttcattctaggggacacatatgagtctctctgatatccctttccttgggcatgaggtgcagaaaattactccctgcccccaaggaataccacgaactgttataacttcacacctctcctcccagtctttccaaccttagaggtggtgtccaggtcagggtgcaaaagttcttgatcacctcctttaaggtcttttttggtggtccctgacaccaactgggtgtcctacaattcagttcacttctgacactactgtgagtttgtgcagacaccacaggttaagaagctcagtctcatacacttgccttcccttcagatgcgagctggacatcctaggtccccatgctacctgctcttctgctcaatttgactataaatatggaagttcccatcaggttcaaaaatttgttagaattgattcaagacttaggaaagcgctgtagttactatagttacaatgatattttattataaaggttacaaatgaccagccagatgaagagatactcagcgcagcaaggtctggaggggtcctgggtacagagcttctgtgccctctccaactggtctttctagcatatcaatatgttcaccaaccagtaagctctccaagccttattgctgagagtttttatctaggtttcattttatggatataattggttaaatcattggccatgtgattgatctcaatctctagtccccttcctctgcccagaaattgggaaggtgaaagttccaaccccctaattacataatttgtttttctggcagccagcctccccaccccacatccatgaaccactttgctggcataaattcaggtatggtccaaaggggtttgtatgaataataaaagacactcttatcattaaggaaattccaagggtttatgaaacactgtgccaagaactcgggacaaaggccaaatgtacttttaaaaattataccacaaacatggaatttgggagtggttggtacctatccaagggccttagtcaaaagtgagaggaagaatattattttaacatcttattatagaatgaaaatgcaacagaactattgcaacatgaatgttagttcagatggggcaaatacaacttttaaatttgggtgtgattagttttaaatgttcttggaagttttttgcaccaggttaggtaattgtaagtgaaaagaagtgacgcagatcaaagaaattgttgaaaaattgcatccctgataactagtgacatatttttaatgtgagttatatacaccctggaggtactgccgttagtgaaccaatttagttggagatcccctgggtatcaaagtcataagagcaatggcgtatattgagaaggatattttcctattttggaaggtttgtacttacaatctatgtgcttataaatctttatcgaggattggaaaggaataacttatctagtaatttctaaattttcagaaatgtttgagggaactaaaatgctttgaatttgaagaacaccttggggtcgtattgagacttcttgaaaggctgctcttttttataatcctgaaatagattatattgcaaatccccctgaatatatgaacaatcggttttgaaattcaactgaactgtgtcacagtgttagttatgatcattgtgaaagctgcacggagaggttatcttaaaacccacatggcacatttcaaaacagatgtctcataaataaaatttgaaaactttggattttttgcaaactgtgttttaaatatcagaagtacattgttctcatttggagcacaactttcctttaggtttttgccttatttgttaggttgtatgtgacaatgatactttccttatggataccaataggattatttttttttcaattttttttttcttcctcatcttcattttcttttttttttaaattatactttaagttctagggtacatgtgcacaacatgcaggtttgttacatatgtatacatgttccatgttggtatgttgcacccattaactcatcatttacattaggtatgtctcctaatgctatccctccccaccttccccaccccacgacaggccccggtgtatagactggtcttattctaaaagaatgtccatgtccccaaatactggaatagtatcagactagccacggccataaactcacctcagtgttaatcctactcagaattttttagatttattacatgtttattactttcttcctttataataggtaggcaatggatgatcacaattaaactgttaacctagaaaacattttagataagaaaagtataaaagttctgtgatgcaaactctattttatttaaaaaaactctgtaaaacctgtataattagcaggaagctcctttttctgttaaagctaagaagagataggagaatgcagattagataaaattgtatcaaataaaaattttgtacatctgtactgattatttatgtttaggacatttttcatgaaaataaaaacatgctatggcaagaaaaaaacatgtagctgttggaaacagttacccaggaaatgttcttttaaaatatatatctcttacaatacacttaaaatcactttgattgtaatgaaaataatacaaattcactgtagcatattaaacatatggataggcaaaaatcaaccttaggaaaaataatcagtgaataaaagcatggactgtggagccagaatacttgagttcaagtcctgatatgtccatttactagctgtgtggcatcaggtaggtgtgccgctctttttgtgtctccattttcctcatttgtaaagtggtaataatatcattttcttatagggttaaaatcaagattaaattagttaatatttgtaaagtgcttagaacagtatcttaaacatattgaatactatacagatgtattgtgaataagatatacacagtctctttaagtaaaaattttaccctatacgtcttgcacctacttttttaactttgtatattataattattttccacatctttaacattttattattaaaagcttaaagcattttattgtatatttctaccaacaattatataaactgttacactttcagcttgttttcagctttttattcttttaaacactcagcataattgttatatctaagtttgtagcagttataattttagaataaattacaagaagtggaattacaagtatatagatgcatacgtattttttaattaaaattttacatctatatttaacagttttctcttcttttcctttttttctttttaatttagagatacgttcttgctctgtcacccagcctggagttcagtggcataatcatagcttactgcagccttgaactcctgggttcttcctgagtagcttagaccataggcacacaccactgcactccattgtatacacatttgaaagcattttttaaatatattaacaaattgctttttgtaatgtgccactgatgttcttcccagcatcagaggatgagggacattgacacacttttccaaacctcttttctcaaactacttgtttatattatgttgggaaaggtgctcccaataaaaactttctcatttgtcaaattaacattttaacttttattttaatctcttttctagagagtgttttaaagttttaattatatgtacttgaacagagttttgaaaggagttttgtaaaattaatagtaattatgggtgttagaatatagctttgaaaaaaatgtgtcaactttggaaggtagcaagaacttgactctctcttttgtattttaacataaattatacatttgtgggaaagtgggtgacttgggaggaaaaaccagtaataggctgcccattacacctgataacaattactactatgaaccttctgtgctaggcactgtgatagtgtgtgtatctctctctctctctgtctctctgtctttctctgtgtataacatatattttatgtattttcaaatcttcgtattgatatattaaccttatgggacaggctatattattacccagttttacagatgaagaaactgaggcacagagaggccttttattcagaacagatgtgagcaggcacccacctatatgtagggaaaagaaatgattacctgagctctgatcacagcaagtctcatgcctttgagttgtcactgactctctcagagaaagccagagatctccaccttatttgtgcttaatgaccttcggaaagaaactgccttaaatgatggctgtcttccatttgtgtaactttaaaagttatattttactttgaggtgttgaatctgagaggtggctatgttttgtgaacttcagctccctttagaaaaggaagcagtgtatctaaattgcccagttgctaagcgggtcttatgaataagtcatttattcaggaaaaatgtcttgatcacctactatgtgtcagtcatggtcccgtgaatttctggggttacatgattaagatagcagccctgcccttaaggaacttgtagtgggagacaaataatatacaaacacgtaaaataatgacagactgggtataaatgctatgaggagatagcagcatgatatgatagagtaactgttctgtgaatacccaaaaaccgcaagcacataccatttctgtctctgaaagggagtgaaaggtttgtctctctgagttagcatatagtggcagagcattttacagaggtcctgagagaaaatttgccatagaaagtctgtgctatgatttttttgaaaaaaaaatataggaaatatgtggccagctaattgataagaaaacaatatttctcaaaaaaaaaaaagaatatgtcatttgttatttaaattgttgagggacaacccaaagaacaccattcaaagtttctgtctagattctggctctgttctgccacattgataagttgtgtggctctgggggaaccatatacttctgttgcttgatttatttatctagaaatagaaaaaatatgtatgtcaggatataacttaataacaaaccctgtgtaaagctgatttcttctgtatgaaatggtgtttatgtgtaaagcactggtgattatatccagttacctaatacccgtacaggcttcaattcacaaagtcaggatttcaccagttttcccaattttatttaaccaagagtattctctgtaaaagtgaattattgctgaagcatttttaaattccagctatgttaataagaagccatttgagagcagctgtgcttcattgtttatttttattcaatatttaatttggaaaaaataatagagagatgtagaaaatagatttttttttttctgggacaatcatcatacatgttattgacatcagagagtgggcaatttaaccttctcaaaaataatatattcgctaagaatctcagcagcctcaggtcaaaaatgaaagcttacgtatatcacaagggatagtcaaatcagtatgaaaaagtctgaaacctgtattttctggctgaacatgatcttctgtaatcacaatagaaagctatttcaccaggtgttacccaggaagggattggtaggtgatattacctggatcaatttttctatgctgtgaataccaatgtaatcattttctcaggtttttgtatttttcttcaatatccatttaaaaatgaaccaaatactgcttcttgttctactgtagttcttccatggcactgtttcaagcagttaacaaatttcatatgctgaaggagtaaaagttaccttggtgacttaagaaaatatccatacagacatactcattcttaaaagggtttcttctgtgcgaaggaagtggtttctacaacataacatgtaattactacagtaaattgtattgtgaatatgaagaagatgaaatctgagccctatagactcatggattttgctattacgttttgtcttcagtttctttttttgttcactctgttgtcaaagtactttgtacattcttctctgtgaactttgcagatcagagaaatcaactgaaagaaggaaatgatatgttttagtttattcaaaggtatctatagcagtggtccgcaacctttttggtgccagggaccggttttatggaagacaatttttccatggatcgggggatgggtggaggtgggcatatggtttagggaagaaattttcaccttagatcatcaggcattagttagattctcataggagcatgcaacctagattgctcacatgcacagttcacaatggggttcatgctcctatgagaatgtaatgccactgctgatctgacaggaagtggagctcaggtggtaatgctcgttggcatgcagctcacctcctgctttgtggcctggttcctaacaggcagcagtatcggtctgcagctcagggattggggacccctgatgtatggtttagaaataaattaggataatgtatagatttataaaaagtggcttagaggtacccgctttcttgtcactttattaaaatccctttaagattaaaaagaaaatgtgtaaataaatgtgaaaaattatatatcacttttttccccagaatctccattgttacaaggagagaagcttagtttttgagagaattctgccaacatttgctgtagcagatgtattttagttgtttaagaatgtgtgataatctcactctttcattttggggtggtctttactttaaaaataagtgtaaatggattatggcatccattttgtaagtcatttacaaaagtttgcaccattctacctcttgtgacattgaagaaataaggcataattttcattttgtcagcaaatctctctgacaggcaagggcttacatagtgtatacagcaacattctctaatggattgcaggtcccatatgagaatgtgcaatgtgctcattaaaattacagcagcagaaaaagcagaataaattgccaccaagtatttaactatgacatttgtatgtatttctttttgacatgcctatgggcatgtcactgtaaattgtccatgaggattgttgtgacagctttatggactaaagttagggacccagcctctcacttggctaaaggatgacagcctaaataagaagagtatagtgaaatagcttatgaatagctgtatgattctgctataacgaagtttaggtacaaactatcccaagtaccttgggaatttggaacaaaaaatgagaaagcaagtatcatcgaatgatttccaaatatgagaaatatgaaggctctatccctggaagaatttaacatgcaacagtagtatctacctctcaggactattgggaagattagtgaaagctgctagcccagtgactaggatacgtgggaagcttcatagatgtttgattttttcttcttgtcttctggcattgtctttcttttcttttaccaaaccatctaaggaaataaatgggaaaagagcaggtgttatagcaacaataatcattgcaaattttctggggaaagtttggggcaactgtagaaggattcaggaacaggtggaatttgtctagtctttgaaggaacttagaatttaagttacagttgcgggaaactgggagagtattcttggcaagagggccctcaagaacagaggctcagcagcagagtttaacctagtgtttctggggaacagtgcaggaaacagctaaggttggaggctgattgtggagggcttcaacatgagagctcaggagcctgtggtcttcatcttctaagctttgggcgaagttgttgagtaattttacttgctagaacaatgacaacatttatagagaaaagtatgtctggagaggagcaggtttcagacacaagatttatttttagacatatagaaattttaagagatgagaaagtcacaaaagcatgggaggaaggttagagctgtatatgttgaagccacaaaattggtgagttttctgagagagagacaacgaggaggaggaacaggaggaagtatgaactcttaactaactttgacatatgcttttattttgtaaatgggagagacaaaacaagcaagaaatagagttaaaggaatggtcactgagagaaaaggagacgttaacagtgaagatagtcatgtttggtgggggagagttacttttctttattgcctctcagatttaggcactgtttggtggctttatgtgttttaactcattttatttttataacaacccaattaagtagacagtattttcaccaaattatggaacagaaaagtgggcttttgtcattaaatagggccatgcaaattttaagtggcaattgagttgaaaatatttattgcaggggattagggagttggtgattagaaaacagcagaggacatatattttctggagaaattttgtggtgtgaaaaaatgttacagtggtagatctctggtatctggggtcagaggagattttcagactgtgatatgaagaagattttatcttctttgcaactcacgagaatttctttgtaggatgggaagaacatttctgagaagacagtaagagggagctgttggagcttagctgagctatgttttatatggaagccaaaaattttgctctccaagaaaaataagtgagaaagagaaaagactggtctcagcactctgcagtgggaggattgtgaggtgagatatggtgactagggatcaaggagagagactggaaaggagatgtgtttaatggggatttttctgagtgaaactctatgcttcatggtacgtgacacctcctgttatccccacacatttccgtaacactacaaaatccaggatgtacttggtatgattacattttttttcatgattgcctgtaagggagatgagatttatatcaatgttagtgaagtactaaaacagtcattccatatggaggaggacccatattcatggggatttaatttgtcattgttgttttatattggtttaagattaggatagttgaggtaataaatttatggggtgggagaagaaaacaatagggagtgagagactaaaggttcaaaagtgagattagatggactcaaaaataggtttataggccatgaataagaggtggttatcttttcctcagaggcagaggaaaaaagagaaggttggggaaaatggaagggcatttttaaagtgaattggtggttaagcctatgataattttgggagagacactcaagatgaggaattatgcctagatcaacttcattatatcaatctctctatcaagcacggagcagtatcattttgagggatgaggaagcagcattaaacctaagatttaaagaaggcaaatgttttggaccatctgactgaacaatgaataaaatgattgcctagaccaagaaagggtttgaatgctatcagattcattttataaatttttccaggaatattgccacttgcattagaagtaaataaagttgaaggatatatttaggtaggaagaactagctatgcttcaaattatatcagaagggttgttccccactttctttgtaagaggcggttaggtatgcaccagttttcttaaaagagacagtccgcctaactaaatttatatgtctcagggtatctaattaaagtatctatatagatgtgcataccgtctatgaaatagctcagtattttgcctccaagactgtaaccttggtggaatagtccaaatatgattaattttcccattaactggtttagaatgttgctgatgatgggctaaatcagatatgtttcatggcatttctctaccctttgttccttgtgagaaggacttttttgattaaagttcccactgaggagatacacctgggagccatggtcttaaccaaatgatcctaattttccctagaccacagtggattggaatacgggagtctcctgacaaaagagctaagcagtagttagtgacttatgaaccattgcctggcaagaaaaggtgacgtaggccaatacaattctccctttagggaatctaatttgataagtgctaagacaagaaactgcaagtgatcactgaaatggaaaggatgtcctgaagtctaattgtggccataatggtgggttagttatgagtccaggtccagtttctaaaatgactttaagatgtaaacctaaaaatgtaatgttaaaagtttgtttttgaagagcattaactctcggcctcatgggtgaaatgatgtcatgcacctgctgtacggagacacacaatgtcttctcagttgaacagtctgaacatttagaaacaacaccctccctcctcctgcagaatgtgactgctcagagacgtagagacaccaagactgaaaatcctatctcccaagaatcttttatcatcttctttcctaaaacatgaagactgtatatgcgtatttcttcaatgtagaattatttctgttttgaagctagaagatgttttcaaagagtataaaggaatgcagtggagccattaaatccctcattgacagtttgtattctctgcataaccttgaatatcttattagcaatgtcagtctgctttttgaaatgcgatctcactgctcaaagtaacctccaacacacttgccagttgaaaaaagaaagttcctatgtggttaaatagaatccaaatttgtcaatcctaggtttgtttcttttttttttattattatactttaagttctagggtacatgtgcacaacgtacaggtttgttacatatgtatacatgtgccatgttggtgtgctgcacccattaactcgtcatttacattaggtatatctcctaatgctatccctcccgcctccccccaccccacaacagcccccggtgtgtgatgtcccccttcctgtgtccaagtgttctaattgttcaattcccacctatgagtgagaacatgcgacgtttggtattttgtccttccctctgtacattgttcttatttcatttcatactaagaagatgttataaagccaattaaaattatatgcagttctctgatgatataaaggaatgcatggctctgagggagagaagtggctaaaggtggttgccaggggcaaccagcgaaggagctgtaaattaataggcttgttcctttcagatatggcattaatcagaagccaggagggaaatttaaaataatttcttagagcaaaaacctcttccagtattagggagattctaaacatgtttttatgctaggtgaatttatgggcctcctggggggtctccttgaagggattactgagaaccaattctggagagagacctacatctggcaggatcaaaaaagacaaccacagagaaagagatgattccctaaaaagagagatgatgacagacttcaggaatcaaacctaaattaagcaagtcagggaggagatgctttctccttaaaagccctaagaacggtgtgaatcagttgacattatttctattttgttttttaaaaagtttaaaagtttccgcttaaatattgctgtttaagttcatttaaacttcagctatttgcaatatgtatatatgtattttgtttttaattggaaaagggtttggaagctcatactaatttattacttcaataaagtttagggattgcaatttagaccaaaatcgaatctttgattctgccactaactggtgctaaagttattcagattgaaaggatattttatcaggtggctctttgaaggagtgtgtgtgtgtgctttgtccatctgttagctttgttagtcaagacttctatgaaatgttttgcagtgtcattagtataatgactcgtgattaattttttaaaaatctgttttttttaaagaaaaaagctttctctcctgaatggtatgattaccaatgtgatatgataaatttttgtttctatccttggttttgaacactaggaattgtatgcataatttagcgttcaataacatagccctataatggagagatgtaggtcaaaggttatataaagttgtatatgtataggatgaataagtctaaagctatgatgtacagcagactataattaataatattgtattgtgtttgtgataattgctaggagtagattttaggtgctcttaccacatacaaaaaagggggggtaactatgtgtgatgataggttttatttgcttgactatagtaaccatttcactgcatatcaaaatattatgtggtatgccttgcatacataaaataaaaatacaatagcccttttagtttaattttagtaatacaatctgataaaataaagataaaattaatatgtaagaataatagtaaactggctgggcatggtggctcacgcctgtaatcccagcactttgggaggctgaggcgggcagatcacttgaggcattcaagaccagctggccaagatggtgaaaccctgtttctactaaaaatacaaaaatttgccgggagttgtgatgggcacctgtaatcccagctgaggaggagaattgggaggctgaggcagaagaattgcttgaacccaagaggcggaggttgcagtgagccgagatcacaccactgcactccagcctgggctacagagcgagactctgtctcaaataaaaagaaaaaaaaaaggaataatggtaaactgtaaactccctgaaatggaggctttggtcataccttactgcctagtacattacatatccttagtacctagtacagtttctgggacatatttagagctcattacatatttcttaaaaacaatcagtagttcatagggaattgtgagtatgattataggattatattttttatttggcaaaatcaaaactccaccaaatcacaaattttatttggtaaaaatccatgtaaagcagttgtgttgagggctttctaaaaagtgctgaacttaaattgttctgatagacaagaaagggagaatgagttcatatggtgagcagcagagatgagatgaagaatcccactcgtgtacagataaaaatacctagctaacattcagcaaagtggggtagagggctacattaaagttacccttataatgtggttcctctctctacgttaatgatgcataaggagaatatcatttgcagatgaagtaaataggtttgatggtgttaagagaaaaaccttagtttaaatttagcagagtttaattgagcaaagaatgatttgtgaatcaggcagactcctgaaccagagtagtctcagagactagtgcagcagtggtgcaagaaaatttatggacagaaaaaggaaagtggcatacagaagatagaaatgaggtacagaaacagtgccttatttgatacaatttgaacagttgggcccttgattacttggtgattggcaccagagtaggttacagtctgtttacacatccagtcagttacagtttaatgtgtacagagaaacctttgggctgaacttaaaataggtaaggaggcaactttaggccaaacttaatttaacaagggataactataggtgagatgatgggagtggctttggctgtagaagcaaaagacagtatactaagcattctctgaaactgtttgtagagttgttgaatttcctgttgactttgtgagccatagtaaacaagctaaatgttttgggttacctgtgtcacctgttgaattctgaagctattgcttgattggaggaaccccttccttgggagatatgcagattcagttctagactgccaaaataaagcaaatatttcaataaagcgagtcacatgaatttcttggtttcccaatgcgtataaaagctatatgtacactatactgtagtctagttagtgtgcagtagtctagtaagtgtgcagtaggattatgtctaaaagatgtgcataactcagttaaaaaaacttaattgctaaaaaatgctaatgatcatttgagctgtcagcgaattgtaatctttgctggtggagagtcttgccttgatgataatggctgctgactgatcatgaaggtggtttctgaaggttgagggagctatggcaatttcttgaaataaaaatgaagtttgctgcatcaattgacgcttcttttcatgaaagacttctctgtagcatgtgatgctgtttggtagtcttatacccacagtagaacttctttcaaaactggagtcagttctctcaaattctgctgcttctttgtcaactaaatttacgtaaaattctaaatcctttgttgtaattttaataatgttctcagcatcttcaccaggagtaggttccatctcaagaaaatactttctttgctcatttataagaagcaactcatcatctgttagttttatcatgagacctgcagcaatttagtcacctcttcaggctctacttctaattctagttctcttgctgtttctataacatctgcagttgcttttttaactgaaatcttgagcccctcaaagccatccacaagggttggagtcaacttcttccaaactcctgttaatgttgatatttttacctcctcccatgaatcacaaatgttcttaatgtcatctagaatggtgaatcctttccagactattttcaatttactttgcccagatacatcagaggaatcactatctatggctgctatagccttatgaaatgtctgtcgtaaataataagacttgacagttgaagttactccttgatccatgggttgcagaatggatgctatgttgataggcatgaaaatctccttgtacatctccctcagagctcttgggtgaccaagattgtcattgtcaatgacatttcataatattatggcggtaatattttgaaaggaatatttttttctgaacagtatgtctcaacggtgggcttaaaatattcagcaaaccatgctgtaaacaaatgtgctgtcatccaggctttgttgtttcatttatagagcacaggcagagttaggtatagcataattcttaagggctcaaggatttttgaaatggtaaatgagcattggtttcaacccaaagtcaccaactaccttagcccctaacaagagagtcaacctgtcctttgaagccaggcatttatttctcttcttgagctatgaaagtcttagacggcatcttcttccaatagaaggccattttatttccattgaaaatctgttgtttactgtagccattttcatcagtgatctgagctggatcttctggatagcttactgcagcttctccattagcacttgcttcttcacctggcacttttatgttgtagaggtgacttctttccttaaactgcatgatccaacctctgctaacttcagacatttcttctgcagcttcgtcacttttttcagccttcacagaattgaagagagttagggccttgctctcaattaggctttgatttaggggagtgttgtgcctggtttgatgttctatccagaccactaaaactttctccaaatcagcaagaggctattttgctatcttatcattagtgtgttcactgtagtaacacttttaatttccttcaagaacattttctttgcattcacaacttggctaactggtgctaagggcctagcttttggcctatcctggcttttgacatgccttcctcactaagcttaatcatttctagcttttgatttaaagtaagagatgtgaaactcttcccttcacttgaacatttggaggccattgtattagttattagtattatagtattattagttggcctaatttcactattgttgtgtctcagggaattggaagacctgaggagagagagaaaaggggaacagctggttggtagggcagtcagaagacacaacattcatcaattaagttcactttcttaaataggtgtggtttgtggtgctccaaaataattgcaagagtaatatcaaagatcactgatcacagattactataacagatataataataatgataaagtttaaaatattgtgacagttaccaaaatgtgatacagagacacaaagtgagcccatgctgttgggaaaacagtgctgacagattgcttgattcagggttgccacaaaccttcaatttgtgaaaaacacagtatctgtgtagcacaatgaagtaaagcacaataaaatgagacatgcctgtatttacttagtataggtacttctgtaaattgccatctctagcaatgatggcagccagttgtcatagttaattattttttcctgggtcttaccaaggagtttgagcccactcaaagagcttagagtaaatacaaaggagaatcaccattaaaatctttattctttatggtttttagttatgtttatttaggtgatgactgactatgcatattgcttgttttgcaaggtacttcaaatctctcttcgtagttgccctgacataaataataaaatgttttttaaaatgttacatttttatggttctgaaaaaaataaaccctcaagtcttaaatcaactttttatgtaaaacctacactttgcaggatatatatgggatttatattaattaaaaaggttatagactagtaaaacagtgctgagggctggggaggtagtctgatagagggtgaaataaagacctcactgagaggtgacatttcagcaaagtcctggcagtagagagggagagggtggtaaatatttaagggaggagtgttccaaattgaagaatcagtaaaaatgaaaagactcaaggcaggagtgtgcctggtgtgttgattcaagaccaagaagcttattttggctggaatggaccacgtctgggaagatagcaggagatgaggtcagaaagttcataagggggcctgactgagtagggctttagggtcttggaaaggctgacagtaccctgtgtgaggtgggaaaccactgtaatgttttaaagcagaggaggaacatgatctgatttaggctttaaaatgattattctggcttctatccctatttcaggaatatatttgtctgtaagcaacaaaatatctgactaatagtaatttaaacaaacagagaattgcttttcttattgttttctttgatgcaggtttctgaaattgattcagcctttccatgatgaaatcagggattcaggctcttttgttgttgttgttgttgttttctgtttgagacaggggacagagtttgactctgttgctcaggctggcgtgcagtggcacgggcttggctcactgcaacctctgcctcccaggctcaagtgatcctcccaccttaccttcctgagtagctgggactacaggcacatgccaccatgcttggctaattatttgtattttttgtagagatagggtcttgccatgttgttcaggctggttttaaactcctggactcaagtgatccacctaccttggcctcccaaaatgctgggattacaggcgtgagccaccgcacctggtccccagactccttttatcttttttctccaccatcctccacatgttggctgtccacattgtactttttgtttcatggttataggatggctgctgcagctccagacatcacatccttgttgaaggcagaaaggagggaaagacagcacttagccacatctacttggaaagctttacctctgtgttacaggctatctggatctgtaaggaaagatgaaacagttaaaatattttcattcttagctcctatagaaatggcagttaagaaatgaagaagttgggggtggatattgggtcagtcaacctgcagtgtctgacagtcatgattcatgatacctgttgtggtttatcattttaccaggctcttcatgtacattttctcattagggtcctgcagtgatcctctgggggagagcaaggaagagatggcaagcttcattttagagatgagaaagccaaggcccagagggaaagtgactgcctcacaggtcttttgatgacagggcagagactaacacagatgtcactaactctcatttattatatcctgggacctaactttagcattatatgaataccttgtatgaggcattaccaattgcattcagcctcctccagtaaatgagagaagccacctggtctctgcaagggtttagagactatgattactttgtggcttttctctagttgtcccagagctgagcttccgcaggcaatgaagaaagccaaggagtaaggaaaatccttactctctggagggaagaggcagattcatccttctggcctgtgacacagtggaaaagttcctgagaattcaggggtagagtatatttcttatagaaaaacattttaaatgcaccagaagagctctgtctgtaaagaaagtatatttcattagttttataaattgcataattattttatcaagataacaatggccctttgttttttaactaaccctgtagtttcttcataagatttgcttaaagctgggtttccaaatagctctgggagcagaacagccgcgctcgtgccagacaggtgtttttcctcctgcctgagtggatgcagctgggagacactgctcttcagatccatcttatgtccaggtgtgcgttcacccttcccttgcacatgactgatgctgttttatccaacagaccttgggattgaaataatgaatgacctaaggctccaaaatggctatgaaagaatgtagaaagcccctaggtttaggcataaataataaaattaaagggaatgggaattttaacctatgaagctgcaaatgtaaactacatttaatctttataacaacgtgtgaaagatgtgactattttattacaatgtctattttacagataaagaaactgaaatttagagctataattaaactacttacaatcagtattcaaccaaaaacagatttggatctagttgtgttctgcttatgtagctgctaacagctttctgtagtgtcctgggcaccctagcaaaactcgagggaaaaatgaggagcggtgatgaaattctggggcatcttaggaccttaatttcacagataggtaatatcacatgtatcctataaatggcatgtgttgtggcctggttcaagtctggtgattggttctcaaattcctgtgtgcttaaaattcatctaaggagtgttatgaaatgcaggtttctaggctccgatccggaggttctggttaagcaggggtggtgacaagcctgggaatctgtagtttagtaagcatccaggcttctttgatgtagattttctgcaaatgacatttcaagaaatattgctttaaattgaaatttaatagccagaatggcactaggcattcaggaggcttccagcttcacatccaggagttggtagattgatgcacttctcactaataaagataaacaagttatctccaatggagactttttcccatttattccagtttggcattgagaactttgaggagatattgaaaaaccacagtagctcttttcttggtaataatagagaaacaacaaaaaaaaaaattaagaggcaacatacagcatgctttatttactctttccctttactttggatctggaatttttttatttgttttacctagccagacacaccagaagagattctcagaggatgctaaaaatattgctcttgtcactacaggcttcacattcccgttcctctctctctgcctgaatcctcagtagaaaagatggcttttgtcttttgtctctttctgacaagaattaggtccctgggttctgagttacttttgtgataagttcttgcctgtctggccagacacactaagtccacactgaggtcaagcgtttaggtctcaggaagtcataggaccctatatggggctcaggttaggcagggcttttgtttcaaatagggagctcagtctggtaatgaaaagaagaaaataaaacaaacaacaaacctcctgaatacagcttgaatataacaaataacctgaatataagtttgtttctccattccacaaatgtttattgagtggctgctgtttgttagatatgtgtcaaggaccaatcaggtaaataatttatgattaaaagaagcgatttagaaaaccacattgtcggccaggcactgtggctcacgcctgtaatcccagcactttgggaggccgaggtgggcggatcatgaagtcaagagatcgagaccatcctggccaacatggtgaaaccccatctctacttaaaatacaaaaattagctgggcatggtggtgtgtgcctgtagtcccacttactcagaaggctgaggcaggagaatcgtttgaacccagaaggcagaggttgcagtgagctgaggtcgtactactgcactccagcctggcgacagagcgagactgtcccctgcccaaaaaaaaaaacaacaaaaaaacaacccacattgtcttttgttttctgttgaaaacctttagcatttgcttccctattctatattacaagcttttaaaacattaataagtagatcatttttgaacacttattgtgcctaatgcccagataactctattttcaggccatgtaaagaagaatatcagagcaaggatttaagaggcaaccaactgtgggtcacactttgcttctgctttccttcctattggctgggtgaactcgggcaagttactttgcccccacccccaataccccatcaagcattttttttttaaacggtaataccttcaagtatgtttctaaagattaagtaactaaagaatgtaaagcatttggcatacatttagtgtttaatgaatttcaattcatactattattgaggttttccaactgctctcaaggagactttagtacagctgggaacacagatatgtccttatttaaaagtgtattgaaagtcaacgtggcaagtttcagatcagtcgaagctggagactggaggtcgttggagtgctgttggaggaagtactgttggaggttggagcaaggagagtagttgttggaaggaacttcttagaagagccagtctcgaagatatggtgtagacaaagcctgaagctgcactcttactacatttgcaagttgatgtccagtgttcggtattctatttgtggctacacaaattgagaaatgtgaaaaatgtaagtggcagaaaaaaaggacagaaaattatttctgtaaggataagttaaagttattgtgattattttaatctgggaatgtggttcttaatgattttagtacatgagccattttggaaaggaaaaagaaaaagatacaagacaacaaaactagtgatagtgattgtgttctttatttttgttggcctcacatgcctaacagaggggttaacacaagaagtttttaatcaacctttgttaatgaatcaatgtaccttccctgttttctgtttgattttacaaagccacaaataaaagtaacttttgaaaaaaaaccaacttacctggaatggagaaactggtagcctttgaagttataccagttgcattatagtcaaggtaatcatacaatttttcatccaaaacgggacacttctgagaatcaaaggggacttttattaataattagactaagacattaagtatcaacttgaattgtcctgggtacatgggaacatttgggcatcctgattatagtttttatttattaaatcccttctcattagtcttttattagttaataccagaaacaaattaatagcgcctatggaaattaaatttacgaagtctcagtcttgcaaatgctataagaaaagttaagggattaaaataaaatgaataaataaaagttaatatttattgaatgcttatttgctaagcaattatatctctcaattatagatataaagctcagagagatacataacttccgtaaggttctgttgctagtaagtaatagagatgaatgaggctttaattctagatttgtctgacttgggactttatcatgatacaaatgtatatatatcatatacatttggcagttctggtctaaagcaaaaagatgtttaatagctgtgtttaagtaaaaactgcaattcttacaaaaaattattgatgcctcagaaacagagaatttcagaggaggaggcaaattcaaccttttcatgagaggtgagatcttgtttcctagaatccttaagaacatgctagcatctcttgcttcgtggtaatttagacaaaattgagaaaggatgtaaaccccactctttatacactaatgcattagtgtaacccaatgtacatgaatgcattattgtttcttgtcattttctccttcatgtttgaggcttattcagttttctcagaagttgagttttttcaacatatgaagaagccctgtgctttctccatagtggtaagtgctgatttttttagactggcttagtcataactttgtctacatgtaagagactagaccagggttattttgtgattcccaccttaaacctgagctatgctctcctcttaggttttggccaagactgggtacatctgaaggatggtggggatgttgtattaggaacagagcacatggtggcttcaaatctaggagctggaatcagctctctgtgttcaaatcctgattcaggcatgcagtagctgtgtggccttgggtaagttacttcatttctttgtgcagagttggcttcatgagcatgtgatctgcatagttgcacagcaccctggtcaggagggccctgcacttggtttaatgttctgtagttgctatcttgaaatgtgtaatattttttgaacaaggagatccatattttcctttttcacttggtctcaaaaattaagtagctgattctgtttcttagccttagattttttacttgtaaaacagggatagtaatattttcttcatctttgtgtacagaggatcctcctaggaaaggatatgccagtggtaaggtcaagtcaggcagtgagtttaatctaagctaatttatttaaaaaggaaggttgaacttggctattatatggtgtccacctctcatgttgttttttagcttatcttgctgtagacttgtgccttggggtataggggggaaattatagtactcttttacatgagaatatctaggagacattaggagcaaaagcagccttgttttgaaactgtggccaggtagtatcatatgaagatggtggggagggtctcttttcttcagtaaaactgggctttggtaccacaattttgggatagcatcagtgccataacttggtagactagcattgtctgagtcctagcagtgctgacaacagtggggccaaagttccctattaggtttttgaggacttcggagagccaatcagctgatgcaatcactgccgttaccaccacctaaatgaactgactttttcataagaggaaaatggcagatgccaggtagtacctcaggcattgcattaaaaacatacgtgagaaattgccttcattctctaagaaataattggaatggattttgtaaagcactggaagtactttaaaaattagtgaggaaatgacatcagagaaatttgggttattgataacattaagaactatattgtattgtgagtgtctgtggcctgtgacacaaaagttacttgatatatgagcctctttttcttctattaattaatgacaggaagaattggatttcaatgacatatatagcaacataacattcaagcaaatcatacttgaacaccaaaggcaaggaagaaacaatctttaatgaaaaggttactaattcatctcttctttataaaaactaataatggatcattattgtggtgttagaaaggttttcatatcttgctcacacctcccagctcatgaagttaaaagctatttagcatgtaagtgagatattctgttcatgattctacatttataccatagatttaaatatggatagcaaatcagcacatatctccaattaaccagtgctgatatatatttgagtaatcagtgtccacagcaatatggtaatttctgattatgcatggataaacatagttgtccccttagtcgttgaactttactataataaatatagccctttgagaatggtagtagataatgaactaatgggggatttattgtagcaggctgtaaaatagcccgatggaagatatgaaaaaatcaaaacaccaaccatttccaggagcagtagtagacaggccttaaactattgatttgacagtttgggccattagaatgaaggcccaactaagaagcagatttcccagtctgcagagcctgccagggagaagaaatatgccatttaacaagtaccttgcccaagtgtttttgcttctaccagctggcaactacagaatgtggtacagtctcatactcaccaggagacattacaacaagttcctggggagttaacaaatagaaaatacccacgcaggcttagcaggaacaaagctttaatattcttaacctgctgaaggcagtgaaaagctctcattagaacagttgctcaaatgagtcacatttctatcgccttccaagcctgtgtttctttactagatgctactttgaagctggcattgccacaggtacaacttgctgcaaacaggtcaagaactctgctctaaagttgtgcagaatttgaaaatctttattttcatttaatattagattcatttcagtttatagcctgtgtgagaatatttgccagaaggaactcttttttttgttactttggtctgatctaaatttattacttagaaacgttgagctgaatttattacttagaaacataaacaatggcttgaactactacattttccagccctttaacgtggccaaacatcatgtaacatgtcagccctgagcttggttaatttattgcacctttctgttgattggaagggcatgaatcctagaagattttgctttcattttgaaataccatctgctaaattgctaaattatattctaatcacttttttttatatgaagggattcctttctaagaacaacttagaaatgttaagataatttcacctgcaattgtgaccttgaaaaagatgcaaaatgttactgcttcattcttttggcatagtccttcaaaccaaacaggattccaacagcataattttattattccttttgctgacagttcaggttcttcattcatactttatattttcttatttatagaaaatattttcctctcaaagacataactttagaaattccaataccaaaatatgttgttgtacttatattttacaaactcaaaagaaggaggaaaaataccagtattttttttgacatttcctacaagcaagtaactcaaaagaaatgcaaaaaaccaaagagacagtattcagaaaggcaaattacaggaattaagtaatcataacttctgtgttgataaaaactcagaaaaagtaaatgacgtaattatccaaaatgtttaattttgagaaatagaacactatttatgtaaaagacatcttcatatttttgcacttttgttcccctcaactagtattttgaagggtcacaccttcagagcagagagatatgccaacgacagaaatatttaagattccacagaattttagttgatttgttgttggagttaacaataaaaccatatcaagtaatttgaactggatcagttggttgtggatagatgtcaagcaacatacatgacacagctctttaacgttctaggaaagtggctgtccccagctggatacagcatttcgacagcatgtgtgcaaacatagctggttcatccttggtgagtcatttacagccacgagtatacactgcaggtgacacaagaaccagtgcacgattggatgaaccacagaggaggcactttggtgctcaactttcagtatattctgtttttacatgtttacatttcaatttttttttcctgaggatactcagtttaatatcttctatttgagatgccttacaattgtgtaaaattcttaggtattattattattttgtttttgttttgtttttatttatttatttttattatactttaagttctgggatacatgtgaagaatgtgcaggtttgttatataggtatacacatgccatggtggtttgctgcagccatcaacccatcacctacattaggtatttcttctaatgctatccctcccctagcacccccccaccccccaacaggccccagtatgtgatgttaccctccctgtgtccatgtattctcattgttcaactcccacttataagtgagaacatgtggagtttggttttctgttcttgtgttagtttgttgagaatgatggtttccagcttcatctatgtccctgcaaaggacatgaactcatcctttttttatggctgcatagtatcccatggtgtatatgtgccacattttccttatccagcctatcattgatggacatttgggttggtttcaagtctttgctattgtgaatagtgctgcaataaacatatatgtgcatggtctttatagtagaatgatttataatcctttgggtatatacccggtaatgggattgctgggtcaaatggtatttctagttctagatccttgaggaattgccacactgtcttccacaatggttgaactaatttacactcccaccaacagtataaaagcattcctatttctccacatcctctccagcatctgttgttttctgactttttaatgatcgccattctaactggcatgagatggtatctcattgtggttttgattttcatttctctaatgaccagtgatgatgagctttttttcatatgtttgttgactgcataaatgtcttcttttgagaagtgtctgttcatatcatttgcccactttttgatggaattgtttgtttttttcttgtaaatttaagttacatttcaatatgtaaagatatctcaagatattttagataaggcagatatgattatctcaacataagattttatgagactaaggggaagcaaaccaaaaaattgtttatctccagagaggtactattttaaagaaattaaaaatgagggccaggtgcagtggctcatgcctgatatccagcactttgggaggccaaggcaggtggatcacccgaggtcaggagttcaagaccagcctggccaacgtggtgaaacctcatctctactaaaaataaaaaaaaattagctaggcgtggtggcaggtgcctgtaatccaagccactcaagaggctgaggtgagaggatcacttgaacccggggggcacaggttgtagtgcaccgagatgatggcattgcattccagcctgggcgacagagtaactccatctcaaaaaaaaaaaaaaaaaaaagagtgcatatgggagtctttctctacgtatactgaggtttgatagttctgtccagagtaccattgtagaacctttaaaaccatatgagaaacacaaaattcttttctcatgttttattagtctgttctcacactgctaataaagacatacccaagactgggtaatttatagaggaaagagatttaattgactcacagttcagcatggctgaggaggcctcaggaaacttacaatcatggtggaaggggaagcaaacacgtccctcttcacatggcgacagcaaggagaagtgccaagcaagtgggggaaaagaaccttataaaatcatcagatatcatgagaactcactatcatgagaacagcatgagggtaactgcccccataattaaattacctcccaccaggtccctcccatgacacgtggagattaggggaactaaaattcaagatgagatttgggtggggaaacagccaaaccatatcacatgttatgcataaagatgatgtttttaagaaaggaacttttcttaaagaggatagttttatgttctaaatcagggtcagcaaactgtggctcacaggtcacatcttgcctcctacctgttttggcatggtctgtgaactaaggatgattttcacgtttttaaatggttgaaaaaaatcaaaagaagaagaatattttatgacccaatgaagatgatataaaatgtaaatttcagtttccttaagtaaagttttattggaacacagtcatgttcgttcatttatgtattgtctgatgtattgtctgttacatatggctacttttgtgcttccatggcagaatagagttgtaacagagactatctcacctacaaagcctaaaatattcactatctatccctttgcagaaaaagtttgccaacttctgttctaaattacttatcttctgattttgatacaagattgcataatgaaaagtaagtgtttttgtagttaaatgggaatttatgttataattacttttgtactaatattatgaacaaataattataacagatttaattaaactatagtattattttccattggcatttgcatgacatgaaataggtccccagtaagtattttttgaagaaatagataaataaattcacacatgaagcagaaaaatattggtactaaaagaataatccattttagccactttttcttctgatttaagttctgtttttgaaaacttgtttaatttagtaatatttgtcatgtctctgaagtaatcagttgccataaatttgaaaatgatacagttgtggaatcacaaactatatttgtgtctgatttaattcagctaaatgtgatcctaattagatgcatggtgttccagctttttgtgttcctcagttcattttttgtggtttctttgtgcaggcagtattaaacatatatgcaaatctctacaattattcacactgagagacagaagcgtctgtgttctgtgatcatccgtttatacatttaaaaaccttatttgtagagaatcaataattagatggccttggaatataaatttgacatttctgctgtacagtgatttccttctggtagagtcttaagttctgagtttgaagcttccatgattattgattataattatttttaaagttaatgacttctttggggatttatttgagactgaagtaagtccaacatgcaaaacttctaagttagtaaacaaataaatctccaatctcatcaagcaagttatttactggaagccttgtaaattagaagcatggtgccccacaattccattaataaaatctcatcagcataatttaatgtcacatatacagtattaggttttagagccagaaccacaattactatgagagagagtttaactgtataaatcttaatgggataaactttcaaaacagtttagaacagacaggtataacagaaaaactcccctaggtaaataatattaaaatattatttaatttatatttatgaaattatcagccaaataattgtgatttataagatcgtttcaacaaaaaggacagcaactattgctcatctgtaaaatagaataattctattagaatgacattgacaccatattaatttttatttacacagtttgatataaaatcaaaattgtacccatgttatttataagcatgaaatctatgggcgtgtagaaattttcagtatgagttagaaagtaacaattaaaaattttatggatttcttagtccaaattcaacattttttctctacgaatgtatgaaacttaattgatactactgagtattttaactgacttctaattgtgtttgaaggatgtattatctatgggttctatagctactgttttctataggtttctgttctaagtcagtgtatctatagggatataggcatagatatagatattactaaatatttttatcataaacaaaacagtaaatatccttactttttcttcttatggtttttaaaacacatttaaatgattgatcgataaaatagaattgagagaaatatgttacataaaagtactttctagaaagtaagggagaaaaattggaaataattacaactatcaaataataattatgtaacagttttacatataagcctttaaagacattaaaatataccaatttataaatataattcatgcaacatgaaagtatgttatgcaacacaacaatataatgaactctaccactcaaatcaggaatcagaacaatactagtagccttacactgaatcccttcacaaatagtgattattttgcattttggccttatttctcccatgcctttattttaaaatagttttatgtcatatgtatatatgtatatgtgtgggtgtatgtgtgtgtatgtgtatatatagccaaaagtaggttgcctgatgttgcttatctttgaacttctttttgtaatttttttcatctttgatgttgtgactatactttattaattttctcatagtaaaacattccattgtgtgagtataccacaagttatttatccatttttctatcggtggatatttggaccatttccagttttcttcccaattttatatgtgctgctatgaatattagtgtaaacatcttcctttaaacatatgcaaaagtttttctaggcatataatgaagagcagagttgcaagaccatggtttatccaaatgttcaacttggatattgaacatttatgttcagtaacataaataacatactaaattatcatataatgacaaactgttttcaaaaatgtttgtgccagtttacactattcctggcaatattacccttgatccatatcctcacttaaatttgtattgggtattgttagttttttttttttttttttttttttttagacatggtttcactctgttgcccaggctggactggagtgcagtagtgggatcttggctcactgcaacctccacttcctgggctcaaggtatcactcctgtctcagtctcttgagtagctgggagtacaggcatgcaccaccacgccgggctaattttttgtattttttgtagatacgagttttcgccatgttactcaggttgctcttgaactcctgggctcaagcgattcacctgccttgtcctcctaaagccctgggattacaggtataaactactgcacctggccagatttcataattcatgctaatctcttgggtgtaaaatgatctcattgtggtcttaattttcatttgcttgattactaatgagagtgatcatcttttaatatttttattactattactttttttgtgtgtgaaatattgtttgcttgttacatgttttgttcagtttttcctcccagttaggttgtttgtcttttttcctatttatttgtattaaattaattttcctaaattaaattcagtttcctaaaaatacaacaaaaaacacaagcaaaatattttgagcacaactgtttcaaaatgttatgtgaattctctaaagcagtacgttttatttattgaaatggtctccaacaagaaaatgtctaactggttaaatattggtttaaaggtagatgacagactaaatcatatatatagataggtagaaatatgtttgtgttttttcagcccaaactaagagtgatcctttatcctaaagcctttagattctaacatatttattattggaacaaggggaatactaaatttgggttgacatttttatgttatttaaacatcatttatattatacttgtactttgaaaagtcttccaatatccatggaacaaaaaagttcagaatgataactacctaagccattactaccatatctgtagatttttttaagcctttgtcagtagtctatcattatgccattatcaatataacatactatcgataaaaaggtacttaaatatcattatactaattattttaattatttaaaatacaactttaaaatccaattgtgtcctaaagtgatatttcacagtaagaggcaaatgtattatatgaagcatgagctttccctgttgtgtctttcattctttccctcatctgtatcagaaaaggtcacaatctggggataattattcacttcaccttttctacctggtgaggtggcttgaattcccaagatctgtccttttcagggcttcatactgggatctcaggcccccatgctaagcctaatttacttatcgacttcatatatttatagtggcataacaatgaccatatggattctctgctaaatatactcttacgttgttgcttcctatataaaaaagcactcaatcctactggtaccatcagaccagtgctccccaggtgatgtgaaagtttatctgaaatccagtttctgaagaataagtaaactttatatgagaggacttccctgaaacgcttgcttctctgtaccatctaatataagcagaatttctgaaaactacattcagctagggttgctgtgaagattcaataacagcacctgatatataggaagttttcattaaatgttaccagtgaggaaaatgatgtgattttgtattgttagaaatcttgacacatttggcatcatccatgttttgctattaattcgtaagactacctcattaaacctttattttgaatgtacaaacatttctcatttgtagtctttggaggcctacttttacacgtgttttgtttccataattacctaaagctaatttgacaggtactttgtctcattttttttttctactacagtgtctagaaatgtgctttacatagtgctcaataaatgtttgattaaattaaaacaatgttaccagggcatctgcatattataaccacagattaagaaatgtagatacagaacatgtattcatttgaacttcaaagtacgaatccaaataataaagctggtatcaaggtggctagtggttctggggctctggtataatcactctgtctggtttgctatcactaaattaccaatagggagcttgatctgagaacacatgcaaaagcagatcaccttcagctcccctctacaggggttcaagagtccattttcagcaatgcagaaaatacattgagaaacatatgtttaggggaaagcaaaatggtgttttctcacctgcgaaaggtagttgctaataatgcattttaactcttgtatgccatctcactaaatctgtactactttgaaattatagaacatgttttcttcctggaagacagaaattatcttctttatccccatgcctgatcattactgaacataacaattacaaaatgtataaaaacactgtctctttgggctccttctttagctatttttttttctagagaagaataagaataaataaagcagagcttctttcaaaattacaatttcttctggaatcacggtttcagaaaaaagagaagaggatgaagagtatgagaaaggagagagagagggaaggatacagagaatagcacagggttttaaataaatttaagtattctcctttaccaaggtttcttgctataagtcatctaaggtcaatttactcccaacatcagttttaacaaagaaaagtgaacaagaaagctaacaacaatggaaaatgatgctagactttgccagagcttttatttcaacaggatattgagtattaaaatgctttggcttggagtatcttggatgttgcttccaagtcttttttttttttttttttgagatggagtcttgctttgttgccaggctggagtgtagtggcatgatctcagctcactgcaacctgcgcctcccaggttccagcgattcccccgcctcagcttcctgagtaagtgtgactacaggtgcgtgccaccactcccagctaatttttttttgtattttagtagagatggggtttcaccatgttggccaggatggtctcgatctcctgacctcgtgatccgcccctctcagccgcccaaagtgctgggattacaggcgtgagctactgtgtgcggccacaactcttgattcctgcctccattgtactttggtcctgttttccattccagatctaggtttgttctgcatgctggccttcaactttgtttctattcaaatccagacctgctttgctttctcagtttctggctcaagtcccaagcaaaattctatctggatagatcagagattcaaatggtcaagggccatttgcaagcagctctttcgctatcaaacaaagtatgaaagcctagtttttagaaacagtttttacttttagccatgaaatgcatgagcatagtacatgaggtccaacaatacttatggcttatattacaacaaccagggtgacttcccttggtcttgtttccatcggacagcaaatgtgatgtcattttaattaaattcattgtcattatttacattattatgactttataattataaattatataatatataattaataattataaattatataatatataattaataattataaattatgtattatataattaataattataaattatataattataaattataatttgtagaaccaagccaaagagtatgatgccttttttcttatgcctcttatacacactgtcatagatctattcctatcctagttgtttttacttttgatctgtgccacaaaattagtacactttagttccaaattatgtacaattatattattaatttcacaaaataaaatagctcagtcagaattttaatcaatattcgtattgccctaaaaatactcttttattcactaattacttcaaggtattttgagtcggaagtgtgttggatttttcttgtgtgtgccttagaacaatgtgctaaacatacaaaaagtattcagtaagcaccttagttgatataactgaatttgcagtgtttttttcttaccattctttctatgtgtgtatgtatgtatgtatgtatgtatgtatgtatgtatgtatattgagacagagtctcactcttgttaatcatgttggagtgcagtggcatgatcatggcttactgtagcctcaatctctgcaggctctggtgatggccccacctcagcctgccgagagcagctgggactataggtgtgtgcccccacgcccgaccaatttccctattttatgtagggttggggtgttgctatgttgcccagactggtctcaaactcctgggctcaagtgatccaccctcctcggctttccaaagtgctgggattacaggcatggaccaccacacctggccttattatttttaaattgataagttcacaaatgtatagcattcaaaaatgtttttctctgcctctctaaacttgacatgtatttaccaaaggaacatataatctgtgcattatttgtttataaagtacaaaaggagctctaaactgatataaaatagtggttctcaaactttttgatatcagaagtcttttacattcttaaaatttattgagcaccccaaacatttactttagaaaattctggaaaatacaaatgtacacaagcacagcattctgtcagctgatagcgtgatgatatcatatgtcccttagcctctggaacacttcactgtagctttagatagttaagagtgaaaaagtcaaataacagcttagttctgttataaaaacagttttgttgtggcagaactcaaagggtcttggtgtctccagggcttcccagcaacactttaggaatttctgtataaatatgaagtggtaataataaatattttcagaacagcttaaagtttacaatgtagtttcaccagtgttttctctttgatttcccccataacactgtgagattaattagtatagtcatgacagtattatataagtttacaggtaagaaaaaattatattcagggaaattaagtgattgtctcactcaactaataaaattaactcagatcttctaattttagagcttgtgatttttccattatattgtatttcctcttaaaaaatttccataaaacaaggttagttgagttaaatctagttctatcacagcctctggcgcatgaggctgatttgaattagaactgatgtctccatttagattatgagtgatcttgtgaaatctaatgtggtcctgggtgacacctgaaagtttaatttcattcaaggttaatctgaagatgtcgggagacttccttagatggatcttaggtagttctgggaatacacctatcatgaacctataattctgctgcagaatttacctggactcttaggcacaaatggttaacaactgagctataccactcagggtcactggatacttgaacagacttgccaaatctttcctgggctgaactgttgcctccagcactagactaaaatggccaacagccaggagcaaaagtatcaaacactatatgcctgggagctggccctagtgtatttatttctttggaggactgcactttctatactgtttttaagttttaacctttgggcaaatcaaaatgacagcacctgtacaccctgtacatcaaaagggacctggtcaaatgtcattctttttctctgttgctgctcagggctttgatacttcaagtattaagcatgaagacaatatggatcacaggtataaaggacacaaatatgtgctgggtaagaagctataaataacaatgttaaatgttctttgaaatgaatgaaaaggaaggatgaatttatagaagtggtataaaaaactccttgacaatctttgctctgccgcaaactgaactagttagaagaaatataataaatgctttattgaaatacaaaaatggtaatatcttctaaactgtatctttgatgttttacttagctgctaaaataaagcaaaataaataaagccaccaccctgacaaccacaaagctcccctctgttgactaggaggagaaagtctctgtttcttcacttgacatttaggtgctttttgtcagtcttgtgccatactcaaaaccaccttttccacttggtctcctcttcccaaacaatggcccctaccaccttaagccaggttggcttctgtattgtcccaccccacagattttcacctctgcacttttgctcatgtgactctctcagcgtaagagagtcacatgagaatacacttatcatgaatctataattctcctgtaacacctttcctcactgatttctacccattcttcaagccattctttcccagtctagtgaatagcaatttcttcttcctctaaccttttacagtaggggatagcaaactttttcttaaagacagtaagtattttagccttggtgggccataggtttcagttgcaatattgagtcttcttgttgtaaataaaaacagccatagacaattcttaaacaaataggtgtggctgtgttccaacaaattatctacaaataatttgtaataattattaacaaaggagctatattttgccaacccatcttctagagcatctattgtgattagcaatacttaccacataatgtcttcttttcttattgtcttatgtgtttatcccatacttgatcaactagactataaatttcatgaagacaaccatagcattttttctattccacacatcaattctgatacattaaacatggtatatattcagacatagagatatttgtgattgatttaaccacctttaaacaatgtttttaatttaaattttattttagattcagggggtacatgtgcaggattgttacgtgtgtgatgctgaggtttgggcttctacttatcttgtcactcaagtagtaaacatagcctctgataggtggtttttcaacccttgctcccttcccacttttggattctccagggtttattgttcctgtctttgagtgcagggccccttttatttttatcttactttttatttatttatttatttatttatttatttatttatttatttatttatttattttgagactgagtctcactctgtcacccaggttggagtgcagtggcacaatctcggctcactgcaacctctgcctcccgggctcaggcagttctactgcctcggcctcccgagtagctgggattacaggcatgtgccaccatacccagctaatttttgtatttttagtagagatgcagtttcaccatgttgctcaggctggtctcaaacccctgacgtcctaaggtgatccactcgcctcagcctcccaaagtgctgggactacaggcatgagccaacaccctcagcccagaacaccttttaaagacaagaaaaacacttaattcctctttacttccattcttgtgcctttttgtttgtgtactaattcttaatcctgtatttatgtgtttttttttgttttttttttttttttgctgagtgcaggcatcacctcttgctgatagagcgtattacctctgatagagtgtattacctctctatgttaaggtatacaaagatacatattaaaacatatcaagataaatactttaagttatatcctcagaaaaatattttgtgacttacatattagtccgttttcatgctgctgataacgaaaagagatttaattggatttacagttccacatggctggggaggcctcagaacctcatggtgggaggtgaaaggcacttcttacatggtggcggcaagagaaaaagagaatgatgcaaaagtggaaacccctgataaacccatcagacctcaggagacttatttgctatcatgagaataacacaggaaagaccagcccccatgattcaattacctcccctgggtccctcccacaacacgtgggaattctgggagctacaattcaagttgagatttgggtgaggatacagccaaaccatatcaactttcttgttggcagaatgattaggatgaggcctcatgcttagcctgccaacatagcactcatttcttaggagaacaaagtaccataggttgggctcctgatagaaagcctgttgagttttgccatttaataaaatagagtgcacagtgtaatttgtacaatgtcaaacttcaaagaacaatttataacaataatgtttctatttacagcgtgccactaaggaagggacaataaaatgtaaagtttgacagtgtctactgattgatattaaggtcagaaggggggaatatttctattctcagcattttattgtcagttggcacaacagagggcagaatacaatcaactttgcattcttttcaaaattcaaggctttggaaaggacagtattctagatgttatatttacccaagggaaactggagtgtaaaaacagaaacaatttaaaactgcatgtttctagttgtttcttttttctgttagcctcgagaaaaattctgataaatgtagtccagttataggtttttattcatgctgtattgtaaccatatatttggatatgttagctgttcatttcaaatactacacccacattttctggtgacatagatggggtcagtagattaatgataagccatatgatttgtagaactgatgaggggggaaaaaagtatagccatcccatgtgacacaagaagatactcagctcagatgcctcatcttggaatatgaattagcatggttcactggtaacaaagaatggttatgctgatcatagtgaagaatccgatatgtatcagctgcatctctttataataaaataacacagagctaagtatagaaataagtcattctcttgccactgtgtgggattaaatgctcaactttgtgtacgcatttattaccttctagattcttcacatgttgctaaaatcatagaatttctgaaagcatatttccagtcacatcctctgacagggtgttcctttcaaaaagcaaagcagtgtttggctgagctcagtacagtgggccaggtactgatgggtaccatcagagcttgacatttagaactaggggctttcctaagtgcagtgcagtgagatcatcttgcctaggaggtaggagatgaaatgctttaatgctagcttgtgtagaagacattacttttattaccatctagggaccatccagaggcatattgaaataacaacacctctcgcccacacataggagtgactttgccaatggaatagctgttgttgaagctaactcatgggaataaaaatactgaactccttcaaaagcagccacacactatagaaaaccagacgtctacccagagaactcaagtggcatggaaaagcatcagcagtctccatgtagatcctaagaggctaagaactattcattctttcaccagtagtttttgagctccaactctctgccagggggtgaaccatacaaggcagacataactcctgtgaacacagagcatatattatgaccacataatcttgtgaatacagttttcttaaattcaataaaggaggaagagtacaaagtgttctgcacttctgcagtacaggaaattgacttgacctagtttggagtggggtttggagcagaaaaattcccttgaagcagtgacatttaagttgcaaacataaggatagaaattagactgaaatgggggtgggaggaaggagcaagtgtttcagagatagggaataagactgtgaaagtttgagatgagcatggtaatactccgaatccgtaagaacgctaattgggcttggagttatattaggctaaatcctattttttttcagtgtctggtcaagggagattttttttctgaagaaagaataacatgccagaattactaacattattcaaattaaattatatattcacagctccccagagtataaagctaaagactttgtctctctaactttgttatttctaattgatactgttttcatcaatcccagtttgataattattaatataattgtatgattttttaagtttctgaaatgtttttaacctgttttgcgtatataatttcattcagttctcacaattaatatgaacaagaatcacagtgtccaggatccctctctgggggatggaggacattggcacaaacctcacagttttgtattagaccaattctaatgtttacaatgaaaatcaggtgatggatgttaacaaaaaaccatgtttgatttctcaatccaaccatgggaagtttctttttcttatttctaggaagttataaaccaatcatcccaatgaaatcatctttttttcattgaatagcattacatagatcttttaagaaatatttactcattactttttcttagatgctactaagagacagaatcatctaagggacagaggtggaatgtgagaaaattgatctttcttggaggaaggcagatagactggatgaccactaaagatttctttagctgtgtgtttcagtggcttaagaattcttctgtttaaagaaatatgaactggtttgcatatcattgtgcatgatttagtattgctgtggtttatacagggatgatttaatattgttaatttactcacagagtatattaatcaactaatagtatttaaagggctagagtatgaaaaatcaagcagaatgaaaagcaaaacatggaagaatctactttagctgtgtcccttatgatgtattacgacccttgtttgatacatgactataataaagcattgccattcaattagagtaagttaactttaaaattaatattgtgcctatgcttgattcaatttaaagggctgaagaaagggaagagaattttgaaccattcactatgcattagctccaatgacagaatatagatcatagtaagtcatgggcttctgcccagttctgatctctgtgtggtgcatgtcaatgtcaaacttaaaaaatgtgcactttggttagagcggcatgcatttggtaattggacagaagtgagtggaatgaattggaggttaaagtctagccccttggaaatgttttgacactttacccaggagcttgcatttattaatagtaatggttcctaaatttttattttggctggctttctgattatattgaaagacccagaaggagtaatgaaagaaatgcattagtgaaaagtattaaaaaattacctttgacatctctagcacacggagcaattctagatggttgataaaagagcataaatcaatcgacacaaatatccccttaaaccttgtctttcatgtccagtatttaattcttcccatttctagtatgaagataggaattccattatcactaagaaaatccactctgggcatccaagtcgatatttctaaaaattcactcactattaattaatgaatagtgcaaattagggaaataacttgcatatgtgttagtgtgtgtgtgggggaatactcaactaaaaaggggagagagaaattaaaatgtaagttcttactgtgtgccaaggactttgttagacactttttctaatttataaacaactagtaaatattatttgtctgaaagtatttggcattgtttcatacgtatgtaccgtcatatttttacactggtaatgtgatcctaccagactaattagttaaaatattaccatgttggtcaacattttttgtcaggggtgggatcagggcaaaaaaatcgtctgagcattaaaaagatgcatgataccactacaacttgttcttgctgcttctgtagtgaaaagcactgtaagggaaaggacacttgtctgtgctgtacatgcacatgacccatgtacaatgcatattacacaagcatgtactagcagtttagtgaaagtctgatcctgaagcgttaacacttgttaacatttttatttgctttattaagtttaatattcttaattctttttggctttttgtatgtggaatcctcaaaacagaccattttttggcaaaaactttgagaaaaataagtaaattcattcaacgagtaggattgggaagccattttgtatgaatcttatgttgagagtggatttgaatagaaatctaaatttctgcaaatagaaatttgatgggaccactgggaagtaagtagcaaagtggggaaagaaatggaagatatgtgtttagttgaatagaggctggatagtgagtgtgtattagtacagaagtgagaagaaaaaatgaaagtaggcctttagattcaagagaaagttgcagagaaaaagcctggaagatgaataggagagagagaagaaaaagctcggttcaaagttgtcacttattttcaggttaggtattcattttcatgactcaaagatacaatagcttccaaatcttcaccagtggccaagttggaattataccagttagaaatactgaatgggcaaaaactggaagcattccctttgaaaactggcacaagacagggatgccctccctcaccactcctattcaacatagtgttggaagttctggccagggcaattaggcaggagaaggaaataaagggtattcaattaggaaaagaggaagtcaaattgtccctgtttgtagacgacatgattgtatatctagaaaaccccattgtctcagcccaaaatctccttaagctgataagcaacttcagcaaagtctcaggatacaaaatcaatgtacaaaaatcacaagcattcttatataccaataacagacaaacagccaaatcacgagtgaactcccattcacaattgcttcaaagagaataaaatacctaggaatccaacttacaagggacatgaaggacttcttcaaggagaactacaaaccattactcaatgaaataaaagaggatataaacaaatggaagaacattccatgcttgtggataggaagaatcaatatcgtgtaaatggccatactgcccaaggtaatttatagattcaatgccatccccatcaagctaccaatgactttcttcacagaattggaaaaaactactttaaagttcatatggaaccaaaaaagagcccacatcgccaagtcaatcctaagccaaaagaacaaagctggaggcatcacgctacctgacttcaaactatactacagggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactgactagccatatgtagaaagctgaaactggatcccttccttacaccttatacaaaaattaattcaagatggattaaagacttacatgttagacctaaaaccataaaaaccctagaagaaaagctaggcaataccattcaggacataggcatgggcaaggacttcatgtctaaaacaccaaaagcaatggcaacaaaagacaaaattgacaaatgggatctaattcaactcaagagcttctgcacagcaaaagaaactaccatcagagtgaacaggcaacctacagaatgggagaaaattttcacaacctactcatctgacaaagggctaatatccagaatctacaatgaactcaaacaaatttacaagaaaaaaacaaacaacctcatcaaaaagtgggcgaagcatatgaacagacacttctcaaaggaagacatttatgcagccaaaaaacacatgaaaaaatgctcatcatcactggccatcagagaaatgcaaatcaaaaccataatgagacaccatctcacaccagttagaatggcgatgattaaaaagtcaggaaacaacaggtgctggagaggatgtggagaaataggaacacttttacactgttggtgggactgtaaactagttcaaccattgtggaagtcagtgtggtgattcctcagggatctagaactagaaataccatttgacccagccatcccgttactgggtatatacccaaaggactataaatcatgctgcaataaagagacatgcacacgtatgtttattgcggcactattcacaatagcaaagacttggaaccaacccaaatgtccaacaacgatagactggattaagaaaatgtggcacatatacaccatggaatactatgcagccataaaaaatgatgagttcatgttctttgtagggacatggatgaacttggaagtcatcattcttagcaaactattgcaaggacaaaaaaccaaacaccgcatgttctcactcataggtgggaattgaacaacgagaacacatggacataggaaggggaacatcacactctgtggactgttgtggggtggggggatgggggagggatagcattaggagatatacctaaatgacgagttaatgggtgcaatacaccaacatggcacatgtatacatatgtaacaaacctgcacattgtgcacatgtaccctaaaacttaaagtataataataataaaataaaataaaataaaaatacagtaatctggaataggtcaaaatgagtgttgctggtgcttggagacagttcagataggtatctataatgaattttgaaataggaatataggatgactcctctaagagtccaatttaataagttagagcagagatggataaggtcagcttttgtataaaatggccccagggtcagtagggtctatagtaactggattgaacattaacatatttgaaaatagaatatgcattggtcagcattgcaaacatagaaaaaggtgagttgaattcattcagccaaacaaatatatattgaatgctttctgggtgccagacagaggctatagtgatgaacaagacaggcaatgtccctgacccctcagaggtcttacagtcatagaggtcagtgatggcatgatgtggctgagcattgtccgggagagaggctgccagtgatactgttctccactttccagaacatctctcctttgaagacagagacagcaggcatttttgcctattattacagacttaagtcatctcacaaatgcccttttttttctgagaccatgctaactctctaagtttctgatcataatttggattcttagatgtgtctgcctatgagaatgaataccagagtcaagcaaatatgagggctttggtcctggtgatgtttacatttctcttttaaaatatggccattagtattctgtgtgttacatcagtctactaagggtatatccctaagggctaaaccccttcttagacttctgccaaagtcagatttttgagtctgaaggctgggagccagatcctatactatcataactttcttgagaaatagccagctgggctcattggtgacactcaaaatctgtgttaactgttcttgttttgccttaacatttctaaaaggaataggtcttagtctctccaaataatattgaacatatatctgagagatactgctttcagtcaagtgatggaataggtacatttatcttttcttgtttccttatagtggttcccttgtgtcatttcttgatctcatggcagacgtctcttgcctcaggtatggctggcaaagggccagcccatgatcttatgggatgtctttcaactgttcaggggatggagcagtctcatgatgtgttaatttgcttttgacatctggttcttatccatctgcttagaagtctgctgttattatttgattactggcaaagccaacctcaggctatctttattttttttttaaagtcaacctgaagttatttccacttttctaaagagatcttaagtatcaacagctaattattctttaacaaaatagcaacctctgtgctttgcaacctcagccttttcttggtatcagcatttttgttttttaatttttttaaaaaataattattccatacaaaatacttaaatagatttctggcaggtgaccattgccctttgcagatctctgtgatgttttgattttcatgccctaaatggtatgccacagtggacttggttgaagaaattaatagtaacactatacttttaacacttttccataagatggtaaaaatacttgggtatatgtggaagtttaattatttacattttttaaaaatagtgatatagtagggtgtctaaaactttaaaactttttgttttgtttttcaaacttttggtttagcagtacaaccttgttttcagataaaatataaagaacctgatataataaagtgataaaactagagatagtctagatgaagcctgaatgcattggcgaattgggtggagtcctggcttagaactgcataaaacatgacttcaaagtctagagtttagaatttcaatatcaaatgttaccaatgaggaggagcatgagaaagaaacagaataagaagcagaatattattttgccatatgtatatggaggagcactttgagaagtccaccaaaacaagtgggatattagtaaaaaggctaaaatgagcctagaagctatagcagattggtagctgagcaagccatgtagtggtgaggacattaagaatgatgacctgatattgctttaatgggaatgctagttacagattgcagaggaacagtaatatcagactaaaaaaaagcctttgggggtgtttcaaattgtattaaaattagaatgattcttttagggcaaagaaaacaggcatatcaggactccaaaaataatgacaaagtttaattcagttcatttatcctctataatgggatagacatggtgctaggtatgtttatattatgtagtgtactgaaaataatgctgaagctaaaaactgaaaacacgggttattttatgccccataaacgtgccagatgggaatcactagcattctgttatctactaatatgtgggataaggttgcaaagtgacattatatatataaaagaattgagatttattcttttcatttggaatactggtcatttttttatgggcagtactagcagagagtttggaatatatatagatatctatgcatgcggagaccaataaattctattaaacatcctaattgtctcttagatttactgcacacgttaatgcctaatgcttcagatcatgggaatatttaatgccaggttcattctatttttagctaaagcttactcattgccaagtgatggtgtgttttcacccataaaatataatgcttgatgatactttgctcatattgtgcttattctcttttgtctgtaacatcccccaaagcaaaactcctctctgcctcttaaattttcctcaagttattgctttatcttgtttctcatcatcaccataaaatttctagaaataatagtttctatcactcagtatttacttctcaatgcactgcaggttttcttctgcatctccagtgcttaataaaagtactcacttcagagccgttactggtgacctgctaaacaccagctctggagtgtctttgcagcctctgtgctactgcttgtccaaccgtcagtttggtgcttgtcttggtccattgcagtattttgctgtaataaaatatgacacactgggtggattataaacaatagaaatttatttctcacagttctggaggtgtgaagttcaagattaaggtacctgcagattcggtgcctgttgaggaccatcttctggttcctagaaggtgtcttcttgctgcatccttacatagtaaaaggaaaaggcagctctctggggactcttttagaagagcactaatcccattcaggagaactctgaatcagattccaaaggccccacctcctaataccaccaaattagagattaggtttcaacttatgaatatgttgaacatatgttgaacatacgcttaatacatatgttcaacataatcctatgttgaaacctaatcaacatcttaggttggtgatggtgccttcgagtgacacaaacattgagaccatggcagtgctatttgccttaagtatcactctcccgatctgctttctccttctttgactatttcctttcagtctctttcatggactgtccttcctctgtccattaacgttccctgaatgtgggtccaaatcttcagtctttatagtttttgccttagtttgggactcatcacttctcacctggtttacttccggagactcccaatatcctcatagcttgttgggcataagtctctcccacctgttccacatcatactacatactgtgggaagagcagctgtccattaaaacaagcctggtctttcactagattacttaaaacatccattgcgcaatggatcaaatgagaaaattcttgcatggcatgcaaaccccctcagagaccggctgtcattttctgtttctgtcttatgtccttccactctcctccgtacaccagctggaatggctgcctctgcacttgtgttcctgagcatgtggctgtcctcctttctctgtctagcaatatctaaggtgtttaatccctgcatgcctttttctttttgatacagcaagggtaactgtaatgtctgtattaagggaagattgtgatggtcaaaggaaatagggcgtatgtaactgctttattttctacaagcatcataaactgatctatacacatttatgtagttcttgtttttagatcactttgaggtgggcttgggggaatttgtggaggatactcaggaaaccgataaagataattaaaagtttaaaaattagaataatgaagaacaggaaaaggaacaattattcagccaagagaagaaaagcctgaagggagatataagaaagaaaaattatttcctagaggacagacttagaccatcctccattaatattgagaagaaagcacagcaaagcatataggatttatgcttgctgtaaggaacatttcccacattaagggaatcggctatctagaatagtttattcattaaactccccaaatctgttcatctgtagatctaaaaagatatattttcttctgtctaacccatgtaggtatgaagaggcctgaatgtggagaagtgagttaggtgatttcttgcagttcttttttttcccctcagtaagtcattctttcattctctgtctctctcttcctctatccatctctctaaatgcctctctctggctttctttctcttcatctctgtaatactatttctccctctcctttttcttccatttgttctcttacctttctctcaccattcctgaatactttttcatttgagctcctatcctccgagccctaaaatgcagtacaaacaaaaggtttcagaaatagtccaaacaccactattctacctatttttttggtcttaagttcctcatattttttggttggcgtaaatattttggataagaggatgatatggtttggctgtgtccccacccaaatctcatcttaaactgtagtttccataatccccacttgttgtgggagggacccagtgggaggtaattgaatcatgggagtggttacctccatgctgttcttgtgatagtgaatgacttctcacgagatctgatggttttataaggagattttccctcctttgctctgcacttttccttgccactgccatgtgaagaaggacatgtttgcttccccttccgccatgattgtaagtttcctgaggcctccccagccatgctgaactgggagtcaattaaacctctttcctttataaattacccagtcctggaatgtctttattagcagtgtgagaatagactaatacaaaggaaaatttttatttctgtagagttaaggagagaggcatttttatgatcacttactttacattactttataaggtcttctttcttctgcacttttctcagcataactccatatctttttttttttttgagaggaatttttcctgtaacttatggacaacatatttttgccagttaactataaagttccttcattacatggtattgtaatgaagtctgagggaagaggacattaatcagtaccattactctggggagcaagaagcaccacagaatgccctgctgaactttgaggtatatatttgtaggttcaatttctaacccttgcatttagtaggttgtacttgtttcttatattatctttctacctatgtgtgtacttcctgcctttcttttgatgatgttggtggcaatctgtctctcattaactttgcttcctatttctcctctattactttttttcagttcttctcattcctttttaatgtttagccttttgggggcagatttcatcatttactgagattggctcctcaaggatgcagtcctgaaactttgcatgctgatggatcccagcacttgctactggaatccacacaactatgaggtgacaaatgttaaacttgtattatttgtgggaaagtcacatggctgagtcgataccatcatttttctttttcttttctcttgagaagctacaatatctcatctttgactttttatctagtcttcactagatttccccctcaagcacttttaaaacatatagataattgaattttgttcctgttttttttctcactaactttcatgtcatagttgaagagaactatgtaatgttcattatcgcagtttcattgtgaatcaacaaacccctgaattaaaactttacagtataaactctaataagaagagtgaaattggcacttctggaaagcaagagagaggagcagtggtcattataagcaagatatggagttaacagtttgtaaatgatcactcattactactatttcaacagatgctgttaaatggaagctatcctggaaaacttatttggaattgaatgtaaatattgttgctataaagtagaatgattaattagtatattaactataacaggaatataaggtcatttaaattatagctttgggtttcctccctcccttcatctctccattcttgttttttctctctccactcctccttccctttatttttttaacaaatattttgagcatacacaatctcatcaatcaaaattatatcaagcttaaatgtttcagtcaactggtaattagggttttttttcctgtcataaatatttattgagcacctaccatttgctcgcttggtgagttagtaaattaccttatttatgtaaacttatttaagtcccacaaaggtcctgtgactggtattattatctccaattttccttaacttattttctttctccaacacttttcctttatgtggctctgagtttctgacctatatactttttcttctctctgaagaacaacttttaacatttcttgcaaggcaggtctactggcaacaaattccctccatttttgttcatctgtgaatgtctttattctcattcacttttgaagaataactttgcagggtacagaattctagactggtgttattttttctctcaatgcttttaacatttcactccactatcttcttgctgtatggcttctgaggagaagttagatgtaattcttatctttacacctctgtaggtaaggtatttttttcccctgggttctttcaagatttttaaaaaatatattttctatagtttgaatatgatatgcctagatgtagacttttgacattgatcctgcttggtgttttctgagcttcctggatctgtggtttggtgtctgacattaatttgggaaaattctccatcattattgcttcatatatttcttctgttcctttctctctttctctttctgttagtcccactaagcttacattacaccttttatagttgttccatagtttttggatgttctgtttgattttttttcagtcttttttccctttgattttcaatatggtaagtttctattgacatagcctcaagcacagagagtctttcctcaagtgttcctagtttactaaggagctcatcacaggcagtcttcatttctgttacactggttttgatctctagaatttttaaattatttctatctctctgcttacattacacatttattcttgcatgttgtctactttctctattagaatctttagaatattaatcaaagttcttaaagaaaatttctggcttgataattccagcgttcctgccatatttgactctgattctgatgcttgtccatttcttcaaagtgtgtttttttttgctttttagtatacctggtaatcatgcattggataagagaaactgcagtaaatcggcctttactaatgtggtagtaaggtgtgggaagaggggaaatgttctatagccctatggttaggtctcagtgttttagccttggactgtgaacttgaaaagtgctttttagtctccttcaccaacctcctggcccctgggtgggacaggatgggtggaggggtctagagttgggtatttcccttccccaggtcagataggctctgatcaaatcccaataaggttaggcatcataaaacagtttctcttgagggcaggtctcgtgaagagcagagcgctctgtcatattccaaaaggagtgttttcccctgctgaaagtataagggtgttttaaagcaattttcactctgagaacctggtagagttccaggaagtaaaacttctaaatttcggtacctttctatgacttgctccctgtggagattttaactctcagatgtgtccataccgagcctctagcaatttatcaattacagttcaggtttttctgtcctggcactggttccctcagaggtttctacttaagggtttcttctaagttgcaattttctgtattcacctgtctgtctttccagttttgggggcagcagcttgcacttctctgacaaatccaagaagagttgttgatttcttggcttgttcaccttttttaacttgctgttaggatggtgtaatgacttcccagctccagtctgaaagaggagcctggtgaactgaaaaccttgtctattatttatatttaaatatatgaaagcaggcagttttcaacaaggctgagtaacttgcttgaggtcaaacacaaacataagggatggaatctaaaatttaaaaaaattgaactccaattaaaaaatgtattttagctgttacagttggtcttttgctctgagtgacaattatatatggttattactttgaataacaattatatatctgggtgcttattggtacaaagagtattaagtttcagttaaacaggagaaataaatttttgagatctattgcacagcatagtaactgtatttaacaataatatattgtatacatataacatcactttgtactccataaatatatacaaatataatttgtcaatttttaataaaaaattaaacaaaattatgtatctgggaaaatacatctgaatcacagaaaaattcttctatagattacataatctaaataattgataccacagagttacagatattgagtatttcacatgtggaataaaagatgaattccaattacagtgaatagtacattgaatatttctttcttatttttgagcttagtttctttcatggaaatgtatacatatatttcctatgtaaaacagagtttataaagtacttttttattttttaatctcttttctgttttattgctattatactactaacattgcattcataagaggtcatccttcagatagcagtgaggatgaatgattatttggctgtccgtcaataaagttgatgatggtataattttaaaaacgaacaatactcaatttattgagtacttagtagaggtcaggcacaaagtttaagtgctttacaataaattatctcacttagttctcaaaataaccttatatataaactatcatcaatttctactgtaaaactaagaaaattgaagttaaaaattaactttctcttatttcccagggttagtaagatatggggcaaggatttgaacctagcctccttggctccagggctcacagtgttaaaaataactccatgtatatttgtccaattaacacattctcttttaagaaacatttatttgtgaccagcatcaaaagagaggaaaaattagtctcaggtttacattatctacttttttagaagagaaataaaaattcacttagaacctagactcttcgtgctttattgcacagtggtttaagagcattgtcacatttaattgaagactcattcactgtgtcactgtattttaatgtgagttgacatggagataggaaacatataattttaatgttaaaaattaacatatagtaatgaagggtaaacagcacagactgaatttttaatttttcgactatttctaatgaagaatatataaaatatttcaatggtatttaatcagcctccaattatgaatttacataatatttactccacaagaaacattattttacttctttcatgatcattttaaaatgtacagttttcaaatcaacttttcagaaagcaactttgttttctttgtggacagatggcaaaaattatatccacaaaactttttgttttcatattctggaaaagtagtatgcagtcattgtggaacagggcttttaaaagttgctcatgtcctgcactgaaccaattgaataacacagcaaaagagccaccagtatctgacctggcttctacagaccaaataaaccctttgtatgtttgtttattttcatctgtaactttgtttgcttatttttcattctgatactttttagtaaaatgagtaagatcttctcaacagtttagactatacttccacagatctgttgacatttgatgagcacatctgctaaagtgaatttaaaagggatagtttacttcatctctttctttacctgttccactaatcacttgtaccaaatttatttatttatttatttattttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatatgccacattttcttaatccagtctatcattgttggacatttgggttggttccaagtctttgctattgtgaatagtgccgcaataaacatacatgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacgtcctctccagcacctgttgtttcctgactttttaatgattgccattctaactggtgtgagatgatatctcatagtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtttaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaagtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctcttggaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcatctgcaaacagggacaatttgacttcctcttttcctaattgaataccctttatttccttctcctgcctgattgccctggccagaacttccaacactatgttgaataggagcagtgagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttttcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgagaaaaatgtatattctgttgatttggggtggagagttctgtagatgtctattaggtccgcttggtgcagagctgagttcaattcctgggtatccttgttgactttctgtcttgttgatctgtctaacgttgacagtggggtgttaaagtctcccattattaatgtgtgggagtctaagtctctttgtaggtcactgaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccagttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacatagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggtgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcaggtctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccagctgctttgtttacctaagcaagcctgggcaatggcgggcgcccctcccccagcctcgttgccgccttgcagtttgatctcagactgctgtgctagcaatcagcgagattccgtgggcgtaggaccctctgagccaggtgtgggatatagtctcgtggtgcgccgtttcttaagccggtctgaaaagcgcaatattcgggtgggagtgacccgattttccaggtgtgtccgtcacccctttctttgactcggaaagggaactccctgaccccttgcgcttcccaggtgaggcaatgcctcgccctgcttcggctcgcgcacggtgcgcacacacactggcctgcgcccactgtctggcactccctagtgagatgaacccggtacctcagatggaaatgcagtaatcacccgtcttctgcgtcgctcacgctgggagctgtagaccggagctgttcctattcggccatcttggctcctcctccgtaccaaatttaaataagtttaaatttttattttaaagaaaaatgacaactttttactcctttatatccatcttgtgcctgttcataatggcaaccaaaaatgagtgaatggctatggaaataaaacgattttataactagatatacagtaaaattaaggtgctcacctctgcatttaggactgtattttagcttagtattggacaaatggtaaaactcaggagtactgaacccagatctcaagagaacctttttctgtatagctctgggatggctgaggaaatgcctaaatcaagccttccatctgcttggccaaagaaagatttccacatccatttctagtttgttcagtagcctctgaaaaagtaatttattctctctgtgctttgttttctccatctagtcagtgaggccaatcatacttaccaccaacctccatcaagacaaacttctgagagaaaagaatctctctgagcatcagggatgctcaaaagtcaccacataagtattagtagaagtataaggggtgagggtgggagaacacattattcttctgtgcgtttagctaatagaacaaacattactgtttcctataaaaatgctactacttccacatttcctgtatgtggactctattctagacattctagtttggtgtttttaaagaaaatcagatacaggctatgaataaaatatctctttaatcttaaatccaatttactgtagaatatctttaaaaacttaattatgaatgaattttcagaaaaagaccgtaaatcatatataattttttatctttaagagctgtatacatgaactatttcaggattggcaaatatgtagcatatgcgtcatctgttcctccttctgcatacatggcagacattgccaatcctttaaaatcctctactctattgaataaagacagagctgcagaattctctgcactgtgtttcaggaagctatgaccaacccatcagagttgaggatgagttaaaaccctcataggtgggaattgaacaatgagaacacttggacacaggaaggggaacatcacacactggggcctgttgtcgggtggggagaagggggagggatagcattaggagatatacctgatgtaaatgtcgacttaatgggtgcagcacacaaacatggcacatgtatacatatgtaccaaacctgcacgttatacacatgtaccctagaacttaaagtacaatttaaaaaacccgctatgccattcctgatcaactctgactttcttatttacagataaagaatctaagactcaaatagtatgggattttttttttttactgaagtcatataacttgttatttttgctgttatttgaatgaaaagccagatgtgcatgttcccaccgtagttttattctgtgacatcaggctgtttctacaattttcaagcctgtctgcattcattatagtcattataattttcatattctttctgattgatcaactcattcatttactctttgattaagtagcatttatggaacagctactatgtgtactatgcctgggctggtgtctctgcactcaagaaacttagagttaaatagagaaatcaggtctttacaaagctagccctcatacatgataaagtgccttctggatcagtttcatctactagaaacacgatcgtgtctttctcattgcttaagcctatgttgcctagttattggtgtatctttctgtccctttccagccaagcttcacattaaaataaatggctacagttatggtctttatctcctttctttatatgacccaactgactgcacgttagtatttttctcttctcaatcactgaaaatattcttgctgaagtcaataatcatctacatgttaaatttaacagatatatttcaattcttaattttctctctttaagcatttcatgctgtcaatcatttcatttcttgaatttcttattatattctgttttcttgtattctttgttatatcgctttacaatactcttcgaatgtgttctcatttctctgaagctgccttctctttaaacagtgtgggttctttttcttcttccaattcctttgaggttggtttccctgggattatgacctcaatttccttttcctctttctgtggaatttcacctactattaaaactacaaactgcaaactgcacttctagcctgaatatttttgtatctttctctcaatctcagattatggcctcaatttccttttcttctctctgtggaatttcacctacttttaaaactacaaactgcaaactgcacttctagcctgaatattcttgtatctttctcttgatcccggtgcagactagtatttcaactacttactgggcatgtccttgtgttccacaggcatgtaaaactcaacttttccaaaattgaatgtatctcctctcttcaaaccttcctcacttcctgtatttgctaatttggtgcatggcagcaccactgggtcaccagttgctgaagcagagatactgaatttcttttaaccccatcttttttcttaccatcctcatcctacaaattctattggttctcatcccttaaaagactttaactgtgtccccacctcctcatgactgctgctagttccttagttaggctcttgtctttccttgactctctgcagtagcctcctaactgatctaattttatctcatcgtaaccttatgaatctccatgttgttgtcagctgaatgttaataaaacacaaactgtatcatctggcatccaagcttagaatcattgaaaactccctttagattctggagtaaactctctcccttgtacttggctcttgaggatcagttcccgcctacatttccactttttgttgctcatcactctaactccctagttttccatcaactaatcccttagttttgacttcagtttcagcatattttaagtgccttgagttcatcatcatctctcttgcctccttacttttgcatatattgtttcttctacctgaaatgtttccacctctcttttcttagctatactgactcatcttttaaatgtcaattctgatgccgtttgcacatggaagctttatctaatccatagcatactgtttttttttctttaattgtagcattttcttcaaggtgttgcagttgtcctctttgatctttagctattgcaatgcctttcactatttgcaggatgtgttgatcgaatcagttgcatcatgattggtcttgtccccagagtcttcccattctgtcctggggctctggacatgcccttggcacagttcctctgcttgggtttgtcactgcattggctcatggtgagcaatatgcaatagcttgatcctgaagtcatcaggggttttgagaatgaaactaggccatatcttgtttttgaccagtgaaggggaaagaaagaaagtaattctagaacaacctaccacttactttagagcttcacttttatatcatctatatttgacctggaaaccatctgtgtttttgtctttgtggtcagccattattgtttgttttgccatgatatatgtcggaatgatattatttgactctcctttaagtacctcctgcttctttgagtaaggagatcctaccagtaaaactcctttctgtatctttgtgttaccaatttattgagatatatggactatcaattgttttgtttgtaaataattttatttttgtaaattgtgatctagctacctaattatctattaatatcatctatctaaatcttctgcctcattttatcctgatacacaccttgacttctttattaaaaaaaaaacacgtacagagaatatattggaaggaaattggggcagttgttctgagtgatggaatatcaggtgacattttccttccaatctttaatgctttttatagattaatgaaatttttaaactttcatggttaaaaagctttttaaatgaagaaagacaaataaataaaaggacaatattttcatgggaaataattttatgttgagatcaacccctttctcattgagtaatgatccagatttgatttgaagagaatgacatgtatttaaccaaaagaattctattaggtacctacgttaactgtggtttagaagaggtagaaatccatttcagctttagaaagcaggggaaggatggaaagaagaggaagtgatattggagctttattttaaaagagaagcaagggtcaactgctgaaaatgataaaggaaggtattccaaacatagggaacagcaattgtataataacctcagagatatagcaaagcaagggcagctcagaatggctggatattactatgtttattagatgacgagaagtagagagattgtatgtcatgttattggcttatccctaaaactttagtagaaattggtgaaagtaaggatttttgtgtgtgtgtttttgatgagctcttcaagtattacatgatatcttattttattaaaatcaatacacattgcaatttttctttagcctctacttttcaggcagggtattttttcacttctttaaacttaatgcagtttattttttataacaccatttaattaatgaaatcctgttaccctttgtcacgagtaggtttatttgcatctctggtttaaaacacatttcttgcattttactttccagttctcaggtgtcatttgggaatatgatgcagccattagctaacagactttcccccaattcctaaataacctaaagtaatatgaaactgtattttagctcatctgtactcataattcaagttttactgttaattttttttcagaaggctgactccagagtgaacaaaagtagcttgtgtggaattatttttacttatgctccactttgaatgcaatgtgtgccaagcacatcaccttatgatgacagcttgttgcagccagaaggtctctaatttaaataaattctggttgtgttaatcaccaaagatataattatgtcatcatatgctgtgtgctttttaaataaatgattctgaaacagactgttctttgatagtttcatcattttttcatgagcttgcagaggatgtttatgtagtgaaaagctgaccacctcagcacaatctagatacctcttgatggcaggaagctcatggttctggttcttctgaatgagattattaatctagtgaacactcaactgaatgaataaatgatgccatttgttgaaagtcaggagagtgtaaacgttttgttttcatgagccccagctttgatcattcctatctatccaaaggtacttgcttgtgtcatttaagtgcttaggattcttacagtgctcatgattcttattgcagttgtcctttgtagtgacttctgagaccctttgtggcttagtgtggtgactcacaccccagatcgtcttcctgactacctgactacctggggctgtgtgtaggagctttagccatgtcagtgactccccagtctgaccgtgtgttagcatcaccaggaggttaagaaaaatactgatgcatttgcttttcatcagcttaattaagtcagaacctcttaggaagtgggctaggcaatagtacctctttaaagtgccctaaggtgaatctaatgtgtaaccagggttgagaatgagtagaacatggatcaggactgagaggtctgtgggacatgctcaccatgggcagtggtgaaggatgctcaggagtctaggaagtagtatcttggagaagtggcaaagaaaaatccagataggcttttaaaagaagtcacttaaaatcagtagaatgggaactttaggccttgaagagagagagaactcaaaggagaggttagagatggggcctggaggtagcacctgggcaattgtctggtgcccatgaaggtgtgtgcccagagaaggtaaaatcatattgtgaagaggaaatgacagaagaaaggggatgatttagctaagttgacaaaaaaaatacttcaaattagtaggaattatcattttcccgatggctgtcttctattcttaattttgggtgctgctgatttgcatgtgtattgttaggccaactaaggccactgaaaattatcaaagcaatgttaattaaaaaggtgctgtctacctattttttcctgcattatatactcatagcttgactataataatagtataaggttcaccaggtacagacttgggtatttatctagaggcctcctgtaggcttattcttctgcccattttaagctcttctagcatgcccttgctcacagctccaggagctgggtaaaaagctagccatgtatgtaaccagagggcctgcttttcagttcaggagttgctactagcttcccctgtgcctgcctgtagacattgtctgattttataccctgatgtccacatttctagtaaatttcctccctagatttggtgatttgactttttctgttggctgagcagctctagcttggcctcatttatctgctgacccttagatgcaggatcacagttcagactctgattgcttaggacctcgtcctggtttctgggtgttggaatacagacatttaatagcaaccatagttaagaggtcctactgtgtgttccccatccccttcatctgtggaggccacctgttcacaagtaatgagtcatttcaattaaagattttatgaagatgtctttattagtccattttcatgctgctgataaagacatacccaagactgggcaatttacaaaagaaagaggtttattggacttacagttccatgtggctggagaggccccacaatcatggtggaaggtgagaggcacgtgttacatggtggcaggcaagagaagagagcttgtgcagggaaactcctgtttttaaaaccatcagatcttgtgagacttattcactatcatgataacatcatgggaaagacctgcctccatgattccattttctcccactgggtccctcccacaacacatgggaattatgggagtacaagatgagatttttgggggaggagtcacagagccaaaccgtatcaatgtctaaaagtatcttttggagtatgagtaaacctaaaatctgtaataaatatggttaaccattgaacaacatgggtttgaactgtatcaatcctcttatgcaaactttatcccacctgtgccacccctgatactgcaatgccaacccctcctcttattcctcctcctcagccaagtcagcgtaaagatgacggggatgaagacctttagaattatccatttccacttaatgaatagtaaatatattttccttatgattttcttaataacattttcttttctctagcttaacatattgtacaaatgtagtatgtaatacatataacaggttaattacatattaattatttatgttatcggtttggcttccaggcaacagtagcctattagtaggtaagttttaggggagtcaaaattatatacagattatttttctctttccaatttttattttaggttcaggggatacatgtgcaggtttgttgtatgggtaagttgtgtgttgtggcagtttggtgtacaggttattttatcacccaggtaataagcatagtacccgatagtaatttttttatcttcatgctcctcctacccttacctcaagtatgccctggtgcctcttgttctcttctttgtgtccattgtactcaatatttagctcccacttgtaagtgagagcattcagtatttggttttctgttcctgtgttaattcacttacggtaatagcctccagctccatccatgttgcagcaaaggacatgatttcattcttttcttttctttttttttttttttgagacagagtctcactctgttgcccaggctgagtgcagtggcgcaatctccactcactgcaacctctgcctcccaggttcaaacaattctcctacctcagcctcccgagtagctgggattacaggtgcccaccaccatgcctagctaattttttgtatttttagtagagacggggtttcactgtgttagccaggatggtctcaatctcctgacctcgtgatctgcctgcctcggcctcccaaagtgttgggattacagtcatgagccaccatgcccagcctctttttcttttttgtggctgtgtagtatttcatggttctatatgtagcacatattctttttttattgcaacttttaagttcggggtacaggtgcaggatgtgaaggtttattacataggcaaacatgtgccatggtggtttgctgcacagatcatcccatcactcagatattaggcccagcatccattagctattcttcttgatgctttttcttctcccacctcccaccctctgagaggccccagtgcatattgttccctgccatgtgtccatgcattctcatcattcagctcccacttaataagtgagaacacgcagtatttgattttctcttcctgcattagtttgctgaggataatggcctccagctccatccatgtccctgcaaaggacatgatctcattcctttttatggtggcatagtattctatggtgtatatgtaccatactttctttatccagcctatagttgatgggcatttaggttgattccctgtctgcttttgtgaataatgctgcagtgaacatatgtgcaatgtatccttaaaatagaacaattggtatcccttttggtatgtacccagtaatgagattgctggtcaaatgctatttctgcctctaggtctttgaggaattgccacattgtcttccacaatggttgaactaatttatattcccaccaacagtataaaagtgttcctttttctccacaacctcaccagcctctgttgttttttgactttttagtaatagccattctaactggcatgagatagtatctcattgtggttttgatttgcatttctctaataatcgttgttgagctttttttcatgtttgttggctgtacgtatttcttcttttgagaagtgtctgtcctttgcctactttttaatggggttttttttttctcgtaaatttgtttaagttacatattgtttgctgaatattagatgtttgtcagacagatagattgcaaaaattttctcccattctgtaggttgtctgtttactctgatgatcatttcctttgcggtgcagaagctctttattagtttaattagatcccatttgtcaatttttgctttcattgcaattgctttttgcattttcgtcatgaaatctttgcccatgcctatgtcctgaatggtattgcctagatttccttccagggtttttatagctttgggttttacatttaagtctttaatccatcttgagttgatttttgtatatggtgtaaggaaggggtccagtttcaattttctgcatatggctagccagttctcccaacatcatttactaaatagggaatcctttctccattgcttgttttcgtcaggtttgtcaaagatcagatggttgtaggtgtgtggtcttatttctgggttttctattctgttacattggtatatgtgtccgtttttgtactggtaccatgctgttttggttactgtagccctgtattatagtttgaagtcaggtagcgtaatgcctccagctttgttctttttgcttaggattgtcttggctagtcatgatcttttttggttttatatgaactttaaaattgtttttttctaattctgtgaataatgtcaatggtaatttaatgggaatagaatttaatctataaattgttttgggcagtatggccattttaacaatatagattctttctatccatgagcatggaattttttttccatttgttttagtcatctctgatttctttgagcagtggtttgtggttctctgtgaagatgttcttcacttcccttgttagctgtattcctaagtattttattctttttgtgacaattgtgaatgggagttcatttgtgattcagctttccactaccatgttggtggtgtacaagagtgctagcaatttttcacattgattttgtatcctgagacttttctgaagttgcttatcagcttaaaaagattttgggctgagatgatggggttttctagatataggatcatgtcatctgcaagcaaagacaatttgacttcctctctttctatttgaatacgctttatttatttctcttgcttgactgccctggccagaacattcaatactatgttgaataggagtgatgagagagggcaaccttgtcttgtgccagttttcaaggggaatgcttccagtttttgcccattcagtatgatattggctgtgggtttgtcataaatggctcttattattttgaggtatgttccttcaatacctagtttattgagagtttttaacgtgaagaaatgttgaattttattaaaggccttttctgcatctattgagataatcatgtggttgttgtctttagttgtgtttatgtgatgaatcacatttattgatttgcatatgttgaaccagccttgcatcccagggatgaagcctgcttgatcatggtggataagttttttatgtgctgctagattcggtttgtcaatattttgttgaggatttttgcatcaatgttcaccaaggatattggcctgaggttttctttctttgttgtatctctgccaggttttgatatcttgaggccagaatgatgctggcctcatgatgagttagggaggagcccctccttttcaaatttttgggaacagttttagtaggaatggtaccagctcttttttgtacctctggtagaattcagctgtgaatctgtctgtcctgggcttttttgtttggtagtctatttattactgcctaaatttcagaagtcattattggtctattatgggattaattttttttttgagacggagtcttgctctttcgcccaggctggagtgcagtggcgtgatcttggctcactgcaacctctgcctgccgggttcacgccattctcctgcctcagcctccggagtacctgggactacaggcgtccgccaccaagcccggctaattcttttttgtatttttagtagagacggggtttcaccgtgttagccaggatggtctcgatctcctgaccttgtgatctgcccgcctcggcctcccaaagtgctgagattacaggcgtgagccactgcgcccggcctgggattcaatttcctcctggttcagtcttgggaagatgtgtagtccaggaatttatccatttttttcctagattttctagtttatgtgttagaagtatttatttatagtattctctgatggttgtttttatttttatggggtcagtggtgacattcccccttatcatttctgattgtatttatttgaatcttctctcttttcttttttattagtctagctagtggtctatctgttttattaagttttcagaaaaccagctcctggattcatttattttttgaagttctttttctgtctctgtctccttcagttcagctctgatcttggttatttcttgtcttctggttgctttgcggttgtttgctcttggttctctaattcttttagttgtgatgttagattgttaacttgagatctttctagtttttttcatgtgggcatttagtgctataaatttgtctcttaacagtgctttagctgtatcacagagattctcctaattgtagctttgttctcattagcttcaaagaacttcttgatttgtagcttaatttcattatttacccaaaaaccagttaggagaaggttgttcagtttccatgtagtatatggtttgagtgaatttcttaatcttgacttctaatttgattgcactgtagtctgagagactgttatgacttcaggttttttttttctttgcatttgctgaggaatgttttagttctaattatgtatcacatatttatccaatccaccattaatgggcatttaggttgatttcatgtctttgctattgtgaatagtgctgtgattaacatatgaatgcatgtacacagatttttgaaactgttagatttttgcagtttctctaacccctccattgttcaaaggtcaactgtatgtgcttttatatcagataactgagtataaatgtatacaatgcttggtttagtttgatatcaacttccaattcttcttcactcatttaactctataaggtggaatttctctccctcctttttagatttaacaaatattctctagacatctacagcattaggcaatatgtcagattctacctgtgttcttctacctgtattcatataatgccttgaaactatcaggatttcagaaatggtttctgaccttcaaagttccagcagttggtgatttcatatgatattaacattgtacagtgtttctcataggctgatgactgtttagtacacagtgcgctagttgcagtatttggctctgttcaaggaatagtctatttttaatgggaaaaaataggtcatttggtaaaaacacccaacataaacatgacctctattctcaagaggattttaaaatgaataccttgtggtttcagaggaacactttttaggttggacatgcatgtaatttacctgttatctgcagctgttaacatgcaagcagaaagttgatgcttgacagcataaataattctagtgcaggaacttcaaaaaggagccagaagaaaaagagagccatgtagttctgtgttgcaacaaaattcatggattaaggcacaggtatgaactcatggaaactgagttaaaatttcagaaatattgcgaaatcccacagtttaaatgataaaatattcaagtatgagtaagtctgttgacttctcaatgataatattgatgagaagcaccatttctacttgatgaggtagctagggaaagtggaggcaattttacaggatttctgtgttgaattctaaaattaggatcatagagattttaaaatattgtgtcatatgttgataggcattgtatttttggatgtaaaaacaactgtatctttaaatgtaaattattaatatgatttctatgatagttttatgtatcaatttggctaggctgtagtacccagttgtttaatcaaatacaaatctaggcgttgttttgaaggtattttgtagatatagttgacatctccaataaaatgactaagtaaggctggtcacggtggcgcgtgcctgttacaccagaactttgggaggccgaggggagcaaatcacctgaggtcaagagtttgagaccagcctgaccaacatggagaaaccccatctctattaaaaatacaaaattagctgggtttgttggtgcatgcctataatcccagctactcgggaggctgaggcaggagaattgcttaaacatgggaggctgaggttgtgatgagctgagatcgtgccattgcactccagcctgggcaacaagagcaaaactctgtctcaaaaaaaaaaagactaagtaaaatagtttcttcttgataatgtgggtgggccttagccaatccgttgaaaggctgcagaagcaaaaattgatgtttcccagagaaagaagaaattcttcctgaatttttcagtatcagcttcttcctaagaaattccagcctggttgccagatccacagttgcataagccagttccctgaaataaatctctatttatgtgtatgccaatgtctgtctgtctgtctatctatctgtctatttcatcatctgctggttctgtttctctggagaactctgactgataccatttcctaaatggaaagccttttaaagatatgaaataaataatattaggtagatgttgggatacaggtttatgcttctaatgttcccatttcagttctcatttcaagccttgttaaggctgtgcaaagcctgctgggacatatcctctgcctctccagcctgcctgcctgctgcactgggcattccagcagcagccctgagctgccctctccgctcctctcatgccctgctgcttccagccttctcttcctttgtctgtctgttttcttctacttcaaacacttttgccctcctctgcccttctctgtaaagccttctcttctctctgcccccttctcttcacaccagaagaattaggcttctctcatccccacttcctctctcatgcacaacattttacacagagggctctgttgaattgtttgcaagtcttttttcatttgctaaatggtaatgagtatgtcttattcatcttggtattcccagcacctagcacagttcctggcatccaggaggtgttcaatcaatattgttgaaagaatgaataaatagctgaccctctccttcagggataagcagctgcctttaagttccattgcagatggctgggaggcatcctaagtggcttttctttcagggctgggtatgctcctaagcttcttgttcctgagttgcttgaagagaaattcccaggcaaacagacctttaattaccaccaaaggcctatgctttcagtatttgtgagggattttatgtatgcccagcagatttaagctgattgtgtagaaatatctggcatcatatattggtggcatgaatgctttgcaaaatgagtataaatttgggctgatatattttaaccttttaattaatgtcttgaagtcttacctgcattcattagcaaggaatccaatatcccttttgaagttatacccgcccagtcaactttaaacttgatgctttgcccagtcctatgtagggtcactagggtctgtgtttttcaaataccagctatagaaaaagctgtgccattctgattattcttctacttcatgtgtgtcttactgttagtgtgctacatggtgtcattgttgaagcttgctcctgcatagttccacagacttctgtctactcagcatgagtgttgtccctggcccagaccctgcatgggccacagcgctgtttctaaccccagaatggtgagttcagaagagcttccattagtcatactgggggctgaaaacagctctcctacacataccctttagtgagcagcccaagtcagcagtgtggccatccactttccccacagtttttgtttggagacgtctcatcattcttctgtagcgctgggcctgtcaggtctttcacaagaagcctgtgtgcttcccatcttggggagcagatctcctcttttcctccctggtgatcagctctgcatgtcagtgtcttgcagagctttactagagtcacagaagtttattacactctttcccattccccttcctcagtaactttcttatcttaacccagagaactaccgggaaattaccaaagtgattcctcatggaacccagggaacatttgcttcgaggtgacttcctgcctccctgtcttgaaataaatgaagcaaatataaatttttatgggtctttcaaatggcactagatttaagctctaccttgtcatgcattatgtatgtaaaaatggtagccctttcattcagctataccatcactttccccttaagaggtaccaagaagcttagtcagttagaatgcagaaagatatttaaactgtagcaacttatggaagaaactgaaacaatctagtttccaaatgtgaattgttcacatactttaaaatataggctaaattacattataggcactcattacaatactcttcactacatcattaattttcagcttcatcgtttattatttttttaccttgcccttgttctggccaggatatttcactaattgcacagcctcgatcatatttcaggaatcttcgttcttctacttccttttgtggcaccatccgatccaacataaaaataattttctcccaaagctatgttgatcttttactatcccagtgtttctcccataaaaagaaaatagttaccattcgttgaaactttgttatactaattggttctttatatttttggtaatttttaaaatgtggaaataatctacctgcataaatgtgaaggccgattgcacacaggtatatcttaattattgtggagtaaattgttataaaatattattaagtggacactcatgttgctcatgttatcatcactgatgtcaatcaaaggagtattgtcaggatcccagaagctgccctctggctgtcctagtgataaacctctcccttccctccaaagtaataactatctcatgttttaggccctttgctttcttactttgctaaatagttttaccacttatacaacttctctaacaccatagcttagttttggctatttctgagttttatatatttgtaattatataatgtttttggtgagggggttttgacttcttttctgtgacagtttctgagaactatccaggcttcaattagtactagttttcattgttgaacagtctccattgtaggactgtactataatatgctcatccattcttctgggcctggatttttcttgtgggaaagtttctaaatatagatagaattttgtgagtagttacaaatctactttttattcctatgtacattttggtaatttgtaaatgtttttttttctagaaacttactgatttcacctaaattttcatttttagtttgcatatcatttaaaaaaagagctgattatttgtttaatctctgaagagtctatagcaatgcccctatttcatttctgacattgatttctgacattgtgctttttctgtatatttttatcagtcttgccagggactgattaattttacatcttttcataggactagctgtgttggtctattgtataattccttttttctttactgcttatttaattgaagtctttgaaaaacttatatatttctctctttgtggttaattttgctgtttcttctctaattccttgacaaggatttttaatcattcagttttagcatttcttattttccaatatatttattcaaaattaaaagtttaagcatggtgttagctctttctcacagtgctttcattattatcctgttcaaaatatttactctgcctcattgaggtttctattttgactcctgttatttggaagtgtctctcttagtttccaatgatctgggagttctcaaattatatgttactgatgtatagtttagttatattatggacaaagaatatcctatgtataatttagtcattttaatttttttgagacttgtttatggccctgctgatgatcaatatttctaagtgttctctgttgcattaaaagaatgtgcattctgtagttgtggggtgagtttttctctatatatccattaggcagagtttgctcatcctcttatttaaatcctttatatccttactagtttttgtctgcttgttccattgattattgagtaaaatatgttatttcacattttctatgggaatttatttttccttaatgttttgccaatttattttaatttatatattttgatagcacactgtatcttcctgataagttgaccctgttatcattagtaagaatccgtcttaatttataataatactattcacctttaaaattgatattaatatagctataccaaattttatgttgttgttatttgcatgttatcttttcccactattttcaacctttatgtagccttagttttaggtatttttatagcagcatataattgaatttttactttgcaggtctgaaaaatatctttattctgttctcactttttctgttttctgcattgtctgttttgttccttgtttttatttcattttgagctttttattttccttgttagagattttcttcaaatatatgataatacctgaagtctatccatacaggctgagcgataaaaagatgactgggaagtctctgtgcatggataggcttattgatggataagaattagggagacggaggcagtgtaggaatttggccatttcactgggagaccctcaattgttaataagccttttttaagcgggaggggctgctcaggtttttttttttttttttagatgaaacttctgtctttaacctagacaaataacattgtggatgatgggactcatatgtgtatgtacgcacacacacacaccctttgtattttaaagctccttctcattaaggtacctcattccaggcttgaacttcttcatgtagcaaatatcccatctaagttaggtggggtgaaagtcatttccaggtttcattgcatcagggaagatacctggtggcctaacaactcattgtgaaagatttctactgatcctccattggaggatcatttttctctttcattcctcttctcccttgccttcagaaatcctgagcttctcatccctgagcattattgggatccagaggtagagtttagcttccttcttattacgtgctccagaaaaagtcaatacaacaaagaaagctgaaactatgaccatccccgttcctcaacctgctttctaaaattgcattaaaaatttctcatgttctgtcatttcttctcctactctgcagttttttttaaattcctacattgtcattgtagtaaattttggaagagggaaacataatttctcactccaccaagtttatgtgtaatcttacttctagggtgctgtttacatgtggcaccaaaaggcctaaaaaataacatctaagagacagttgaagcaggggtatctagttcaaagacactgggcagatgttgaaaaagaaaggattattgtgaataaagcacagtgtattttactcgtggtcccaactacttacacctgaatcagatggtaagagcaagtacaagaacaagtaaaagtgaaaagtgagttttccataatatctttgggaatttgagactgcagggcatcagtgtccctgttgctattggcttatggtagcacaggcatggtacaatgatgtgggtgtattcgttgactgattacagacattataagggaggcatctgttgtaataacagaatttgcaaagatgtctgcattgtctttggcacagacatgagtaccttggtcttggtgcacatgttgacaacatgagtggcagtagcaggctctttggtgggcatcagttgaggagagggtatctctggaaccacttttgacattggaatcaactagccttcatgacagtgagtggaacaagaggaaaatagcactgtaatagctaacagtactggttccaacagcgcaaaggaaactctcagaaaacttactgagttatttggaggaactcgatgggtctgaaatgttcacaagatgggtggaattgtggcttttcttctctcctctcttttcctttttctttttgcttttttgaccgtggtctgatagctggtgtggtgcagcttttgaaacacacatttcaaaagcagagcgtgaaattcttggtggttaagtcaagagaaactatataattagtaaaattatgaaacaaatttatggggcaatgagaactaattcacttctaatttgaagggcatttgatgatgatgaggctttgtgaggctaaagagatgtcccttgggctttagagctcttcgtggaaggtccaagttcaggtatggccaagcacaaatggggaaagtgcttcataatcctttctctgatatgccacttctatattattggcaaactcaattccagggcccctctcccaaactcctgtgttgctctctccagctctattctatactactaaatgatgtctgcttaatattatcttcttgttacctttttctgacactttgtaagagacctataaaatacctttggtcttcagaaatgcagcctccactctctccaggttacacattatctgcctttattttatcttttcaacactttatatttcaaaatcaggctccctttatattagctagttaagtgatgtcaaatctagcttttcatctattcagtccacagatattccctcacttattgtgactcagttgacacactcaccgtttgtcccacatctctcaaaacggagacacattggtcttttggggtttttgtttttgtgtttttgagacaggttatcactctgttgcccaggcttgagtgcagtggtgcaatcaaggcttgctcgctgtagcgttgacctcctgggctcaagcaatcctcctagctcagtctctaagtagcttgatctacaggtatgtgccaccaagcctggctaattttttggttttgtagagatgtggtgcactatgtttcccaggcttaacagattggtcttaactggaccatatatcacattttttaactggagagagaggggagtgctattctaaatttcaggacacctgtgaaatttatatgcggaaacagtacattagatttaaacaaaagttaaattccccatttcctagagcagtgccacaaagtgtgggcacatctgtttatcttcgttctaattaggaataatttgagaaccaacctcagtctaccaactacactgatggctttttttgtatagccaatttagtgtcatttatttctaaaaggctagaagaatggttgcacagttaaaattgaacaaaatactcagaaccacaattttagactctaccctctttcctgggtgaatatttacaatgcttttcattgcaacgaatataatctcggtgacgttagctcaagaacaaagataaggtagggaacagtgattcttaggaagcaacatggatgtcccatggaatccaaagtgctggtatgcatgtcccaggaaggcattggaattagactgacacaccacccatgttttttcctgtcttctctcctttgcatatgtcagccagctttcatcctctgcctgccctctcactctctgccactctcactctctttccttctcttgctttgtctgcagattacaggggataaaactgtggtctccaacaatcactgggttattttctcatataacctccaggaaagatatttccttctttctctctttttgtattggttctaaattaccagaaaaggaaacaatagcagagttgggcatcattgtatatgtctccataagcttaccccaatggcaggaataaattactagaaaacaggcactgagtgataatccaagatgggaccactagctctggggtgctattttctttcccttgagaatttatgagtttacaagtatcagggtcatggtctagcatgcagtgagacatcagtaattatttgtttaatgaataaatgaatataaattaagataggtgcttatccaatataaatttacatgctgcaataaggttcctgggtaaaaagacagttcccttctcccttccccatatcactggagcctaaaattgtttcaacaggaatatggagtaaatcattgggaaatagtgttgagtagctacagggaagagaaaaagaggtggttgaattcatatccagaggaagatggacgaaaagaagaaagggaagaagaaggaggaggagagagaagagaaagaaaagaaattgtcacaattgctttgaatttgaaaattttgtaggaaatacaagaacagtctcatttttcaggtttcttcattttattatatacagtggacaaattatagttcctggcaactgttaattattgtatttatgtcccattgtttttattccattattttgatcatttgcaaccatgaacacttgcctccactgacacatacccattaaaattgaacttggtttttgttctactttgaacagcatcaaaatctttgcaaaacttgtaagttattttatgcccttctaattagtttagatagaagaatcattatatagggtaaattaatgaatgccattctggcttagcttacaattcccttttacaataataaaaacttatggcaatgcattgtatatattttacttgaatagttctaaacacttaattttatttaacattaaaatgtgactaaattaattatgaaattactttcaggtaatttgtgactctctggattcctttggggatttattggggttctcttagcaacaagctcaggattttaaagcttggttatctgtatcatttttctaataactttagtgaagataaatgaagtctctttgttgtatttgtttacttcattagaggtagaagacagaactattcagagcatcaaattagattgcatattcctggagtgtttgggaagttgataaaagaaaagaattaaactatgaaagaaacttgggatataaccacacaaaatctgggactttagaattagttttgaggctatattgttttttaaccttatagacctttatattttgactttaaaagacacacaacaaatgtagttttacagtatccatttgaagggcagtggaatatattttgtttcctttttttcatatggataaaataaatgtgttttactgtgtagctctggtattgtttgtgccagcaaattggtgcactaaatcatgtattgataagtaatctcatttaaaaaatactttaatatgattaagtagattttcaatattttactttttaaattattcaactgacgttcgaagtaagtaaatttacagcatgtgttgcagaaagtcaaagatatgttctttattttgatttatttatattctagcctctagctttttattccagaagaggtaataaaaatgatacaataacgctctattctaactttgttagagcatcataattacatggcacacaatttgtctttgatgtttgcttttattttatcttgtattgcaaatccttgtttttaccttttatgcttttatactcatcctactttggccctgatgtcaaatgatttaagtaatttactacttaattcatttacttatttattgcattcctaaaacatactataccctgggccaagaatttcatttgccaaaaaaaaaaaaaaaagatacatgtttattacccttgatgaagcaaatcttatgggagagaagggcaatgtaagaaaatcattaaaatactctgggaaaatgatttaacatagaggtatagtcaaagtattatgacaacactagggaagcgataactttcaaaagtaatggcagtaggtttctcagtggacagactgagttagtaatctcaagccagaagacagggattggcatgggacaataaagagagcattctgggcagccattataagtgtattatgaaatggtggtatattggtgagattgatttcctagtaggaggagggcctgaaagaaggagattctgaaatgtaaggagatgagtctaaaaatgaagatgccttgcagagtggaggttcttcttatccatgttgtcttagtccattttcacgctgctgataaagacatacctgatactgggaagaaacagaggtttaatggacttacagttccacatggctgggaggcatcacaatcatggtggaaagcaaggaggagcaagtcacatcttacgtggatggcggccagcaaagagagagtttgtgcagaggaactcctctatttaaaaccatcagatctcatgagacccactcaccattgcgagaagagcacaagaaagaccagtcccacttattcaactacctaccactgggtccctcccacaacacgtgggaattgtggaagttacaatccaagatgagatttgggtagggacacagccaaaccatatcacatgctttaccctgtgacattggggaccacaatattattttgaaaaatggaagccagtaggccagaagtttacctttttttacatgcatattatgaaatagttgtactagaagctttgcatactttatatcatgtgttccccaataaacccctgggaaggaaaggtatttttattcccactatatagataaggaaatggatgattatcaaagttgatcatttgtcccaagtcatgggggtatggggtgggttgcaagcttaatcttttctggttccaggacttctgcttctccagtatgccctgtttctttgctagaaatccccatagtgtcaataaagaatttactgtgggtggaaatagttacaatagaataggaaattattactttagtttcagattagagatgattatggacagaatttagacattgatagtggtgatgacagaaaaacagcatagatttgagagcctttcagaagtaacattagtgattaatcactaatgttgagagtaaaggaaagggagaaattgatgtaatactaatgtttctgtatacagcacaaatgaatttcactgaatgggctgaagtaaggcaagaaatggaagaaagaattgatgtatgctggatgtattcacagtgagggtgggcttggttaatgatactctgtctcccgtcttcttagatatgtcttccttatagaacttagagggaattaatggctaaagttaggaaatttgagttggaattttatcagtgaccattgttaggttcagatgcaattttaatcattacaggctacagctaacaattgtctgcagcttttttgtgacattccaggggatcttgccccatagcctcaaaccataggtctggcctggaaggtccttacacatgtattgagctccatcaaagtattttaaatcaagaactagagattttgagcaaatatactaaaatgtggttatttggataatagtcgagtaagtgactggagtcattaatctagttaatcatttcactacaaacacaaaatgattgaggaaaggttaattttaaaaatctaggtttagttcctggcattttgtagtgacaaattttcactttaatgccttaagaatccttagagcttttgctttagttttagtgtgtttaatgcagacctgtactcatgcaagtcaactcctcgcccatgatttacttgtgtgtgaagcccccaatcttatttatgttgtccaaacatggctgagagagacagctgtgacattatgaatccagctggccacagatggtttttcagtgaagtatggatccatattggtttggtgatctgtgtgtactgcctcctgttaaaattcagactcaaccactaaatcacctggcattgactgcaaccacttatgtatgactaatagactgaagtgaactggaacttttgttgctagtgatcaagacccttactgtaagaccaattcactatattatagttttattgactattttgctcatgttagagtctgtttagtttagtcattttgcaacaggttttaataggcttggtatctcgtattgtcaagatgttatgataattagccttttccagatcttgtatattgaaatctccacgtttgttatggatttgatggttaaggtttaaatctcgaggaaaaaataattgaagttagaggctgagaaaaaatttatttaggatcttaaaagcctatatcaatgatcaatagttacttagaaggctggtagaactgcaagattttctagatagtggaaaaaagaaaacaaataaagcataaaagaaaacaaaggatgtatgagttgttaaaataatcagctaatgcaccaaacaaaataactttaattgtgcctcttagcaaataaagtttaattctgaattacttgcccaaatcagtaggtatatgaaacctcacaatttcacttttctagagtccaatgtgatattcaaactggctaaaattgctgatataaatatatgcctgtcttgttgtttacaatccaaccaggaaatcttgttaaatgttaatggatatgcaaatgaatgaaatagtagctgaaaatttttatgacaggtctgcatatttgtaattcttcttcatatttatccaaagcagcaaaaataagaataattactgaatgactagtctttatatattattcttcatttttaagtatattagttatttcataagttgtcagtactatctcatctgcattgttatagcatctagcacttatcatatgtccacagccacaggcaaggatactttattttgtgctgatatattactctgggtgaatacaggacagttatcttccagtcagtcaagaagctataaatgtagctggagagataaagtgaacacacaaaacaatttttagaagtttttaatatcttcctccatggaaaagtttttcatgattcaatctcattttattgctgtttctaggatttaatgtatggagatctacccatgccatatataaataaatatgaatgatttgggtcactttattaaatcataatttaaacaaatatttattaattctccactggagaatcaacagtagacaagatagccaaaatagcttcctattcttctggacagttttttctcttggttttcagtgataggagcttgtttcttgacatcctagtaatttttgaatgatggacagatattatgtataaaagtgtgtagaggataaaacaaaattttatttttccacaaaacatttactttttcctttgttaagtggagacagtagaagctgttcaccacaatctggtcatcaaatggcctgggtaagggctggtttatactttcatcaaggattcatccatctctggttttctgtagccctccagagggctgtattctcttggaccacattctctagctggttctgaactctaatagagtcctcaatataaggaagttgccaaacctccctaatgctctttagagattttacttagtcttttagtctccttcctgtacaagttcagaaaggtttggcaagtgtcttgaaaggcaaccagctgtgtgtcatgctgtcttctgggtttctccttcctcactaggatcttggctccttaaatttccaatgttgtctgttcttcacagttctaactttccacagttctctctaatctggtatcttgatttttctagtcttcattgcctcaacaattttaattttttgattatttaaacagtgttaacacttttgattaacatatattcaaattgtatacacatgtacagtagcaccacttcattaaaactccttttgtcagtaacctccatgataccaaatttgtgacattttttgcatttttaaaaaacttttaagttcaggagtacatgtgcagttttgctatatagataatctcgtgtcatgggggtttgttttacagattgtttcatcactcaggtattaagcctagtacccattaatcatttttcctgatcctctctctcctcccacccttttccctctgaaaagccccagagtgtggtcgtggttttggtttttatttttttagttattagctggatgattgatctgttgcaagtgtatccagccgcctgtctctatttttagatagtaaaataaaagaatgataccttctcttatacaaatgtatgcaattacagggaatataccctaaaatttccactctaccccaagatattctagaactaattggaaaagtggacaggtggggcattgaacaagttcttcaaattaggtatcattgaaagaactgggcaattaccagagctaatcctttatagtaatgttgagttcactgaccaagagctgttcagtgattgtggtactgaatggtgctacaccaagttgtccaagtgaataacttgggggctttcaagtggacgccactttgattggtgaattcaacatgaattgaaactcaagacttgatggttgctctggagagctaaaggttctgcatactattcttgacttcttattaggatttatcttaaagggaaataagttttaatttttatcatctactaagctacttgtggacagagtagatatttgttgtgttttatatcttcactaacacttataagaagaagatgttgcttagtggttaaatttctgcgtttgtgagtcaatcaagtttaaatttaaatcctgtccatttaccagatgcttgaccttaagcaagttgcaaaaactctgtaaatctcaatttcatattgtgaattaggaataataatacatttcattgtaccagtgtgagagttgatgtatacactgtatttaaagtggtaataactatctttggcaccttataagcatgcaatttatggtagctataaattttgggctactatcaaagtccatggaattggagatccagaattttggggttgtccttaaaacacttacagagagcctccaaggtaggtgaatgaagtctgttgaaaaagagttatgttaagaatttttaagtttgctttttttgttaaataaaactagttaaatatctgtttattttatggataacagaaccatctgaaataactccagaaaagaaaagactgaattggagatagtttacctctcagtgacttcaaaaacatgtttcttcataatttcagtagataaataatgaacaatcattatctattggatgtattttaaaattaagaagaattaagttttaccaatactctaaattgtacaggtattattatgtataagaaaaggagcaaaatttaagataaaagtagttaagtgaacaaaaacttaagagtaaaataaaaactaaaagagggagagagaaatttgtcacctagctaccatttgttagttatatgatatgaatagggcgagttatgtgatctgagtcccagttttttcagagaaattgcaaaattagaaaaataataattagtgttttcttgaatattaaatgaaaatgcctgatgaacagtaagcatggtcttaatactaatatttaatgatcagtggaaataggaattagctatacaaaaagtaaatggtataattacattctcttatttatatttcagtaataatttaaatcacacatatttggatcaaatttcatactgctttattatgcatggaaatttttcttaaatcttgatattattctgaacgttattcaggtatgatgttatatctaaagcctaatcccagcatttttccaattgttttgatttgatggaactgaaggaaagttagctcttctctcctctttgaagttactccaatttaggaagtgtttctgctctgctcatacttgagtgagcatgcaataatacctttgctgagtatttctgtttgatttttcaaaagctgtcattagtcgtacagctcaaatatgaagtgcacatggtaattggtggagccacattcagtcttcaagtataattgaaaatgacccagacaccctgagagctcttcttagacttccagatttgtaagcatatgtgatgggacaagagccagacagcttgctgagaatgggagaagtccctttgcctgttgctgaaccagaaagccttaactgtatgactctctgagtccggacaatgtcttgtgtgtttgtttccacagagcatatatcattacagactatatgggcatccgaaatgaaagtttcatgaaattagctgcagtagggacctggatgggggactttgtcacagcttggatggtaagaaaattttaacttcacccatttcaaacatcaaacggaagacatgttcacagtgttggacagacactgcttttgatgatgtagagtaaaataattacctctctttgagtgaaacaaatttatgagtaaagataattccagagattatatccaatatctgtggacctcagaaaaaaaatcaatgcaattagaatacaagtaatggcactccaccagaatctgtcgatcgatctatctatctatcatctacctatctaaacacacatgtatgtttgagcatataaacatatacagtcataacattaatagaaattctccctgtgaagttacaaataattttgtttgtctaaataattttggctttttcttaaggcatgtacaattttcaggtaaggaatgtggtctggcctgtctcagaagaccatatgaaatattttttttagcaatttaagaaatcattttctacatttattttcctcattggaactactaatataatggtaactgagttctgagtattatctcttttaatctcttttgtattttcttactccttgttactataagcctggaacaaacagacaaacatgtctcctgctgagctcatctgtcaataaagtatcttctgtttttaatcattgggttaaaatttaaagatagcatgttgctagaaggctctgggttctataaatttatgagagactcacaaaatgcaaagaacataactcccataaaaatggagcacttcattaataccgttcataaatgcagttgattctaattacctttgtcagtctattcacttgaaaatgaggagatataccagaaggcagataatgcctgactcagacaagacttggcatggacatgtccctgcagatatgtcccagatattgtaggtagatattgtaggtaggaacaaaagagttcctgccatttctattgattgcttcttacctggaacaggtgctttccaggatcaggaagcagttgtagcttaactgctcctactgagaacatccaggaagagtatcaagtaactaccaaagggtttgtatggcctgtttttgagcctccacctacctctgttgatttttagaatgttaacagattactgtatggattctattccattaactttaaaatgtaaacttgaaaaatgatttatttgtaatctctagaaatagcaattagaataaactagacattgagaacaggctgcctcacatgagaattttcttttttctgggccgggcgcggtggctcacgcctgtaatcccagcactttgggaggccgaggcgggcggatcatgaggtcaggagatcgagaccatcctggctaacacggtgaaaccccatctctactaaaaatacaaaaaattagccaggcgtggtggcgggcgcctgtagtcccagctactcgggaggctgaggcaggagaatggcgtgaacctgggaggcggagcttgcagtgagccgagatcgcgccactgaactccagcctgggcgacagagcgagactccgtctcaaaaagaaaataaaaaagaaaaatttcttttttccattggaaaaagctttttaggaggagatacataaactttgaaaaacgtaacttccttgaaatttgaggggatgtttaaaaaaattttttgacattaattatgcattgtgattttgacatcactttgtggcaaatctgcttaataagatggaaaagataactagattaagagtccaggaatttgaattatctgacctgaccacctatggttcgaccttcctacaaataatgaacagttctcggaggctcagtttgcagatttatcaaataggattaatagttccttcctgtgttacatattttctgtaaagcttaaatgtgtggccctgtgatgtgacttaaaatgctaacgtataaggtagacataagtgcttcattgtgcacattgtggggcttctcatcactttagcttggctcagtcctttgaggggatggcaagggccaagtcattgatccaaacctcaggatgcctagacttcctgagccccataagtgtgagcagcccaccttatcccaggcctggggtccagagtgtctggagtttatttcaatcgccaatgatgcaggaggctaagatgatatggtacattgcttcctgacttttgtcttatactgaacctgacaaaagttagaggagaaacaatgaaccagcaggacctaggagctgaagtttgcaggctcatgccagccatttattacataaatcattttcttttccactatggcaacattgtttgtttctaacccaattctatccaattcttccccagccatttcttcaagatgttgctttctgtaccatatacagctctgcctctctttattggttcattattattattttttaaattagccttttttcttttttaaccatagggaggggtccaattgctgcagcacccttaggaggaaaatgcatggtagagttttgaccaaagacctttaacccttcctggttggatttctattctgcacttgtctgccactttcatctggctaaggggagtacaaataattccacagttcagcctgtgatctttgtctcctttcaaggtctggctgaccttcatagtttcttctaattttactgctttaatgtcttatatttctactagctaacctgataacttcacttttttctatatgagagattactgctacatcacagaactaagactggattgagagtcaagaaaaccgtgttctaggttgaacctcacaatgtgatcttaagtcacctaaccccctggggcctttctgtaagctggaagagaatccaaagtctctttatgctatgttatatgaaacattgacctttccacattagacacagggatagaaatagcaaaggaaataccaagtgctcctgattttaaaatatagtcacacagggaggattcccagagcacatcatttctattcccatttctattcactgattgggcagtgagtttctgtataaatatttatatgtctacatatgtgtatattgataacatttaaaaaaataatattttccctcatgagagaagtctaacgtagccttgaccttcatctgtctataggattctcatcgtgaaatgaatatcaatgatgagggtgactgtcatggaaaagcaactatttacattaacaatcaaagtgtgtcttttatatatttctgaaatggaggatttttcttttatggaaataattcaaaactttttcatagttttaaaaggcatatcaatattaatgtgatccaaagataaggatggtgtcaaccaatatgagaagtatctttggccctcacattacagagcttcaagctctgctgggtccagtttcttaggcagctctgacttttcctggctctgtggtactccccatgcagaggacaagagatatataactcagggttaagggtactaattcttttgtcaaataggtttttaaaataggttaatatgtaagaaatacgtaaagtgctgagcgatgtaatccacattgagctgggtctttgctatgggcaggatcagagaaaagcgctgtcatgaagctgtaaataaaacaacatggggtgtctcacgagacaccatttccaggtatccacccgtgcactgtgccattaagtcagaagctggaggagagttggccagttccatatcacattaccccagttttgccattgctgcttcagcttctgatgaggtctaaggtggcaggggattccaaggacatcatgatggcacttgcttctgcccttaatttaatgccagagagaagaagcacttctgctgatctatgcctaataatcccctgttctagcccctggtacatcctgttctagttgcttccatcttacagaagtaaatggtatgactcacaatagaaccagggcatcagactccaggtttgaggttcttgttggggtgaggggtatagataaggtaaaactgagccatgacctaagaagacaactctgggccgggcgcggtggctcacacctgtaaccccagcacttgggaggctgagacgggtggatcacttgaggtcaggagctcaccagcctggccaacatggtgaaaccccatctctactaaaaatacaaaaattagctggatatagtggcacatgcctgcaatcccagctactcaggaggctgaggcagcagaatggcttgaacctgggaggcggaggttgcagtaagctgagattgtgccactgcactccagcctgggtgatagagcgagactctgtctcaaaaaaaaaaaaaaaaagaaaaagaaaaagacaattctgttagccaacactgaagtcatcataaagcatccttcaacctgaaaaccgtatactgtgtgtatcaacttctaacagtcacaggacattgcatggctttaacatagtagccctaggattatctgtcggaatttatgtatatgtgccactactagcaaaggctttaccataaagtgatgttgtagacacataaaacaggaaaaagtcagtttagttgtttgccagttggctttacttttatttaaggcatttatagtgaccgtctgtttataaaattatgtgtgatttttaatggactttttttccccttgaaagttggagtttcattagagccagacaagcttaaccactaaaaatgcttttggattaataaaacatagcctttgtagttggaatatagtaagaaataagttgtaatttttgctgaattatttctctgtattgaggatctagcaagaatatgattttagaaaaaatgtgttgattttagaaaaaaggtattttttagaaatatattttacctttctattttaactgtgtctattttatgtataagtactgcaatatctgtctaaatatttgagtgacaatttttgctgtcttatttttcatacactttgtattttttcagagagattttatcattaatatttatactgctattatctttgcttcaaaagactgttcatactagttaagagaaaaagttaaaaactcttcctgacttgactagaagcttcttgaggggagttacaatgtcaatcatatttataattatattcctaacacccaacacagaaccaggtataaaataggtgctcaagaaatatttatttaaagaataaatagatcataacagcacataagcactgtttcatttcttttttctggttcagttttgtgacttattattgtaaaatgagcattctagaatcctataaaggtggaaggaggtcagctatattgttcagggtatcatatatattaaccctgctttgctcctctccctaccccacctcaaccaggctatgcacttcttcacactaaatttgttcccagaaccacagggacacatgcttgtgaacactcttgaatggaagtgatgaattgccagtgtaagtctcccaaaatggtgatgtcattcttgagtgtaaatggcaaagagtataaagaaaagattgagctctgcagatcctgccagtgcattcttcgaatggtcattactgctctcagtggcactgtgttgatcccagctctggggcagaaggaagctgggttgagatatgtcccttgagtcatgtgagcaagaagagattactacgtaagatagaaaattggttaaatttcagtggacagagagaattaaagaatggcatatacttgagagtaaataccattacatcaagggtcaatattcatttacaactctagaacagaatagagggaggaaatatttctgcagtgtttgagcataaagtattccttctagcttaaatatagataatatgaaataaaatttataattatataaacatacaacctaaaatgtggtgatgtttttaattgtcattttatgcttattgcacacttatttaggaaaggagttaactgtttgtgttattttcattttatcaagttaaaaatagtttagttcaaaattttctagtttatacatgtcactattttgtggactatttcacaaacactaagtgtgtgaatgaacagtaacctggaatataaccagcatctagcttgttattctgtctggaattgagtttgacaatgcatattataatcagtgccaattttctaattatttctcttctactgatgtttcaaaatgacagaataagaagcataattgaatttgatttagcacttgaaataaagtagcaataacagtttaattgaacttcataatagaaaaaaaatttaaaccatgaaacttggaatagaaggccaggatgagcaaactcattggacacatgtatatgagaaatggaagggtgcaaaccagatatttagccatgggagctggacctaagagctgaacattcctctgggtctttctcttttgctgtctttctctgcctgttcattggaaccattttgacctcaacctacccctgattagttaacctcatgtttggtacattcgtatgttccatttcattacttatacagtgaaaatacaaactggatcaagcatttaattaatacactatctttctataaagatttcgtgttatgtgaggttctctaagaaaaaaagcatgcatcagggatttaggggcacaagatttaaagaggaagtactcttggggaatctgtaagagatgagagaaacaggagagagaaagagaaggaggcaagcaaagatatagttctatggtgtcacataaagtctgccctcagcctgatctcctgggactgtgctcttgggcaatggagtgctccagtaggtcaagaggttgcgagtgggacaccaacatggaccatcgcacagacaaaacccaaggacggcagatttagtggcacccacacttgccaaaaaaaattaataataatcagtttgtttgatcatttgattgaagcaaagagcataaaagggaaattattttttgcatttcttttttgctcattaggaagttttgagggaagtaaatgtggtcattttgcttttgcatgtataaatattttaatgtctctataaatattttagctttgtgtttcatgttccttcaaaataataagttccagctaaaaaattaataaggcaggagagtctaacttcctgtgttcagatagcatcctaagtgatgatcaagagtcttttaattttcatgacttttggaattaaaaaaatagaatatgacctggaataaaaaaggatttccgggtaaaaaaggttgtactataatgtatagacacttaagaacagaggcaaaaattctggctttcactgtaagtctcctaatgccaatgcccatcaaaatatcaaataattccatagtatgtgataggtatatgtatgcaatttatattcatttattaaaaatttgtggaatataaattttatattcatattcaccaagaatatgaaaggcacctaggaaaattcacctaggtattgaattgaactacattaagatatgaaagaaactgaggacatctcttatagaaagacattcccaccagagacaggggatgctcatttttcatctttttcatccccaacttagtttcagcttcttccaattccattatactttatttctattacttagtttatacttcctctagttgggtacctcctttgtccacatattctttatgatttttctaacgtaaagttccgcaccttttttttttgatggaattttcttttttttttcattattattattatactttaagttttaggatacatgtgcacaacgtgcaggtttgttacatatgtatatatgtgccatgttggtgtgctgcactcattaacttgtcgtttagcattaggtatatctcctaatgctatccctccgccctccccccaccccacaacagtccccaggtgtgatgttccccttcctgtgtccatgtttaaagcagtatttatccaccatttacctgaagaactttgaataaagcccaggaggcattgatacttgattttttcctctttgaaagtcaatgatataatgaaatgagagctggctgttaatataggctcatattagaacttgaaaaaagaagctatgtgcttttttgtagtatgtttaggagttggatggctcccttaacatttctttcaccttttatttagtgcctcttgtgggccgagaactattctaaatacacatatttagaataatgtttatatataatatataatattatatttaatatattatatattataatatatatttaatatcatttaatatataatatatattataaacattatatattatattatattacataatatattatataaatataagtatatatttatatataaacattattataaatataatatatattatatatttaaatatgtaatatatattatattaatcatatatttatattatagatataatatatatttatattataaacataaatatataatatataatataaatgtatattatatatttatattatttatatatttatatttacataatatatataaaattatatttataaaatatatataaatataattatatttatattatatattataaatataattatatatataattataaatataaaatgtataatcatatttatattatatataattatatttataatatttatatataatcatatcatataaatatatatattatatataaatttatatatttatatgtattatatcatatataaatttatatatttatatataatatttatatcatatataaatttctatatttatatattatatttatataatataaaaatttttatatctataattatatcatatataaatttttatatatataattatatcatatataaatttatatatatatttatatcatataaatttttatatataatatttatatcatataaatttatatatataatatttatatcatatataaatttttatatacataatatttatatcatatataaatttttatatataatatttatatcatatataatttttatatatataatatttatatataaatttttatatatactatatataatataaatatatttatatttataattatatttataatgtatataatataaatataaatatggtgtcacataaatatatatacattatgtttatatgaatataatgtatatattgtatttatataaatacaatatatacattatatttatggaaccattttgacctcaacctacccctgattcgttaattatattcttaagtatatatttatatatacttaagaatagtgcatatacacacacacatattttagaatcatggtgggcctgcaggaggtgctaactaaaaggtaaaagaaatgttcaggggagtcattcgactaattccagaagtactacaaaagaagcacatagcttcatatttcaagttctaatctcagctaatattaatgagtactcattttattgtatcattaactttatatcagatacatactgattttccatccataaaaaccctgaaacaggtggagacactgaagcttaggaggttaagtgtcttgcccttgcccaaggtgacacagatatggcagtatgaatggcagaacttggaatataacccaggcaatctggttccaaagtttttattgttttcacatactattctgacaaactgaataattttcttgcaaatatttaatagtagatcttaatccaatgtggcatatagacatagattttggttcaatttttttttctgcttacatgtcaattgaatttgttgaattttgtcatcagatgggggaagtgagtatatttttaggcacgaaatgatataaccatcacgtctcagccaaactgttgattttcaactttagaaaattcctaaattcctatattcctattcccttttgataaagatggtggaaagcatcttatttctggaatgggaaaaaggtaaaagaataagttttatcttattattgtttaagatagatattgcagttcctggttacttaagtgctaagtgtttttatgaaattgctattctttagcagttgtttgctccacgtatttttagagcagtaaagttttttatattcatagaatatgccacatttttagttaaatgtgttttaaccatatttagttaaacatcagaaagagatttatagcaatgaagtatcttgtatttatgctttattgttgttgcttcataaaagcttcattatgtttcaagagattaaagtaatttgagtgaacacagggaatacaatatttgataagaaatgattaagtaagagttttcctaaaactaagtttgggatatattcttctcttatatatctgaaagctgattaggaaataaataacttctttttttccttggctgacaaaatatgttaagctttatctcagacctggacctgcctccacgatccttcactagtctaccaaattgctcagtgaaacatcttaagtagcttttggaacatgatattgcataaggaatcaattaagcatgcaacagcaatagaaattactggtcaagtgtaagatcaaataaatttctctgccatttccaacgatatcagttaaaacagaagataaagtccacatcaacagtttcttaaatgctatagacaaggacgcacaaaaagaaagtaggacaccacgtgggccgtgttaagaattccaaattgttcttgactactgaccagaggttatatgagaagtaatgcctatgagtcaagtgagtgagagtgagatgaaacagaaaacctagagagaagccatctgttttcattgaaagaacagcacctctcgtaaagattttaaaatacatcataaaaatactatgaacctgtagctattgaagaaaaatgaaacctaataattttcaaaacccaagtgctttttttcttatgttgtaattatcctaatttctctttgacattttcagtttgaacgaaaaataatagaatcaaggaagaattttggcaaatctaagttgcaggtttgaaaaaaaaagaaggcattttattttacttaaataaaatttagcaaagtgaaccagttttcccccaaacaatatgctatatatctaaaaaaaaaaaccccttgttttgattatatgattttttttaaaaaaaataagcagaatattcctggtacttctgcatactttactttcttagccctacaagtctctatcgtaatgccattgctatctttctaaaattggtgacaacttcaattgactatttcttggaccataatatctttgagaacatgttttctctggtgtcaagggatttgtgaagtgcagagcttatacaaataaatgaggaatagtccaaatttatttttgctactatttttgtccaaatatttcttaagataatcatctctttcctccattcagccacctttttgcaacaaacattttgagataaaaaaactcatgaaataaggtatttgtatacatagtttttaaatattttatcaaattttgatgttgcaaaattacagacctttggtattccaaaaccccactgagggtctctcttacttcttcatgaatctattcacttaacaaatatatacgaaacacatgtaaagtcataacaaattagtaaggagtaaacattggactgtattaaatatggtaaaaattgagtcaaaataccattgcatttgaagttaactttctcttattaatctctcaatggtcttgttccagccagcccctccctagacttgctggtttggcaagtggtcatgctgtgtataatttgttctgcaataccttttggtctgttcaaatcttaccaaccatgtttcagtagcttaagtcatcagtttgtggtgaggtcttaatgagtgacagtggctttctctgttaaacttgcataaataataaataccagcattgcaaattcaaatgccctcaaggccaggctcatctagtagaagtgtgaaacatctggtatgagataaaagggtctgtgaggagttgagggcagctgcgttgaaccagagatcgtgtttcttgtaaagaagcattaaaattcagtttacaacaaaaatatcactaatgcaaagtaggatataacttcagcagaaagtctgccctttggtcacctgacagggagtcctgctttgtgctttttaaacagggcacattaatctggaaactgattatggcatgaatgttgcaagaacagcacagcacagggcatgagtttgggacaggtaccatgttgtaatgtctctatcgcacccttaaacttatccatcctgtaaaaggttggttctcccttttctgtccactaaaattcaggggggacaaggactgtctgcatgttaatcatagctgataagaacaaccggaatctttgtactgcttagcactaattccacccaaacatttaaggctcaagcaggcaaaaagcattttcataataacacttactgaagtgttaattaaatgcttgttatagtagtcaggttagcccttaccagcatggattcagagagacctcaagttcatgctgtatttgttgactaacttactagctttagtttctcatcaggaaagtgtgtgcagatgtgtacttaatatgcattgtggaaatcttaaatgaatacaaatatcattaagctgtcaatatttgtaaatctcttaagcagtttatatatagatttagggaacagagcttattgtttagttgggtgctctaatcagtttttacctgaatttcataaggctatgattcccaaatttgtctgcatactggaatcacctgggaagtttcaaagactactgatgcctgtgtctcactctgggatagtggtttaacttgtctgcatgtagtctgggtgttggaatgtttaagagattcctagagattctaaaatgcagaaaaatgcagggactgtttctctaaggtggttccaggaagtttggcatgggaacatttggacatattctatgtcaaaatcagatattatggggtcatacttatcagatattaaggttgaagagaaaccaggagaaagaatcttttggtgctggaagactatacaacaagcaggcatgagggtaagatggatatgaagagggttggctttctttttgggttgcagcaccccaagggcctgtacattgccacgaggcaatataagtgctcagtaaatgttacctagcctccagagttaagtctagaacttgctgtgggattcttacagagcaactttgactctgggttccttttgatgctcacagtgtattccccttttcccaaggctagattctaccatccttcatggaaaacctgacagatgttactatgcccaggctttggctcagataatatttaagttttcctctctctagttatcaggacaagcactgccagcccaccgctttcagttcataatatgaagaacaatccttttataattttgcctattgcaataaagtgtcatctacataaactttcttctgatacctgcccaccagcaaatgacctgctccgccaattcttcatgtgctttaatttgattctttacttcttattaaacattagtaggtattgttgccatttgctcagggggtggcttatttttagtaattattacttagaggatatggctgtgaactgctgtgagataaaagataaagcatgtggaattatgactgctaatattgttagtgttacttaatttaaaaaattacagtgtttcatacattagaacatcttaaaatatcgttctcaatttggattttctgaatgaagactttttactaattttaacatctttttattgttgctctagtgtcatttccaaagcttagccaaacaggaactgataccaagactgtataatcactattttacatagcagcctttttaaaaaaataatgaggtcggctgtaagtaggtcactctgaattataaatatacctgatgttagtgttatgtcattttacaattttctctgcttatagaaattaaaatatgaattatatgaattatgtgatgaaaacacaataaaaagtttgtgttctgtaaggaatgcttatatgttaggtatacttttcaaaagatggtaagacagtcttgagcaggcaaatcatagtcccatttattaaaataagtgactaaaaagaagtattgaggaatgaaaaactttaaaatataatcttgactcaaagtagacaatttgagttttgccataaaactttgtctcataattttccatcctgatgagttctgagttctaaagtctatgagtatttgaggcaaaaattagatactcatccaaatagttttcttgtgtatacttttagtcctgcttattttagtagagtccaagtagcagattttattaaagtatgaatgctatattctctaaaatggattatatgcagaaaaacatgaaggaaagggagtttgggccagatatgtaattcaggaagcaaatttgggaagtagctgagtaaagatggtattttcctagtcagtgacaattatcaggacctctcctctgcgttatgtttccacaacatttcattgacttgtctataaaagtaaagcttggagtcaattcaggtgtgacaacaaaagaattcaatagtaaacccaggggaatcataaaggcaagtgcagattttaattcgaaagttttgacaaaacagctgctcaaggacaacaacttttgatgtgaagtggatcctgacagaagctcagatccctgatatttcagtcctgttcctttgtcaacataaaggcgagatagtgtcttatgggattaagcaaactccatggctaaaaatatagtttgacatttcttgaaagcacttgacaagactccacacaaaattatattagtattcttttcagctgagagacaatttttaagggagtctgagttctattattcaaattcagatttaatctttggttgccatggcatcttaaaaaatttaatcatatattgttggagtttaaatgttgggtctagggtgttttagtacagttggaaaataacaaactctagaaacattattgcaaaaattaaattgcatttgggaactttaaaaaaaaatagcagccctgaaaaagtcaattacaaagattttacataataggaattctacacaataggaaagtgattattgaccatgttgtcagtggccatcagtgtctgccctggtctttggcatccttgctgtggtacagctggctggcagattgtagctaatgtgcaagtagagaagaaaggtgaggaggagcaagggttgcagaatacaagacgccagcagcctcagagactggggtgatgcatgtttgatgtttagtgctgggaggaagaaatctgcagagaatttctgtggtactgggctgattggagatgggggcggcaaatggaaaatattttatgggtaggtaattatattggttctgagataatatttcagcagcagaaatggtgaatggcaatccttaatcaccaaatgttgcagccatgggaagtggaaggctgagtttgaaagtgttaagtcttcttcagatggaatgtctgttactgccttaaaatctctgtcttcttagcatttcctttcctttgaaaaaacattatttgccagcttgttggactctagctcttgttctgtttacctacagggaaaacagactgcagtgtccaacagcattatttactctttaaagacttttttttttaaccaaaaactgcagatggtttagttttctaaaacaaatgcagaggtgtgaatggttaatcaagctgaaacaattgcagagctgtgcttttgaaagcttaccaaatgccagcctcacttttgatgttagcattttttttcctaaacagtgtgtccataatttctaatgaaggctttgcccattcatgcttgaaattcatgataataatgtgcagccagataatcacaagatttggtgtcaaactgtggggcatataatttctgcgtgcctgtgaattagcactgataccctaaacataagtatatttatggttctccgtaaacatgccattaaaagttaaaatgctgataaaattattaattactttgtaactttgttgaaaacatcagcagaatgaacttaattcagatggttcttgataataatactaaaaaataattttaataaagaatctaagctaccagatgcctggtgagaaacaaagtgctggtgtggaaatgacagagaaggcacaggaacaaatgtaggcaatttaagataatgctcatctccacccaggttcctagtttcaaatcagagagaggatgaaagcacaaagaccctggccaaaggagggctcagagagaagtggcagattgtaaattagcaggaccctgctactagcctggaaagcaacatgacattccctgaaggtattccaaggataaaaataagtaccgagaatgtgtagatgtccaatccacagagaaaggctcatgtatttgtaagctgcgttagcccttttagatcgccaagtcaattcagtggtgttatattgagcatctaaattattttgttcatgcattaagtaaattacatacacatacacatatgtatatatatatacacacacacatataactcacagaaaagttaatatatatccatatttctctaccattttaaaagataagtgacaaaaggaaattactagttacagtgcagtacgatccaccaatgaagcttattttcagcaagaatgctatttactttattaaaaatttgatttgtatataatttttcaggaatgtaagtattgaataagttggatttccttatacagtttaaaaaattaactgggtgtggtaactcacacctgtgatttcatcactttgggaggctgaggtgggaggattgcttgaagccaggagtttgaaaccagcctcacaacatagcaagacactggctccacaaaaaatttaaaattagctgggctctgtggtgcatacctgtagtcctagctactagggaggctgaggtgagaggatcgcttgtgcctaggagtttgaggctgcagtgagctatggttggtccactgcatgccagcctgggcaacatagtgagatcctgtttctaaaaaaagaaattaccctatcaatgccttgatccgtgttgatgatttgaaatgaattattgtagctgccatagtaattacaatagtaatatacaaaatttgaatccatgtgctaaagcctgttctaaatgttttaaacctattgatttatttagagccaaatggtattaggtatattatgattatttctattttatagctgaggaagtagaggcattttgagtcaaggttacacagccactaattggctataatcatgaagtgcagtgagcactgggcaatagggttttcagggatattgagtaacatctcatttatttgacatcaaaatacatatttctctttactcaatagttaacataaacacaaattaaaccctggaagtttgtgactataattgtgttttgatgaaatttttctgaaaatttttgcgtctgttcctatcttaataaacaaaattataaagataacctatcatattaataatggaaagaatgttgaatttgcatacagttgggtttaaatctcaattctgatacttagtaattgtatgacctgggtcttaatttccttattggtaaagtgaactgatccctacatccttgtaagtcacttagcatggaacttatgtcatgataggctctcataaatgctagctattgctattaattttattgctcctatttccttaaaaggaaagtgagggactaatgctcaccttataagagttttgctaattaaacgaatggaatttatatatgccatttgtaaatgcatatgtgtgtgtgacataccctagcacagttcttagtaattatcattcagtaagcatatagagtacatgaattaatgcaggcagagcacttagaatatgcctggcatttaggaaggacttatcacatgttgtctgttattattaccatatgataattttgttttggtatttcagttggttgtcctattgtgcttattccctattcttggtttatggtagtggcaaattaattaattaattaatttttattacatggataggtgtaccaagtgacaagttgatactgatcacaaaaatccataattcaggaaggtgagaattatgtggtgagagaggtagtgaggtcagatatatatgttagttgaggcatctatggaacatcaaggtagaggagtatggtcagcaatcagatacagaaaataaattggactttatgcagtcatttgggaatcatcagaatatgcctgttatttgaaactactaaagtgagtttaaagaatgagatgccgtatggagctccagagaacgtgaacattctagagaactccccaaaaataaagatgatgatatatatttggagacatagaagagaaccacagcaactttgggcactgtatgtggacagagaatttgtggtccaccccagtctttaaatgcctcttcacttctacaacagttgacatagtgtcccttctttaggccctcatgcaaagtttggggtgggtgtcacttcttggccccactgtctcagcttcctcaatattcttctgcatgaaaccatgccctcagggtgcattttctctccctccacagacagagctgaatggtgttggacaaagtaactcatctctgatcttttccagtaaaactactccctcatctgtcactcagcctgtctcttagcccttcatgctctgacctaatgcatatccattaactggctgcttgggttttcttggtttagaagcttacatagtcaaaacctaacgcttttacaaagagtcattatatcttgtcctttttctccctcttccttccagatgtatctgtttactgtagcattaagactgaatgaatgaatacataaataaggttgtaatagttatgagactgaatgaatactgatgatgcagtggcctttgcacttgttctgttgaaaatgtctctgatgttgtcttgcctccatttcataaaagtagactaataacacatgtagttgtgtgacctttggagtaggtattgcatgatgacctttctcaaaattaattattaaatcaaagattttttaaaaatagccttttcaagtgatttttgctccctaggaaaaatcctaagagatgtgatcagtgtattttgactggtcaccaacattggaaaaatgcatatgcaaaattcctacaacactaacaggaagatcaggccttctggtcagcctcggttcttctgcctcacttaagtgtctgttgaagagtcttaaataagggatttgccatttgaagaaattgagctagaaaactttagagatgacttgctgcaaagcttgcacattctttggtggaagaaagaatggtttagcaaatccataagattagcattttaacaggtatttctaggcacgagccacatttaagaaataagattaaaattcttcagtagtgactgcattatttttaaattgcccactgaggcttttcagaccttcttaataccttttgtctacaagatgatctcgtgacataacacttagggacatggagaactttaaaatgctgtaaaacctgttttattttattttatttttccagaacaagttcaacatttatttagtaataatataaattttctatctttagctaagtctgcatttctgaaatgatcttttattgaaggtatgaaaagaatcaggtgacagacttacctaatgttaaccaaacttacctaagcatactttgccttagaagcaataggtaagtgtgtgacactttggaaagcactgtaataaagatttcttttaatcatcatcagttttatttatgggacaaaagagaatttggccttgtttcactacagccagaatgatgattggaaaaattatttcactgagtcttcctaggataaaaatgtgaacatcaccaaaatgtactaattttaagagcattgttggattgccattgactagccagtgtcacaaatgtgacttctaaaatataacatcctaggtatcaccctggttactttttatattttaagacaaacattgaacctgctaatggcatttagagattattgaagccactcatcataatatgtcaggtcaactggattttcccaaagtattttctattttcatctagcattgagccctatattggcaaaacctcttttttctcccttcccagatgaaagggatcctaaaataaatggattggatccaagtggatcctgggggcctggtgcaggagctagggtgggattgggattggacaaagctttctccatccccagtggtcttggaatgagaagactataccgtggaataagagaaacccgagagacagcataaaggggttgagacataagccaaagtcagaaaaacatacttctttttttcttcaatgaatttattaatatcttattttaaatttatttaaatagtttttggggtaaagtggtttttggttacatggataagttctttagtggtgatttctggattttggtgcacccatcacccaagcagtgtacactgtacccaatatgtagtcttttatccatcaccaccatcccaccccttcccctgagtccccaaagttcattttatcattcttatgccttttcatcctcataacttagccccaacttataagtggtaacatatgatatttggttttccattcctgagttacttcacttagtttaatggcctccagctccatttaagttgttacaaaggccattacagaaactatactttcatgaggggctggaaaaaaaacccttgtaaaaggcaacagtatggaaatacaggaacatgaattttgaaatgaaaagaataggctatgaagattctgtaaactctgggatataataagaggatttctgaattatggggctacaatctttgtcttgatagagggggcaattgaggcagaaggtgtgagcctgtcagtactctgagaatcacttaaaccatgatctggatggtatattttgtattgatatacaatatttgtacatacttatggatacatgtgatattttgatacatgcatgcaacgtgtaatgattaaatcagggtatttaggatatccagcacctctaacatttatcatttctttgtgttgggaacagctcaaatcttctgttctggctattttgaaatatacaatatattgttaactatagttaccttactgttctgtgaaacactagaacttatttcttctatctgtacatttgtacccattaaccaacctctctctgtcactacccccctgccaccgccttcaccccacactcttctcagcctctggtaagcatcattctactctctaccttcatgagatcaacttttttagctccacatatgagtgacaatatggtgtgaacacacaaaagtttaaaaactcactgattgagcagacacacaaatatcaaagagacaggaatcaaatgttaccactacagaaaaccaccaaatcacaataagcaatgagagaaggaaaggaatagatgatacataaaacaaccagaaaacaattaacaaaatgatagaagtaagacctcacctatcagtaaacttcaatctgtttacaaaacagattaatttccccacttaaacgatatagattggctgaatggatgaaaaaataataacatgaccaaactatatgcagcctaaagaaatttatttcacctgtaaagactcatatacactgaaagtgaaatgatggaaaaagatactccacacaaatgaaaactaaacactgacgggagtagctatacttagataaaacagactttaagtcaaaaacagtcaaaaaagacatagaaggtcattacataatgataaaggggtcaattgagcaagaggacttaacaattctaattacatatgcacctaacactggagcatccagatacataaagcaattattattagatataaagggagagacaggcttcaatacaataacagttggggactttaacaccccactctcagcattggacagatcatctagacagaaaatcaacaaagaaacattggatttaaactgcactttagaccaaatggacctaacagacttttatggaacattttattcaacagctgcagaatatacattcttctcatcagcacatgaaacattctctatgatagaccatatattaggccacaaaacaagtctcaacaaatttttaaaattcgaaatcatgtcaactatcttcttggcttgcaatggaataaaactggaaatcaataacgtgaactttacaaactgtacaaatacaaggaaaataaaagtgtgctcctgaatgaccattgagttgaagaagaaattaagaaggaaataaaaatagttcttgaaacaaatgaaaatggaaacacaacataccaaaacctatgagatacagcaaaagcagtgctaagatggaagtttgcagcaataaatacctacgtcaaaaaagtataaagatttcaaataaacaggccagtgacatcctctcaaggaactggatggtatagcttagccacacatgtttagtagtgctaacatctttagttgagttaattaaaaaggtgaatctataacaatgaattttgttggagggtattaaaaataggttttgtgaaagaaatgaagtttcacattgtgtttggaccaaatatgctaaaaaacaacttgatttccttcatacaaacattttagagggagagtcagtataaaaattaaaaacgtttgaaatttcacatcaagttcagtctttatggggtgaattacacaagattgctctgtttctaagtggacaaataaaattttctaaaataaacatgttttactacttaaatgatcatgctgctacaagccttgcaggaaaatgattatatttattagtcctctagtcaaactcctatctatgttcacatgaatttaagcatcctgcaaaatcttcttcctctgtgaatggataagagcaatttcagcacagaattttaaattctccaagtattcctgtctctgaaattagcctctctacccaaatttacaaggcttgttatcaaatatgaaaatataccagtctctcaaaatttaaaacctataatttttggttccacactagtattgtatgtagctcagtgttattccttaataaatatttgttgaatgaacaaactaattttgcaataatttgtcaaatgtgctctttcttaaaggatttccagtctcttgtgggattattacatcttttttccacttgagtttcacagaagtgtagtatacatgcactaaggtggcccctagaatatgtattttttcctgaaattatatgcaataaaacgtcctccattctacttgagcataatttgttatataccatattgaacgtctccacagatggttttgctgtcaaatccttgagtttaaatgattctgaatgtattgtagtcctgttggacatagagaggttgccttgcattaaatgcctcccagggatcaatataattattccagtgcccactgcactccttttgccccaagttgaatacactggagacttgcagtgtagaaagaacataagctgtaggctgggcgcggtgggtcacgcctgtaatcccagcactttgggaggccgaggcgggcagatcaagaggccaggagatcgagaccatcctggctaacacggtgaaaccccgtctctactaaaaatacaaaaaattagctgggcatggtggcacgcgcctgtagtccagctactcgggaggctgaggcaggagcatcgcttgaacccgggaggcagaatttgcagtgagctgagattgcaccactgcactccagcttgggcgacagggcgagactctgtctcaaaaaaaaagaacataagctgtagaatcagaggggttcttgtttcagctctgccatttcaatagataagtaagttgcttagctttgttgagtcttagtttcttccctagaagagtagaggaaataatgtctataggttcacagttctgaggtctgcattacatagtgcagctctagtgtgtaattcagtgcccagcacagtcagaactacaagaagttatttactctcctcttgaaaattccatatagttctgttacttcctaagtgcccatattcagataggccaagtagaaaaatcctggaatttggccaggcgcggtggctcacgcctgtaatcccagcactttgggaggctgaggtgggcggatcacaaggtcaggagtttgagaccagcctggccaatatggtgaaaccccgtctctactaaaaatacaaaaattagctgggtgtggtggtgcgtgcctgtagtcccagctactcgggaggctgaggcagaagaatccttgaacccgggaggcggaggttgcagggagctgagatggcgctactggactccagcctgagcaacagagtgagaccccatctcaaaaaaaaaaaaagagaaaaatcctggatctgtaggattgatggctaccttggagaacctactgctgtttccctcccccaaatattgttttattgaagcaatagaaaatatttctagcacagtgtgaaaacccatggttaacttgtgatttattttctttataacttcttatgcatttgtacattattttatgacagcataataacataagcatttactcctttttattaaaatcttcttaatggctgtatcgtaactctgtgtggtcataacatactttaattaaccattcttttattgttggacatttaggctctttcttgtgtcgggctattctaaataatgatacatcttgtacaggaagcttttttgattttttcatgttattttcttgataaaagttcccaaaattagaacttttgagctaaaatatatttttttattgtgataaaacgtacataacataaaatttaccattttaaacatttttaagtgtagagtctggtgacgctggtcattcacattgtgtggaaccggaaccaccattcatctccagaacttttcccccttttcaagctgaaactctgtttcataacaataattcctctttttatcctcccctcagccactggcagctagcattctactttccatctctaggaatttgactacactaggcaccttatgtagttgaaatcatacaatatttgtccttttgtgttgactcatgttactaaataaatgtcttcaggtttcatccatgttgtagcatatgtcagaatttccttcctttttaaggctcgtattctattttgtatgtatactaaattttgtttattcattcctccattgaaggatatttggattactttaccttttggctattgtaaataagtctgctgtgaacattggtgtacattatctcttcaagtctctgttttcacttcctttgagtacataccctgaagtggaattgctggatcatatggtaattctatgtttaattttttgaggaactgccattttgttttccactgcttccacaattgctaccagcaatgcacaaggattccagtttctctatgttctcaccaacagttattttctttctttctttttaaaaataatggttattctgtcaggtgtgaagtcgtgtctcttcatggttttgatttgcatttctctaaagattagtgatggttaagtatcttttcatgtacttattgtccatctgtttatcttttgggtatattctttgagtgttaaagatcttttcccattttttaatggacttgttttcttttgttaagttttaggagttatttatatattctggacattaatccccatcaaatataagatttacaaaaaatttcttccattccatggttgcctttccatcctgtggatggtgttctttgatacacaaaagtttctaactttgaaattcaatttattttttgttttattgcatgtacttttggtagtatatcaagaaatcacaccaattagaatggcgatcattaaaaagtcaggaaacaacaggtgctggagaggacgtggagaaataggaacacttttacactgttggtgggactgtaaactagttcaaccattgtggaagacagcgtggccattcctcaaggatctagaactagagataccatttgacccagccatcccattactgggcatatacccaaaggattataaatcatgctgctataaagacacatgcacacgtatgtttattgcagcactattcacaatagcaaagacttggaaccaacccaaatgcccatcaatgatagaatggattaagaaaatgtggcacatatacaccatagaatactatgcagccataaaaaaggatgcgttcatgtcctttatagggacatggatgaagctggaaaccatcattctcagcaaactattgcaaggacaaaaaaccaaacaccacatgttctcactcataggtgggaattgaacaatgagaacacatggacacagggtggggaacatcacacactggggcctgctggggggtggggggaggggggagggatagcattaggaggtatacctaatgtaaatgaggagttaacgggtgcagcacaccaacatggcacatgtatacatatgtaacaaacctgcacgttgtgcatgtgtaccctagaacttaaagtaaaaaaatttataattttttaaattaaaaaaaatcattaccaattccaatgtcatgaagcttttccctgctttgtagtaagttttgaaattagaaaatgtgagacctccaactttatttttcttttctggatgaacttttttaaagcctgcattttcaatacagacatgcatgcattcagtgtaggccaagcaaggtctaaataaccaagcaagtttctttctacctcctggaggcagaaccagtgaattttacatcttgatagatcaatgttctcttttccctgtgactttttaaaattaattattaaatttttaactgtttattttgaaataattttagtctgacaaaacagttgcaaaaatgatgcggagtaccttgtacccttcaacaagtttcccttaatattaatgctttacataatcacaattcaattatgcaatcaggaaactgacatttgtgcaaagacaaaactagagatcttattcaaattttgccaatttttccagcaacatgtttttctgtcctgagatctgatccagtattctgtattttctctctttattaacaaatatcttttttttttttttttttttgagacggagtctcgctctgtcgcccaggctggagtgcagtggcgggatctcagctcactgcaagctccacctcccgggttcacgccattctcctgcctcagcctcccaagtagctgggactacaggcgcccgccactacgcccggctaattttttgtatttttagtagagacagggtttcaccattttagccgggatggtctcgatctcctgacctcgtgatccgcccgcctcggcctcccaaagtgctgggattacaggcgtgagccaccgcgcccggcctttattaataaatatcttgagggagataactttgagacttacacaaatatcctatttctcctcaacttttgcccattaatcttagcatccattagtggatcttatcagcaataattattactgtggtgtttgcctaatggtgatactgtatttccctctttcctttgacattcattgactggaattcttttgaaatgaaaaactgttccttttcccccatttttttcttagaacatatttttgaagcctctgaatacattgagccaaatgtattcctgaaagatttctcccaagttatgcttctcagcaatagtatttaatatcatagtaaaatcgttttacccattcagtggtccaacatgtcaagaggctgtccctaattaccccatctaagttagactcctcttaactatgctattttctatggcagaaactgattaccataataggaaatatcaagactgggagaggggacggtaactttagagatgattaaggaatgcctcttgagaaagtaacatttttgctgagaaggagagaagtatgagaaggagccaagcagagagaaagtggagggaagagtgttccaggcatagggaacagcatgtgcaaagccccaagacggtgaaggcatttgccttagctcaagggagctaacatccctgaggaactcaaagatggccagaataaaacatagtgggtgaggcagcagtgcttgggagatgaagtttggttgtaagcagtggccacatcaggtaaaagtcttgaagactttgttaagatgaatggattttacgctggggacagtggaaagccactggagaggatttttcatgggttcttttaggattgcacattctgttatttactgtctatattagattcctatggctgacataaccaagtaccattaaataagaggcttaaaacaacagaaatgtgttctctcccagttctgaggctagcagtctgaaaccaaggtgttggcagggccatgcttcctctaagccactagaggaggatcctttcttgcctctttagcttctgatggcttgagacattctttggcttgtggtatcgtaattcactccctgcctccatcttcattcacatggctttcttctcgctgtgtgtctctgtgtctttacatagcagttattctttctgaatcgctctcctcttcctattaggacaccagtcatattggattaagggctcacctattccagtatgacatcttaactaatcaaatctaaaatgaccctatttccaaataaggtcacattctctgggggctaggatttcaatatatacttttcaggaacacagttaaacccgtaacactgcctctattgtgtgcatgtgtttttaatttcagcacacctacttatgtggtagttttctgtgcaaaatctttctcttttttttgagactgagtttcgctgtgtcacccaggctggagtgcagtgatgcaatctcagctcactgcaacctctgtctcctgggttcaagtgattctcctgcctcagcctcccgagtagctaggattacaggtgcatgccaccacgcccggctaatttttgtatttttagtagagatggggtttcaccatgttggccaggctggtctcgaactcctgacctcatgtgatccacccaccttggcctccagaagtgccgggattacaggcgtgggccaccgcgcccggccgcaaaatctttctttttttcaagttataaccttttaaagtagcttgtttttgttttgttttttgtttttgggatgaggtcttactctgtcacccaggttggagtgcagtggtgaaatcttgattcactgcaacctctgcctcccagggtcaagtgatcctcccacctcgccctcccacgtagtggggaccacaggtgtgtgccagcatgcctggctaattttttgtatttttagtagagacaaggttttatcatgtttcccagggtggtctcaaactcctgagctcaggcaatccatccacctcgtcctcccaaagcgctggaattatagacgtgagccaccatgcctggcaacctgttcttattttattaatttaataactttcttcattttactgaggatataaagtaaaattgtgttttcaatggatttttacagttgggggccatttgccttggtgtttaacttgattgccttcttttgagtttggatgtggatggttttcatatgtttgtgagatgtgtgtagtttcatgaattggctgtttgacatttttttattctttagttgctgaaaacactagaacctttcttattatcagtaggttcttaatatagataatatattaatgtttctctatcagattttctgcataaaacatcccaggttgttttgggtacttgaaatacttactttcataaaatatttgattgcaatattatgtattttagtttttttctttgaaatatatttcataaattttaataatagaagtttatcagtaagtcaaataaatgtttcccacatattttcttctagttatttatgggtaaattttctttacacttaaatacctttaatgcttattttcccctaattattaaaatgatgaattatttatttctaaatataaaacaaatggttaatgtctaagaaagttcagaaaagctcaaagagaaatcaattctccatacattcatgacccactagtaattgcttttaacttttttttaaagtttttaagctttttccatgcaaatattttaaccatattaatttaactctctgtgtaatatttggagaaccccagatttcttttcttgacactataatctaagcatattatagaacatactttgtgaatatcattttttttaaccaaatgtactatcatgtggacatttaatgaagagatcagagaactatgacccttgggccatatccagcctaccattgttttttgtaaataaagtttactggaacacagccacaatcatttgttaacatattgtgcatagttcattttgggataaaatagccagtttagaagttatgacagagagacactgtggccccaaaagccaaaaatatttactatccagttatttacagaaaaaggttgccaatccctgctcactatacttaactatttttttgagttttgtgctttgggtagtttaatttttttgttttaatatataacatgatgatgaaattttatcaattatatttgttacttatcttgagttttcttaggccagaactttgagtacctttaataaagtcattcatttatttatttcttcttttattcaacaaaaacatactgaatagctatctcataactagcactgtgtttgtttctaaaatacgcttgtaaataagatacacagagttcttttagggagtttacaatttggcagggaaaacaaatatatttaaatgtgttgagcatttgatgaacatttcgtacagagtttatctagtgagattatcacacaacagaaaatcctgacttaaaagaaggaggtcaagtaaaacctctcgaaaaaagtggtgatgcctgaagaatgaaacttggccagcaggttgaagagaggcagtggcaacgggcacggagtctcctggagaaggatcagagtatttgaagatccaaagagaaagagattcctagaaataccaggaccttgaaattgtacaattctggctgaagttgcatgagtgaggaaaagagctggagcggttgaaggaccaggctttacagattttaaagtatggtaaatattttgaattctaatgatataagaaactattgaagcagattttatcactactttggctaggaaatagggaatttttttgaggacaaagagttgctgcagagatttcagttaggagtttaggccagagaagatggagcttaaggtgttgatggtggagaagagagaagaggacatatttgacagatattttggaggttgagctggcgagatttcgtgatactagtggtgggagttgaaaatagggaggaagcaaggatgaccccaggcttatgaaactgggttagtgtcattcactgagtgagggagcactagaagaagagcagtttgtttagagtgggatgggaataatgatgttgagtttgagatggctgaaagaagtataaatggaaatgtcaaataaggggtgaactagatcagctcaagcctgagggcacataactcaggggagaatacagttggatatacatattcaaacgtcttttgcccacagatgattatagaggttatgggagttacctgagcagagagtatggagttaggtgacatgatggccaaggtaaaggcccaatgaataccaccatttagttatttatttatgtttttgtcaaatgaagaaggtagagctggaaaaggtagattgacagagatggaggaggggcagcagataagaacagtatcacaaatcaaaggcatgagaactgtaaaagggagcagtggtcaactgtaacaaatgctgctggaaagtcaggtatacaaaatcctggacagatgtttattggtttaattgaaatgaatgaatggtttttgttgatatgtaggaagtcagttcagtagatgttatgatgtagaaataatctggagacaggttaagtgggaggtgaagataaagaacagcaagtatagatgatttattcaagaagtttgtaatggaagaaaaataaaatagaagctcaagggggagatgggaataaggaaggtgtattatttgtttgtctgatttttaagaaagaagtttaatcttctacatatttcaaaatttcttctcaaacattattactaatattatgaagaataacaccatctacatatgaaagtgcttgcctcacttagggttgactagactggaacattatcatttttagtagaatttaagctctgctagggcaaggatctttttttctctttcattctttgttttatacccagcacctagaatggtgcttggcacatagtacatgcccaataaatacctgtggaatgaacgagtgaataatacatctctgttaatatgaagtatagaagtgctatctcagtattgctttagcgtacaagtctttgttaactagtaatctcatgtatagagatccctatcaaactgaattcctcagtggcaagagctatgatttgtttatccatggatccccataaagttgtatagagtttagcacttaggctgtcaaacatagttgtgccagataactatttttttgccttacatatggagagaaggatgagatttcaaataacttaacctagagtccaagggaaattggccatagagcctgctttcagctctcaattaagctctggtttagttaaaccaaaaggaaatatttttccctttaaaaataattctatatggagaatcaaatctggtggctctcacttgactataaccatttcattctctgcattgtgaggtgtttctagtactatggaattgctactggtgatggaaagaatgctctctctatatataaatgtccttaaaatgctatcctcacagaattttataaaacaacacaagaagagggtaacagtgttaagaatataaaaaatgaagtttggtacagtattatatcatggaggactagctcaggaaggaaaggggtaaagttctgcatgactgtaaaatacccaagccagtcatgttactcatattgataaactactgtcccagctgcatttttcagattaacaaaaatcaagctacaaaccattaaagaaatataagagacatttcttactggtttcatgtaggggcattcaatttacggtgcagtacctatcacttcaggaaagaaacattgctttagaaaagaaagatatttctaacatttttggactaaatggtcaagtctctaagtctgtaaatttcactagataaaaaaattgtatgtgctgggcaaaatattattgagcatccattttccttttcttctttacacaaaaaatttactgttatagctcattgaaggctcaatgcgaaatgaacaacctctttgcaatcctgtcacccaagtcttgtaaacaatcagctctttccacacacataatcataagcacagactataattgggatatttatttatttatagcttatttgtgttctgtgtttatttgtggctgtgcctctgcaggtagagtgaagtggattgttcaaaattcagttaatggtggtgagctgggtatacaaaggctgaaacgctgcatatttctttttttattagatttttgtctcattctattcaccatgcttcaggaaagttattaataactcaatcttcacaacttataaagtggttactgatttgggtatgaactgattaaaatttagctataaatcatccatttaattgtagtttctcagtttaggaggagaatttcatgattattttgttaatttcagcattggattaatcttgcaaaatagactatgcttcgatgcctccaataatggaaatctcattacctcacaggaaagccccttccagctcttgacaagtctcagtatttgaaagtttctccttacagtgacacccaaatcacttttcctgagcttacattctgtgattattgttccaactgttgaagttataccaaaacttactcttccgtatgacaaactcttatataattaaagacacataatataattcacctaagtattttttttcaggacaagcatctacaacatcttgttatttcttaattgacttgagttcaagatgcttccgtatcttggacacttaccaatctttttcttaaaatgtggagttctgctgttacctctcatgttttagatacactgttaatttagcccaatattacatttgtctctgataatcacatcaatttattgacccatattgaatgcactgacaactaaactttgtcatataactcttgtcactactaagccatgccactcccattgtgtacctatctaatttgtttactggctatgataacagaaacttatatttaaccttatttacttttaatttgtaagaccccagtcgtttctgcattcttttaatagacgttttcatccttttctctcatatagtctacttatctctgtcagctccctgtcacctgcaggtttgatatgcagaactgtatatcttcatccagttcattgattgatatgttaaacctcagcattcccgctaggtgggcatcatttcattaatcaggctctttggataaggtcattctatcaatttcaaacctataaataccacattgtagttaagagtttgggttgaaaagagatcctagacatggttctcaaatctattatgtaaaagatacaatattttaattacccttgataaattatgcaattgtctacattatgggttttttccccctttaaaaggagataacatatctacttctgagagtctgggatacactttaaatgggataatgtgtataaattgcttagcataatacctgacacatagtaagtagttgtattagtcagggttctccagagagacagaaccaagaggatatatgtaaaaactgctttatatggctgggtgcaatggctcacacctgtaatcccagcactttggaaggccaaggcgggcggatcacctgaggtcaggagtttgagaccagcctggccaaaatgggaaaaccccatctttactaaaagtacaaaaattagcctggtgtggtggtgggtgcctgtaatcccagctactcaggaggctgaggcagaaaaatcacttgaacccgggaggtggagttgcagtgagccgagatcacgccactgtcctccagcctgggcaacaagagcaagactctatctcaaaaaaacaaaacaaagctgctatatatatatatacataaagggagtttattagagagaattggcttacacaattggctcacacaattacaaggcaaagtcccatcataagtcatctgcaagccggagaaatagagaagccagtagtgtggctcagtccaagtccaaaagcctcaaaaccagggaagctgacaatgcaagcatcagtctgaggctgaaggcccgagagcttctgggagtctgctggtgcaaatcctacagttcaaaaggccaaggaacctggagtctgatgtcgaagaccaggaagagaggaagccaagtgtccagcatggcaagggaagagtgagagtgggaagactcagcagcaagctgcttatctcccttcttctacctgctttgttccagccttgctggcagccagttggatggtgcccaccaattggtgggtctttcttcctagaacactgactcaaaagccaatctcacctggcagtaccctcgcagacacacccaggaacaacgcttcttcagccacctgggcatccctcaatccagtcaagttgacacctaatgttaaccatcacagtggtctattattactgactatctttatcattgtgttagtttgggaaatactagctgtaataacaaataacccaaatatttcagtgctatataacaacaattcattgtgggctgtcctggttggcagatggctttcttccatgttgtgattcagtggtgaggctctttttatttggtagctctgccaccccttagggcctcagtgtcttctttatctaggcagaagaaaataaaaaagaaggtttataactaacaccacctagaagtgaaataaatcacttcaactcacattccaatgaggagcactaatcacatggcctcacctagcttcaaaaaaggcaccaaaaaatgtggcccctgactgggcagccagttcccagtgttaacagttggtgagagcacacatttatggtagacagtgtatcgctgctgtgatcaccatcaccatcatcatcatcatcatcgtcatcatcatcatcattaatattccctcattaagccacatgcagctcatgttcctctatcttgtccagtaagattttgtaaacaacgatgtaaaagaactacctgacatctttttttttttttattatactttaagttttagggtacatgtgcacattgtgcaggttagttacatatgtatacatgtgccatgctggtgcgctgcacccactaactcgtcatctagcattaggtatatctcccaatcctatccctcccccctccccccaccccacaacagtccccagagtgtgatattccccttcctgtgtccatgtgatctcattgttcaattcccacctatgagtgagaatatgcggtgtctggttttttgttcttgtgatagtttactgagaatgatgatttccaatttcacccatgtccctacaaaggacatgaactcatcattttttatggctgcatagtattccatggtgtaatgtgccacattttcttaatccagtctatcattgttggacatttgggttggttccaagtctttgctatcgtgaataatgccgcaataaacatatgtgtgcatgtgtctttatagcagcatgatttatagtcctttgggtatatacccagtaatgggatggctgggtcaaatggtatttccagttctagatccctgaggaatcgccacactgacttccacaatggttgaactagtttacattcccaccaacagtgtaaaagtgttcctatttctccacatcctctccagcacctgttgtttcctgactttttaatgattgccattctaactggtgtaaaatggtatctcattgtggttttgatttgcatttctctgatggccagtgatgatgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccattctgtaggttgcctgttcactctgatggtagtttcttttgctatgcagaagctctttagtttaattagatcccatttgtcaattttgtcttctgttgccattgcttttggtgttttagacatgaagtccttgcccatgcctatgtcctgaatggtaatgcctaggttttcttctagggtttttatggttttaggtctaacgtttaagtccttaatccatcttgaattgatttttgtataaggtgtaaggaagggatccagtttcagctttctacatatggctagccagttttcccagcaccatttattaaatagggaatcccttccccattgcttgtttttgtcaggtttgttaaagatcagatagttgtagatatgtggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaaggcattggtagcttgatggggatggccttgaatctgtaaattaccttgggcagtatggccattttcatgatattgattcttcctacccatgagcatggaatgttcttccatttgtttgtatcctcttttacttccttgagcagtggtttgtagttctccttgaagaggtcctttgcattccttgtaagttggattcctaggtattttattctcttggaagcaattgtgaatgggagttcactcatgatttggctctctgtttgtctgttgttggtgtataagaatgcttgtgatttttgtaccttgattttgtatcctgagactttgctgaagttgattatcagcttatggagattttgggctgagacaatgggtttttctagatatacaatcatgtcatctgcaaacagggacaatttgacttcctcttttcctaatggaataccctttatttccttctcctgcctaattgccctggccagaacttccaacactatgttgaataggagtggtgagagagggcatccctgtcttgtgcacagagccaaagacaaaaaccacatgattatctcaatagatgcagaaaaagcctttgacaaaattcaacaacgcttcatgctaaaaactctcaataaattaggtattgatgggacgtatttcaaaataataagagctatctgtgacaaacccacagccaatatcatactgaaagaactacctgacatcttatcatgtctctctacatacttaaaggttttcagccattgtagaattgttatgaaagctcaggaaaaaaagcctagtggataattcagacatatatcccctgccatatctagagttaacctgaatttcagcaagtggatgcaggtacctcatagcttagttgtactgattggcaaaagtgtgatgagtcggtcagtagcacctccatcttgtatgcagaaataacttcatttgatgtgtagttaaacaaaaaacgcttttaatccaaactgttactttaaaataactttctacatctattagttgccttctctatcttagtacatacctttacttgattttttcatatttaaggataataaaataatccaatgaacatcattataatcatttataagcagcaattgttttgtttttctttcacacatgcatacagaggcatatatgtaaaatcattttggatttagaaaatttagaaatttataaagaaaaaattgccaataatcctcagctagggataattacagtaaaaattttggtgtatttctaatattttccattcatataggataattattatctaatgactatatttagtaaggatataaaaatgccattgtttatttagacattccctattattgtatgtatgtcaatatagttgttgcatgtgtgagagtacactgtggtgtgatcttagtaaatgcattgctctcttaattttggatacttactttgcatagctgttaattgagaatacttacatttttaggtgacatgaagctgggtgtgattaattataaagtgctttataaagtaccttagctatactaaaggtatgtgcttaacatgtttttgcctggttcctgcacaattatcactatattgtttgatgtaaacattaactggacaatcttagagagtgctgtgctgtggccttcattaagggggctgggaaaacttattttagagaccagtagcaagcctagagatcacacagaatgattttgtgcaagtgaaagtgggttttaaaaataggatcaaaggcaagctgcataaggaataaggtctcaaaggattaatatgcaactgagtagcctagtgtgctgaaagaagaggtgggaaagggggcgggactgcatgttcggcctgggtgtatcacataaaacagtgagggagttgatagctaatagcccatttgatagaatccctcttttctacgtattcattgattgactacttccctcacatttcacacgcagcaagaccttcccaagccaaggcctaaaatccacatccctgcagtaggtagaattctaaacatgtcccccagcattcctgtcccctggttcttcaaccaaacaccaatctagatactgctgggaagggactttgcagatggaattcaggttactaatcagctgaccttaaagcagagaaactggcccgggtgcagtggcttccacctgtaatcccagcactttgggaggctgaggcgggcggatcacttgaggtcaggagtttgagaacagcctggctaacatggcgaaatcccgtctctactaaaaatacaaaaattagcccagtgtggtggcaggtgcctgtaatcccagctacttgggaagctgaggcaggagaatgacttgaacctgggagatggaggctgcaagagcaaagatcatgccattgcactccagactgggtgacagaatgggactccatttcaaaaataaagtaaaataaaaaagtagagaaattagcctggattgtttggatgagcccactgtgatcacataagccctgaaatgcagcagaaaaaggcagaagagttagggagatgcagcaggagatatggggcagatggggaggggagcccagggagattcaaagcatgaaagggagttggctcatcatgacgtgccttgaagatggtagaaggggaccaagcaggcagcctctagaagcagagaaaaaccccagcttacagcttaccaggaaatggggacctcagtcctacagctgcatgggactgaattctgtcaacaaccagaatgtcttgaaagcgatcctttcctagagcctccagaaaggaactcagctctgcttataccctgtttcactttgtggcttttctggttttctgttcctggttttataatttacctcattttctgactacacaactgtgagctagaaaatgcatgttgttttaagccatttaatttgtggtaatttgttccaggaacaatagaaaactaatgcaatctcaaacatatgtaagcataacttcctatgccaagtactcgtacctttttgcttgtacgcctccctctgcctagatggtgcttttcttattccttaaggtaagccctactcagtctttgaaataaccatgtcacctctttcaggaagcttccctcaatagggttgagtgtaatttaggtgctcttactctgcactgcaatagaaacctgtttacagctcaatctttgaatttatatacaggtaatcattgatttatttgtctgtattccccttcagccttaaatgccttttgataagagctgacatcttttcttactttgcattatcagtgacttttctagtatctagtcctggtagtaatacaaagcatgattgctgaaacaatggttgaaggaacaatggtttctaagctgaggtcataagctgaatcaaaatgttccatcacgaaaattagataaagattttttcctatttatagaaaaaatacagtgataaaaattcccaatttcaaacctttgtcctctaagttatatttcagattttgccacctgttgttgcatatcttctaagaagagctagtctataaaaagcagaacagaaaagtgagttattaaaaataacaaaacaaagcaaaaatcgttaggaaaagacattggtgcttaaaaaaagcctttgtttttctcatgaactcctatttatggttgtgaatttatattgtatacatattatttagccatgttttactagttggtaaaattattcctagttttcatgatacaaatattccagtatttcaccatgtgcaatgaatagcactgacttagtggtgctctattctctgaatcaagtagatggtctttgctctatcatggatttggggtctttttacttctttttaacatgatgctcaagaaaatatggtctggttaatgctgaagatgaaacagtttatatagttctgctcattttcagacctaaaagacatacacacacacacacacacacacacacacacacacacacacacacacgtgctcctactttcttatagtgttattattagtgccttttctcacatgcattctaccacccattctaacccaaagcagcacttttaaaacatgtaatcagaatgttctgtagcaatttgtgacagaaaataataacatatccaatagaaattcctaaaggtgtttcagcaggtggaatgcagaatgatcagcaaatgatttggctagaacctctgccaaaacctccacttttgtgaaaagggccattgggagtcctgataatgagatgtggttaggattttgacatctgctcttaaagatattactggaagcccttccaggaccaatactgacagctcaggaactccttttgacttgcctttccaaggaatcttatgcctcaaagaaagtaatcagaagatttgtttcctccagaaagccagggttggcaaaccgagcaagactggtctagggaggcagatatccttcattctacaacttgtttgtttaattgatagccaactttgcaaattctctctgagctgttaaatgcacatggaaagatgcagagagggcagcatacatgtgtgaattactgccaaacatctccatatgttgtgtcacacgtaaccagttttcctatggaaagggataggtgaaaatgagaatgatttactctcacaatagcctatttttgcaaggagcatatgtttaaaaaatctagcaatagtcataactctgctcagtttcatgtaactttgagttaccacatggtatatcctggaagactaattttactgtgtctaatattaggactaccttagcactcttcactttataatgatcctgtgaaagaaaaaaaggaataaaagttaataatttatacataaaaatttagaccataatggcactaaaaaagcaaaatggattttgtctccattgtcccaaagcatcgttgtcctgtgcatgtgttcttggtgctttggaagcacattaacatttaaattcttgagagtttacacggtagtgattccctgaagcagttaccctacctttaagcaggcctaccctattccttgggagtcatttcaacagtgggagaacctgggagtatgtataaaataatcttatgttaaaccagcagtaattttatatttagccatccttacttaattctcaaggcagacaagttttctactacgtattagtttcttgcacagatggactctcactagggaggcttcttataactatttaatatatatgtgctttttcattatatccagacttatatttgcttatttatttcctccatatcagtctaatccagatggacaaatgtaaatgggaaaaaaatcaaggtcatcatgatctttaatattttcatctgttttttgatctatatgcttatcaaaacaaaattcttatttctctatttttaaaaaatatactattttatattattccctgtaagcatagctctgactgtatagttcttcatattatgccttttagaacttgtgctgttagcctgatattcacttgttaatttaatcacttatcaaatgtttgaaagtccctgggacaacagctatatatttttaatgcttagcactcagtaatgtttttgcattaatactatgtgctaaggaaattcagattgaataagatgggatctctaacctggaggaatttcacagtctaatggagacaatggatatgttgcatttgtgctgggtcttgagttataaatgggattaaatcaaggaagcagccacttctcaggcaaagcaccatgtcctaatgtttcagtcatctcctgaaataacccttttggccaccagtatttgtttttttagatggctgcttcaggtaaggggtacagtacacactctgtaatatctcttaggatattagagaccctctgtaatatcctaagtgactcatatggagctgccaccaatgatttacttaccattgatctatctattcactacctctaaggaagaatggatacagcagactttctatttcaagagcatttgatgaaataacagcttttttcaggtggctctgagaatggattaagagaatccaacctggtatttgtaagatgtacctagagcctcttctaggacacatttgaaagggggatataaaatacaataaaatagttgtagataaccttaatgaggcagaaaggcataaacacaagacttaaagatcacattaaataagctggccagtgtgagctacttacatgtccatatctattatctattgctgatttggggttctcttttaggcctgcaaatctgttttctctttcaatgactttgatcatcttctatctgaacatccaataagtgatttcagctttgcctttctgcttatcttttgcagctaatcctgatccatttttccttattgtttttctggtaccaattttagtcttgctacatcttattgcttaactgtttcaaggggcccataacttgataatgagacaggatctgagagtattggaagattattgtggtttctagagtaagtcagccctaactatgccattcctgggggccagagagcaaaggaggttcttgtcaggtaccagttatatcttatctcttgtcttcagaggtcagtggatagatagagataatcaacgcactttagtaacaagcttccttgctcctactgctctgttttttgtatataatatctcccacctgctgtccattttgctcaaatgtcatcttctcaataaatttagccttaccaccccaagtacaattgcaaccatccccctcctctgctcccacctcccacagcactcccatttgtcttagcaggcttaattctttttcttttttttcatgtcatttgttgccttgtaacatattatggaacttatttattgtgtttactgtttaagtattttcttcccactagaatgtaaactctgtaattttcgtttgtttttattgatgtagccccagtctagaaaagtgctttagcatgtaacaaattaattttttattggtacataatagatgtacatattttcagggtacacatgataattggatacattcatataatgtgtaaagatcaaatcagggtaattgggatatataccaccttaaatatttatcttttctttatgctaggaatatttgaattattctcttctagctattttgaaatgtacactagattattattaactatagtcaccctattgatctgtcaaacaatatgtcttatttcttttaactatatgtttaatttttaatacttattaaatatatgaatgaataactccaatatccacatcattgccatcattcagaatagacttattttgcattcttaattcttatttcaactatatatgtttgctaagaatctttcttttaatccagtgttactgcagaaaatgatatttctctcttcagtatgaaaggattagctatcacagtgaaaaagaatataaagatatgtgagaatggctttgagaagctagagatgctaaaagaatgttagatttgcttctatacaatagtaccctccaggcaataaaagtatttaccttaggctcatgttatcatgagtatgaattttattaacttacttgttatgtgcaaaaggagatgacagcatgctacatctgaaagaaaaaataaacttttgccttgtgtctcctccagaacaaaacaaaaacctcagtaacctgcagaacttaaagatcgtttacgtaaaagggaagtaaaaaggttcagaagccttaaacaggcaaagtgaagcaagcaatatattgccattcctcagtacttaaggagagaacttagaagtcctgtaaaatcaacttttctgcatcactccaaggagatatagtagtgattatagaaaaaaatagttttataaatacaaatacatagtttaagtcatttcttctaaagtcttggaaattatatgctagatgagatggctgaaaattatatgaaattgtggagttacctgtttttacatgaccagtaaccaagcatgattttttgacagaaggttcacaggcctatgccaaaatatgattaaattgctcaattaagtaagaagagatgacaaactagaacagctgtaggccaaggattggtccacatgaactgtgcgcacagtatggattcagagtatggaagtgtccatctagggaaagtaataatgaaaatggtcactgaaagaatggccatttttgttctgccacttttgtaatagcctaatattttttagtagcactcaaaatgctaaggttttgggaaaggcaactttggatttggagagtggttaattttacacgaaataatcttgtttgttgaatttcttatgctattaagccacatagctataaagcaaaaataaattttagtatattgtctcttcaagctatgcttctcaatgaagggtgtatagcaaatcatctgtagaaatttagaaaaaatacagagttctgggttctacttcatagaacccaaatgccctggggtgaggctcggcaactgtgtgccaggagcattgctcaggtgattctgatgcctgttgctgacttgtagttgctacagaaagagaacccacttaacttcaggtctagacaaatggaaaatgtggagaagaaaatagaggataagtaactgtgtcagttaaacacacttctgagatttacagctccttattcacaattctgaaatcttgaaaacgttgaaagccaaaaaagaaaaaaataaggcttcatgaaacctgcccagccctcatccagtttctggcacaaccatatctgaactgacatgaggcttttcatgatctgtatttatcccaacaagtgtgaagagatatgtgttttgttaccgaagcatgaatgtatttcttatggaagttttacttgataaactgtatatgtgcactctctctctatatatagagagagatacatacatacatatatatataaagtatatatgtaatatatatactagtaatatatatactatatatagtagtctatgctaatatatattatatatatatattagtctattctcacactgctaataaagacatacctgagactgggtaatttataaagaaagaggtttaattaactcacaactcagcgtgactagggaggcctcaggaaacttacaatcatggtggaaggggaagcaaacacatccttcttcacgtgatggcaggaagaagaagaatgagtgcccagcagagggggaagcctcttataaaatccatcagatctcttgagaattaactcactatcacgagagcaggatgggagaaaccactcctatgattcaattatctctaactggtccctcccatggcatgtagggattataggaactacaattcaagataaaatttgggtagggtcacagccaaaccatgtctatctatctatctgtctgtctgtctgtctgtctgtctgtctatctatgtatcaatcatttatctatctataaactatatacatatagctgtatatataccattttctcttctagaatctaaagaattttagatcttaaagggtatctggtctcaataagttttgaataagacatggtagagttgtagtaatggcttcagttgacattttgttctgtcctactcagatgatttgaatatattttactgattctaaattttttgagggcagaaactctgtatgctcaccttatataataatgaccatacatattgggtcatttaaaatagtacctcatccaggtctcacaacaatcatgtcacgaatgcagggctcactgttccaaggatgcgagtcaatgagctatcacaatgcttagtggaggggcacagaattaataatccatgagtatttagtaaactgaatattgttttaaattgaattgaactactacatttttttctataagtaatagaatacattcaatgtgtgctggtcaaaaaaaccttaaatgggaaaatatttaataaatacttttataaaatatatagacattttgtaaatcctatgagcaaatgtaaaaggtcaagggatacaaattttattgatgtatgtaagaccagagtcagctttaagcattaaatttaatgtataagggtaggattggtactaatcacacttattttgataaacacttatttttataagcttccctctagtgatatatactcaatcttagaggagtataccagtaatgtgggaagtgggtttgggataaagggtgcagggtggtcaaatgtcaccctcactccttctccatcagtgaggtcttcagcagctgagccagtggtccactcccagaacccgaggtcctctgcacgtgaggcttagacatgtgattcctgttctgattgcactgcctttcaggacctactggatgcttactgtttttggtgttttcataaggagattaccattttccaaatgctagtataagcgaagggagaagaccaaataaaatggactaatttggctgcagtgctaaattgttctgtgcaaatcatgaaacttctctgtgcctgcttcaccatttgtgaaataaagattgtcaaactggggtgacactgaatggtgatgagtacaaatgaactgaagtttccaagagtcctttgaaagttattgtatatttaatataggtgaagtattggttgaatgcactgaataaataaaatgtttttacaaaaaatctgaaaatataaaataattagtttgaaaaaatattacttcattaaatattgttaacattagtgaaatacacacagaatccatttgctaagagcttggactttgggatcaggcatgattgtatttaatctgcatcctggctctgctgtactgtgacactgaaccagctatcaagcctctccaagctgtctggttatattttcctgttctataaaattgggaacatagtaatgcctggatcatggaaaaatatgttaattagttgtcaataaatatattgtaggtcctaaaaggtacaaagtgaaaacttggttagcctttcccttcttcagagaaataaaggtagaattgaggtatgtgttgggaggggagacacttctcaagtataaccagacttagaatctgtagggtttatttggctgtgcacctttgaaaatcattaaatatctgtattctttctataattaattatttctggactttaagaatatctttctaggactaatgatgaaaacttgaattctctgttaaaacatcttgtgttctacagtgctaaaatgagggtgagagaaagagtatggacaaattgaactgttcctaagaatacagtggacaagataaccaggaaaaagcaacagcaacaatttcccaatacaaaacactttggctatataattttttaaaataaaacagacggataagtaaaacagcaatcttttcaaaaccatggtcttttgtacaaaagtaaaggatatctttagagaccaaaaataaagtgtgactcaaacccagacaggtaatgagtaggactgtgactggcttgagggcatctgccaatgctaatgacttagagcacttgttttttcactcatgtgaaacaaaacccaagggctcagacaaagcctgttgtcaaatcagaagcaactgatataaggccaggaaccttgaatagctacactctcactgaaaaagcaaaaaactaccttaaataaaaaaggtgctttggaaacttggttgtcttgtcagagatcctagagagaggaaaacataaagtatcccctgagaattcataatattctgttcctcaagtgagttgatggcccaaagtctcactacctgtaggcttaaaaaactccacataaaaatttattttggagagatcccaggttggaagtttccttagtcccttcacagaacgaagcaaaaattctctctgagggaacacactaacaaatcagtccttaaaatatctccacaaataaattactgataaacatgactgcataatcaaaaattacaaaacacagaaacaagtgtcatgagaaacagcagtaaatacaactagcagaatcagacccacaaagattttaattattagaattatctatatagaacataaagtaatatatgcaaataaataaagaggaaattgaaaatatgggtgaggaatgaaagactgaaccatttgaaaatgacccaaacagcacttttaggaatacaaattttaaatgattgaaatgaaaagttcagttgtgggttaaagagcatgtcagaaaaagatagagaatatgtttaatatgtttttaaatgtaagcaaacatttatcatattaaacagctaccatagtgatttctttcggaaaaagcttaagcaagtgttaataaaagtcaaatggaactgaaattctggaaaaatttccataatatttgggaaggagggttaaataatcacaaatttttcaaattggtggcagtagaatggtgatattgattagttccgttttgctaatttaagtatgcagagtgaaatttttaggacaacttcctagtgaatagaaatccaaaccaatatagaagaaaggaagaaatgaaatgaaaataaaatctcagggctgggtgtggtataatcccagcacttaatccacttaatcccagcctgtaatcccagcattttgggaggctgaggcaggcagattgcttgagctcaggagttcgagaacagcctgggcaacatgaggaaaccctgtctctacaaaagatacaaatattattcgggcatggtggcatggcacacacctgtagtcccagctacttgggaggctgaggcaggagggtcacttgagcccaggaggccgaggttgcagtgagcccggattgagccactgcatccagcctgggtgacagaggaagaccctgtcaaaaataaaatctcaattaatctgaaagaaagcacaaagaaaagtttgagcacaggagcatataaaatgaagtggtagaaaaaattatgttagtaagcacaattaatgtaatttttctgttaaagagcaaagattagcaggctagcttaaaacatttccatctatatgctgtgcattagttttctactgctgcataacaagttaccataaacttaacagcattaaacaagacacatttgatagctcactcttctgtaggtcaagtctatgtgggctccactgggttctctacttaggttctcataaatctgaaatcaattattggccagacttggctctttcctggaggagccaggaaaaacctgattcccagctcattcagcttgttggcagaattcagttccttttgcttgtagggctgaggtccctgtttcctttctggaaatggccctggccaccttaggtcttttcaaattgtctattccatgtcagcaaaggagagcatccctgcattgaatccctctctagcttccaatatcgctgacttctactgctttttaaaggactcatatgagtaaattagtaccacccaataatctttcttttgctgctcatcatagtcacaggttccacccagaactaaaggaaagaggattacacaagagcaagagccataggaggtcattctcggaattccatctcacatatactgttctcagagtcatgtttaaaacgtaaagtaataatgcctggaaaacatataccaggaaaatacaacctaaaacaaagttgatatagttatattgctgtctagcaaaatagacttttgacaggaaacaaagcatttttaggattaaagaaagatactacctaatgaacatgtaacaattttaaacttgtatgtaccatataacatactttcaaaatttataaagaataaattaggctggatatggtagctcatgcctgtaatctcaactaccagggaggccaaggcagaaggatcacttgaggccaggagtttgagaccagcatgtgcaacatagcaagaccctgtctctaaaataaataaataaataaataaataaataaataaataaataaataaataactgggcatggtgacacatactttgtagtccaagctacttggaaggcttaggcagaaggattgcttgagcccaggaattcgaggctgcagtgagctatgatttgtgccactgcactccagcctgggcaacagagcaaaactatgcctctttaaaagaaaaaataaaagaaagaataagttgacagaatatgctaattgttaaatccaccatcatagtgcttatggtggaaaagaaaaagcactgaagatgtaagcattaagcattaagaatttagaaaaacaaaagaacaggtaaatcagtcaaaaatatattaggaagcaaataaagatatgagcagaattaataaaaataaaggtactatatagaggatcgaaatatacaaaatttgttatctgaaaggctaataaaactaacaaatataagattaatccagattaaaagagtacaaataaaccatgtgaaaaaaataaactatcaacagatgcagcagagatcaaagatgtaaccatatgcttcaatacagaaaaatatcagaaaagtaaaatgaaaatatcttggatatgtaattacatcggatatattaacaaaacaacagaaaatgaaacggtttgactaaaacacttttacttgatgtaatcttaaaaatatgtcctaaagctgatatttcacttatatcttaaataaaaatatttggctttatttttagacactgaatgctaagtaggatttctttttacaaaggtacacatttaggtcgttgcttttaaatttctaagttttctattatgaatatcactgaaacactcattccataacattataattatatctgctttcaagcaacaataaaatatagaagcagtgcttactcaaacttacaaaccatgttactggctagttcccttacttcttaatctttcaaattctgaaaatggttatggttatgtcagatggttgagttaccagtcttttcttggacttgccatttcctaacgttagaaacaaacatcaagcctatagttatcttccgcacattagcctacagatttgggtttgtcacccaatagagctggctgaaccattttgataagtggtattatgcaaacaaaatggcaggctacctagtggtgcaggacctgggagactgagctaactcttttggctccatcattagggatagcatgtagtaggcatttcatttagaaaactggaatgctgaggatctttaagatgagatttattttccctttgagaaaatatttgcttttttgtgtgttccaagggctcctttgtggataatattttttatgatcacatttctgaacacatcctttatttttctttctattagctctccatccctgtatacattttcagagccgttatattatggtatatcgtacataattactttctctagtaatgatcagttatccatgttaacaaagcagagacggtatgcatcctgaaagctactcattctttcaggcaaaaataaatgctcaatcatataatattgggctaatatagtttgataatttagccacccataaggaatggcatgctagaagatggtgtaaatatttttttttctgctggcttcttgctcagcaaaaccagtgatcattctcattttttccatttattctaaattacaattcaatgtggtggaaagcaaatcgtactggggcacatcatatttatttgtatttgttaacacactttttgaaactctgcagaacttgcctggaaaggtactttttgattgtgtatatttctgtattcagatgattcaggtgtctttctctaaatgcttctttattctgagacatgcccaatttccttacttaataataaaacagtccatcactcattgtaaatcagtagggatccagcaataaggtgcaatacatcacaaaagcagggcaggctatcattgagataataagaagatgcattaatattcatgcattatgaaaccctggttgtgcctctaaaaagctgtagaatacattccaggtttaatgttcaccagtaggtgtttgccagtgattttaagatacttcttgtggcaatttattcaaggcatcactaggtgatttaggaaactttcatctgcagtttccattcacttaactgtatactcaggtaatgttcctcagtgagtatgcataatcctttctggttagcctttgggttgttctttatctcagttggaagtgatattgtgtaagacggatcatatatgtatgtctgtgtatgtgatgtgctgtgtatggttagaataggaagggcagcagaagggtggtaaaactacatacatacatcctatatagtacagtatttacatagtgtcaaagacatgaaatttagattttgtttccatctcagagtaatttaagcgcgtgcataagaaaataatgctatgctacagtggatgcaaaattaccaacaaagcagggccaccacagaggatgcttgtattgcctattccataagaaaagttggacctcaaataataaatgagaaaaattaaccagaaactctttacctgtcatgatgatgttgggtttattactgttgttaacattctgtgtacataggatggacacacacccaaaattcattcagatgttgggaccagtgatgtctgacttaccccaagagggtataaaaagatttatttcataagtagtgaggctttctggggagagcatggaggctcccaggcaaatctgaaaataacttgagccagggccaagaaaggaacctggtttggaatttttatggtgtacttggagtgaaaccagggtgagggtttccatacatggtttaaacttcctgctggtaccaaaggaaggggcaccatagttttcttatcagttttctcaagtgtcaggcagaaagggaagaaggaggggtgaggcttaaacgttgtaagcaatcaaacataaaaaaaatggagtcatttttcatactacagttatgatgatgttgggagaaactttgggaaatatgactgtagtgtatttgggactttatatcaatatgcttagaagcagagaagtaaaatgaacaacttgaagaaatactggagccctgttgttcacctcacctcttctccaatttaaattctgacattttctggctggtaaccagtgtctcatcactcctagccagtgctcatgtccttcatcatgataaagagtctttcttcttggcctgtgtatgtgaagatgtctcattctgatgttggctttggctattggtaaatcagtatatcctgaaccatattccatgggcggtaaaagttctcaaacattagatctgcttttacaaattaaaagaaattcagtatctttccatcctgtcactgaatgaaccaccataggaaatttcaaagcatatgttaaattatgggttttcttaatattgaaagcttggcattaattggctatacatactgagaaagtgccaaatacttgcttataatttcacctaaaatattgttcctgatgtgaaccagtatatgaccacaatatactgaccaatatatgaccacattttcttcaatgaaattgaataaaatatcaaccaagtcaggaaaataatatttcagtgatagggaaattcttccctaattgtctcaattgactttcttagttgcacaaggaactaaaagaatgttggccatgatgacagttataccaggatctttattgaagtatttaaaagataattaaggaaatctatgaaaatcctatttctggtggcatattttgctgtaattttcatgagatgggagacactaccaatgtgggactatggtattactattatcttcaagagaagagatgaaaaatctacctactaaatgctgttaaagaatacttagcagccgggcttggtggctcacgcctgtaataccagcacattgggaggccgaggcaggtggatcacctgaggtcaggagttcaagaccagcctggtcaacatggtgaaatcccatctctactaaaaatacaaaaatcagcggggtgtggtggcacacacctgtaatcccagctacacaggaggctgagagaggagaatcggcttgaaccctggagatggaggttgcagtgagccgagatcgtgccactgcactctggcctgggcattagagcgagactccatctcaaaaaacacacaaacaaacaaacaaacaaaaaacaaaatagaaacaaaaaaaccccttagcattccatttatgaaacacttttcatgtttcatttatgtcataaagataggtagtcagataaacccaatgtttagtttaccacatatactgagtattaaacaaaatgttgcttcaaaattatctctcaaaagagctgaaacggttttatgttcaaactcctacagaatctcctattacatttattttattttgaacaaagttgtatttggggaagacattaatagaaaacattgttaattaaaaactggccttaaatgttatttaggtcatctgatggatactgttaaaaaaggaaacaagcctctcatggaaatactaattattttgggtgatatatgctcaaatttgccaaaaatctgtgttattttaaatgggcctcttagaaatcgctttaaataacaattcagaaattttgttttaaaatagagaagttttggcaatcaaccaaaagaacacagagaacaggaattaagactaagtgacatatctaactctgaatcagtctgtaatggagggttcccaaatgcagtgacggtcaactatgtttcaagacaatgaaaagaggaaacatgatggttactgatcaaaggcaaagttggtaaaggacagttcttcaacgtaggtgccagactctaaaagccctggcacaatgcgggtagagtgtgctggctgagtgggtcctgccacccctcagcatgagcctcttggatacagaaagtctggaaaaaactcacatcattcagatgtcaatcagtcccaaaggaactagcgtgagaattttgttaccaagaagaaaaaaggaagaaaataataggaaaatccagcagaagttggaagagtcctccaccagaaaatgctaccaaggatgagaggaaaatgatgaccaaacatattatattgaattttttaaaattagggaagtaattgccttttaaaatgaggtttcaaagcaatgaggtttcaaagcaatggcataagaattcagagaggatgatgtgagacaatagaagatgaaacaagagatggtggactcagggaagaaacatagaagaaagaaaattagataaataaaggtcaaattgaaatctctacaaatattacttgacacacgccaaaatcctcagtatagatcctaactcaatgagcagaattgaaagctaataaggaatgtagacatagaggacagagaaaaccagcatatacataattgttgtccctaaaaaatataactaaagtaatggaaaatagaagtcatggattaggataagattccaaaaagactgaacagaacaaaggaaaacttgaattcttagattgaaagggcaaatcatgcctagaaaattgacacaagtcagtaaacttagcaaaattattctactcaaactataaaaagtatactttataaaactaatttacctggaaagatggaaaaaaataatttcaggttcagttttctcacttcttagcatcaacaatgttaaggcaataaaggaatgcctccagtttcttaaggaaaaaatgtgacccaataattttaaactcagcctaattattggccaagtgttttgaaaataagcaatttggttgtaggctatatcgttgtcttgccaatttagttttagggtcaagtttaaaagaaatacataacacccaattataaagcagaatgtagaaatattcccaaaccctaagaacataaaaattaaatatagtgtaagaaagtaaaatatttttattttctcattttttatagatgaggggagaagatatcatgtggtatctttatatcatgtgatatatcatgtgatatctttatatatatcatctttatatatcaagatgatatcttttatatatcaaagatgataaataaaataggaatataagatattcaaagagttaaatatgttaataggaaaaataataaaatagggtagtgaaggggaagaagacaaaaggggaggaagcagaaataaaattttgttgtttatgctcatagtagggagtaagtaaaatctaaataaatagaaaatattaatacatgcctaaatgaagtctaattataaagataattagaacaaaatagaaacctttcatattttagaagaatgcacataaaaaggtatgatggttctttgatgcctagtttgtttatttttaacgtgaagccatgttgaattttatcaaaagccatttctgcatctattaagatgatcacgtggtaactttttaattctgttcatgtgatccagtaaatggatcgtatttattgattagcatataatgaaccaaacttgcatcctaggaataaagcctacttgattgtggcggattagctttttgatattctgctggatttgtttgctagtattttgttgaagatgtttgtgtgtatgttcatcagggatactggactacagttttcttttttcattgtgactcttcaaggttttggtatcacaatgatgccggcctcatagaatgagttacggagatattcctcttccttgatttttggaataatttcagtaggattggtactagctcttcttgcatgtctgatagaatttggctgtgaatccatctggtccaggactcctttggaagtggtagcttttttttttttttagatggagtcttactgtgtcacccaggctagagtgcagtgtcaccacctctgctcactgcagcctctgcctccagggttcaagcaattctcctgcctcagcctcctgagtaactgggattgcaggtgtgtaccaccacgcctggatttttttctttttcatatttttagtagagacagggttttggtatgttggctacgcttgtctcaaacttttgacctcaggtgatctgaccatcttggcctcccaaaatgctgggattacaggggtgagccaccacacatggcctttgttgttgttgttgttgttgttgttactgattcaatgttgaaatttgtttcggtcttctcaggatttcagtttcttcccggttcaatcttgggaagttatatgttaccaggaatttatccatttcttcaagtgtttctaatttttatccatagaaatgcttacagcagtctgtgaggttcttctgtatttctgtggggtcagtgataatgtcccttttgtcatttctaattgtgttgatttaaatctctctttttaacttaatctgggtagcactctatcaatcttgtttactctcttgaagaaccaactttttgtttcgttcatcttctgtatggattttcgtgtctcaaatttgttcatttcagctctggttttggttactcatttctcctgctagctttggggttggtttgctcttgtttttctagtcctctaggtatgatgttaggttgttaatctgagatccttttaacttgatgtaggtgattagcactatgaaatttccagttaacactgccttagctttgtcctagagattctggtatgctctttctttgtcttcatttgtttcatagaactttttatttgtgccttaatttcactctgtacccaaatgtcattcaggagcagattgtttaagtttcatttaattgtatggttttgatacatcttcttgatattgatttctatttgtataatgttgtggtttgagagtgtagttggtatgatttttctttttttgaatttgttgagaatagctttatggccaagcatatggttgatattagagtatgtgtcatgtgcagctgagaataatgtatattctgtaataagagccatctatggcaaacccacagctaacttcatgcttaaggggcaaaatatggatgcatttcccctgagaaccggaacaagacaaggatacccactctcatgactactattcaaaatagtgctggaattcctagccaaagcaatcagggaagagaaagaaataaataggaagagaggaagccaaattctctctcttctcagacaatatgattctatacttagaaaaccctaaaaggctcctaaactgataaacaatttctgtaaagtttcaggatacaaaatcagtgtacaaaaatcagcagcatttctgtatgtgaataatgtccaagctgagagccaaattgagaacacaatctcattcacaatagcctcaaaaagaaaaaaatacataggaatacagctaaccaggcaggtggaagatgtatctacaatgagaattagaaaacacttttgaaagaaatcagagatgacacaaatgaatagataaacattctatgttcatgaataggaagaatcaatattattaaaattgctgtattttctgcagcaatttacagattcagtgctatttctaccatttttcacagaattacccatagtctattctaaaattcgtatggaacagtaaaagagcccaaatagccaaagcaatcctaagcaaacagcacaaaatcagaggcatcacactacctgacttcaaactacactacaaatctactgtaaccaaaacagcatattggtacaaaaacaaatacagagaccagtggaacaggttagagaacccagaaataaaaccatacacctacaaccatctgatcttcaacaaagttgataataacaagcaatggggaggggactccctattcaataaatcgtgctgggataactggctagccatatgcagaagaatggaaccggccccttcctttcaccatatacaaaaatcaactcaagatggattaaagacttaaatataagatctaaaactataaaaaccctagaagaaaatataggaaacaccattctgaacataggcattgacaaaaattttatgacgaagttcccgtaagcaattgcaaccaaaacaaaaatggacatgtgggacataaactaaagagcttctgcccagcaaaataaactatcaatggagtaaatgaacaacctacatgatatggttttgctgtgtgcccacccaaatttcaccttgaattgtaataaccctcacatgtcaagggaggtgccagtggagataattaatcatgggggcagtttcccccatactgttcttgtggtagtgaataagactcacgagacctgatggttttataaatgggagttcccctgtacaagctctcttgtttgttgctatgtaagtcatacttttgcttctcctttgccttctgccatgattgtgagaccttcccagccatgtggaactgtgagtccattaaacctcttcctttataaattacccagtcttgggtatgtctttattagcagtgtgagaacagatgaatacactacagaataggataaaatacttgcaaaatatccatctgacaaaggtctggtagccagaatttatagggaacttaaataaatcaacaagcaagaaaacaaatatataatctcattaaaaaatgggcaaaggacatgaacagacacttatcaaaggaagacatacacatggccaacaagcatatgaagaaaaaagctcaacatcactaatcattagagaaatgcaaatcaaaccacaataagataccatctcacactagttagaatggctattaaaaagaaaaaaaatgacagatgccagctgggctgcagagaaaaatgaatgcctatatgctgctggtgggaatgtaaatgagttcagccactgtgagaagcagtttggagatttcacaaagaacttaaaatagaactaatatttgaccttccaatcccattactgggcatatgccgagaccagctctgtcgtggagaccctaacccagagaagctgaaggaattaagacaaagacacagaaatggagtgcaaagtgggaatcagggggctgacagccttcagagctgagagccatgaacaaagtttgacccacatatttattgacagcaagccaatggtaagcattatttcttttaattttattttattttattatttttttattatactttaagttctagggtacatgtgcacaacgttagattagctaaaagcattccttatgggaaacaaagggacaggctctgccttgttatctgcagcaggaacatgtccttaagacacagctcgctcatgctattgtttgtggtttaggaatgccttgagcagttttctgccctgggtgggccaggttttccttgccgtcattccggtaaaccaacaacctccagcgtgggcatcataaccatcatgagcatgtcacagtgctgcagagatcttgtttatggccagtttctcatggcctgtttatggccagatttgggggcctgttcccagcaggcatatgcctaaaggatataaattgttgtaccataaagacaaatgcacatggatgtttattgcagcactattcacaatagcaagatgtggaatcaacctaaatgcctatcagtggtggactggataaagaaaatgtaatacataaataccatcaagtactatgcagccataaaaaataatgaaatcatgtcctttgcagcaacatggatgcagctagagactattatcctaagcaaattaataaaggaacagaaaaccaaatactgcatattctaacttataagtggcatctaaacattgaatatatggaggcacaatgatgggaacaacagacacaagggcctacttgagtggggagggtgagaggagggtgaggaccaaaaacttccacctatcggatactatgctcactacctgagtgatgaaatcacttgtacagcaaaccccagtgacacacaatctacccatgcaacaaacctgcacatgtactccctgaactgaaaagtcaaaaaaatttttaaaaaggtatgatggacaattaaagcaagaagaaactatctaaacagctttatatgtgctaatattgaatgaagtcagtatattgttaagtagaaataaataaaatgacaaactatcaaataaaattttatctattatgttcattaatatcctttatgtatatgcttgtttattgatagaataacatttgtttatcttaaatgatactccaccaattagtggctacctcaagagtgacactacatagccatagttatttttctattttggtcttgtatccctaataaatcaatattttacatgaatatcacatgcttagcatacaactatatcaaatatgactttagatacagtatatgtagtacctgcgtgggaattagcttgtaatcaggctaagaagataagaatggcaaaagtagagaatcatacagaatgtcaattaatactcagttttgtcacacaaatattttatgaagccctcttagacgactgcagccttcagtgacctccttcctctgatttttaatagcaattatagactgtatcatagttcaacattaaattatgtctttatcattttctaatagttcagtatatgatagtcttgtctttatagaaaagattgattgtcaaatcctttgactctaaattcatttgtgtgttgtattactgatgtgaagcaaagtgatgggatagaaatctcagatacgaacaacaacacaccaataattattataccacctgctaatatacatattttgtgctcataggtgattaataagaaaacaaggtgcagagaggttaattaccttgccctaaataaaaaaaaaaaacctactaagaaatatatttagggttagaacccaggcaggctggctctggaaatagtgcacataatggtatagatgtgtgaccttgctctgttatttaacttcattgacttctcttcctccattgctgaaaggtggaaaataatgacttactttacaaagttgctgtgactcttaataagaaaaatccattaagagctttgtaatccatgaagctgtatagcaaatgtgaagtataactctcatcattgctattttcatgctgttgttgcctggcatcatataggctcacctcaaaggaaagcaaagatttcacttagatttctgtagagataattgttttttacaatcatttactgacttttaaacctcaaaatgcatgtttttgctcagattgtacaatatgtattctaaaataagttatattctattgaaaaagattatctgacaagccatgatgcggtgagtgccataatgaggttctgagttctgtacagagacctagtagagaggaaaggggaagggaaggattctgagactcaaagagttatgcacatttctcccagcatagaaagatttgcaatttcaaattctaatacctgcctgtgagagaggtattcacaggttttgtgtatttatgctacacagaaacctcatggcattgtctttagtctccctttctggcatcttttcccacaaagactgtccttgaccaacaccagaaatgaatttgatttctctaatgcaggagataattggatttttctttatggaatgcatacctttaatgactgtctctgcttctgccaatttagctacaagtgacctgacattgatctgataatatgacttaaaaaataaagagttcgagctggaggtggcaaagatcagctgcctggcatcagaaagaatgtttttttttttttttttttttttgcttcatctaaccattttcctgagaaaatgctttatccttgaatgtcatttttacacaacatgcagctgtagtaattggtcatacagcagcagattgtctccttctagaaaatataataagtatttcccagaaagtgccctggagaaaacattgaaaattgaataaaacccacccagtaatcattctgttccttggaaatatttattaccatgttgattctttctggaacaggataaatattgcctaagagaattaattaaatcttttaaaagtctaatgcaacaagaaatatttatttacctatttattcatgtaacctttaggttttgttaaaatatttgacactagacctgttattaaagaaggttataaaggaacagtggctgaaattgttgtatttggaaaaaacagcaatttcttcctctagagaagttacgatataaagctctttttatacctaagagtatgtgagatttaaatttctctattttcaactttattctttttttccagtaacaatgtaattcacttgattcatggttaatttttattctatcatcttccccttactccttttgataagtatcatgaatcattttgatggaaaatacaatccatgggcattagtttgagtgagaaaatataatcctgtaatttaaaaggatcaagaagaaaataaacagttgaaaaaatcatcgatgaactagtttctctttaaaaataagcaaaaagtgttttcctttttgaattcttaatattagttgcattcacatttatatagtgattgacagtttaaagagaaatgaactgaaagtttatattaaaaccatgcatgattgttgaatcttttttgattcaacaatgaagccacaaattattgtaggccctatgttagatagagcctacataaatctgtagtgttactcagtgaaggggaatggactaactttggttttcatcaaccaagagaatcttgggaactctattcctagaaatgacattgagaaataatatgaagaattaaaatcagatctttcctgaaaactggaatccttatccaccattctgattgtgtcacctaagtgagcatgtgaagcattgacatgccggtgaatgtttccagagaccattttggatgaccctgcttgagaattgatgtgccttccacaggaagtccggtattattgaaggggtcactgatctaaaaggactccccactgaatcacaatctttcatcataaatgattaaatttcacccatttcaaggccactgttcaaagctatactcaaatgcaatgataaagctttaagcacaagagaaaaatttattttagtggatgacgaaaattctctcttactcaatgcagtaaacctcatttcgtttctgttttcataattttgaatctgtcttgtctggatttgaacattattaattaaaatcataagtaatggaatggtgttctcttctcttgaagggaaggcagattttctgggagtggaaaaaatgtgcatgtgtataacatacacacacatttatgtaacacttttttaaaggaaatttattctccatcctcattggatttttaaaatacctttctaatagattaactatttataatactttgggcttctgctgaaaccattaatatgtgatgtggtagatgagaaatgtactttgttaatggatctttaaaaacaggcatttatatcttaatttattttatcatttcttcttgaacaaatattttggtctagtatataaaaatccctttgacattcttagaagaggtagaaagatcttcactggcaaggatttcaaagcctagtgaagagagaaaaaagcatataagtaagtaaaagagaaggtagaaggtgatacatgacatgagaaggatgggtcaagaaccacaagttttctataagtgggagagaacagtgaagacatcacaatagtaatatgacttaggcctcggaagatgggcagaatctgtgcaggtgaggaaaagaggaagaacatttttagatgaaggcacagaattgtgggtgagagaatgctagctaattagaataaatatgctgtagaactgggtacgagtactttaccacacatatagctggaagaagtaaggaagaggaaaagagaagataatattttgattaatgatatcgctaaaaatctagacatcagggaatgcttgagttttggatttagacaaactttaaaagaatatagtattttatttgttacatatgctttgtttctatggtactgtcttatatccggtaatcttaatatttaaaaaattcttaatatctgacatgttgaatgactttaaatgtgctcattctgtatgtacagtcgaagaaactattaaagtttttaattgaatgaagtatatcctaatttttgtttctgcatatgttataatgttaaaacgtatacttattctgttctcaatagaatgtaaattataggcttatagttaaatctgattttaagatttctgaaagtgctgaataagttcctttcattgcttcaggtcactgatatgatgcttcaggacaaaccctatcctgactggggaaaatcagcaagagctttctggaagaaaggaaatgttaggatcactttattctggtaggaaattgtttcacttatttatttctgccttgcctcattcactgaaggactttagttggatgtaattttccttacaattatagaattctatctagagggacatttttggtagctactatgctccattaaaaccattatcctaattattttatgaattaatttcttcttacatattgtgtatattcacatttataaaacagaagttttgctaatatagtgatagaattaagatttgaccagaggtaagttcttgactcagcaaaaacaagctgtaattttcatcagtaaaatctgatagatgaaactgtctcctataaatactaaattgcctagtatatttgacaggatatgattttgctctgagaagtgataaagaaaaggaacctctttataaatcacatcttctacattggcatttcttctttatgtagtttcgtttagctctccagcccaatctttgcaattaaaaaacaatccatgtcttatggaactttgttttttgtgaagtcaccattatttatgtgtacgtgaacaagttcaaacagaaaagataggaatggagaggcagcaagaagggcactttcacgtggctgtgggacactccccaagcacaatgattctgtgtgatataatatacagttgaataattatataatcccaagaaaagttatgtaaactaacacttataaatgttctacagtatttcccccttatctatggttttgctttccctggtttcagttacccttggtcgactgcagtctgaaaatattaaatggaatgttccagaaataaaccatacatacattttaaattgtgtgctgttctgagtagtgtgatgaagcctcataccctcccgggagatcaatcgtctctttgtctagcgtctatccatgctgtcgatgctacctgccctttagttacttagtagctatctcacttatcagatctattgttaaggtattgcagtgctgtgtccaagtgatccttattttagttaatgatggccccaaagcacaagagtattgatgctggcaatttgggttaagccaaagagaagtgatatggcttcctttaagtgaaaaggtgaaagttctctacttaataaggaaagaaaaaagatcatacactgaggttaacatatcgtatgctgagaaatatggtaagaatggatcttctgtccctgcaattgtaaagaaggaaaaatgtttgtgcataggatatatagggtttaatactatccaggacttcaagtatccactgggggtcttggaatgtacgcccaccagataagggggactactgtaattgattatagctggctctgatgtatattatcctgtatacctgccttttgaaacaaaagagaaaaaaatctgtttattcttggatttaattctggcggttgattttttttttaatgcaaaagcttcaaaaatcatagtaactaagtacttgaggaaaatatacactctatgttatcttttgtgctttagtactatcattaaatgttgctggagatataggacatgttgaactcaattcttaacaggtaaacaaaagtggattttcaatactgttatgaaaatgaatatgattttttagctgtgtattcacacctcatcttcatgggtcacatgtggcctatggtactatttaacctccatcttttttcctatttgtaaacttcccatatagcttttctgaataatatataatttaatgattataagaaatatttattgatagtatgttttgcttgaggcagcaggccaaagactttacatcctatatctttatttatttaatcatgacaatcccataagataggtgctattgttataggcatagttctctgactccagagccctagtttgtaattattacactaggactgcctctaggagaacaaaagatacatcagtgtgcaaatttccaaatgattaatgttcattcttgtttaggtagggtgctaaagaagaacatacagttcttgggagccctcttccctacaaaattccccacatgggttttaaaagtcagaatttgaaaggaggtaaactaatatcaaatgtgtttatggatggtctctcttaaaacaatatttatttactatgtttacacatgtttcttattagtgtactgatacggtctcactctatgtccccacccaaatctcatcttgaattgtagttcccataatccccacttgtcgtgggagggacccagtgggaggtaattgaatcatgggggcggtcacccccttgctgttcacgtgatagtgaggtctcaagagatctgatggttttataaggggcttttccacgtttgtttggcacttctctctcctgctgccatgtgaagaaggacgtgtttgcttccccttcagctgtgattgtaagttttctgacgccttcccagccatgcggaatggtgggtcatttaaacctcttttctttataaattacccgttcttgggtatttcttcacagcagcatgagaatggagtaatacatgtatcttcaaaggtagctgattgatgactgttctctgctagttaccaaggtcacatgtatactatttgcaagggtaagccatgtattctataggcccctatgattgttgtcattagctgttcttaatcatgattgctgtttcagaggagagaaatccattaatatgattttttctttgaacattatcactcaggtctatatatcaccaatgtcttacaaattttttttttaattttttttttttttttttttttttttaagacagaatctcactctgtagcccaggctggagtgcgtggcacagtctcggctcactgcagcctctgcctcccaggtcctagtgattctcctgcctcagcctccagagtagctgggattacaggcacgtaccaccacgcccagctagttttttttgttgttgttttttgtttttgtatttttagcagagacagggttttgccatgttggccaggctggtctcaaactcctgaccacagatgatccacccaccttgggctcccaaagcgctgggattacaggtgtgagccaccacacccggcctcaaatgggtttatttttaacatatgtgataacatagcccagtgggtattctaaaacgtagtttaaatgttgtaaaaatgataatttaattagtcactggcaagtagataatattcttaaatagagagcaactaaaattcacacttttttgtagttattctttctgtaaaattattaataattaggcaatatattagagagattgttttcactgttatatttcaaaagtagtatttcaaatcattgcataaagtaactgaagaacaatttaaatgccactttaaaatttttttccattttatccatttctatacatttagattatcttgacaatggtattcatggttgtaaaaaaggaaaagctgatggaaaaagttgaatatagaaattatgtgggaagtaaagaaatcttcctttttattcatacttttcgcataaaagggatttagcaagtaaaaagggcatttggggtttggtttggttttgttcttttagccctaggagataaaatacaaaactcattggcaaggttttagattaaataaaagacagtatttacatactttatgtcacccactcaaaaatgggtattttcttttgattttgctttagttaaggaaagagcgattagtgtgaaaaaaaatgtatggtggagaaaaaattttgcaaaggaaatctttcttaagttgcaatgtgactatgcacagcagtttgagcagcacaacatgtaattttgttctagtaaacatatctcttacctacttgtagctgctttaactcacaaacacctgtcagaaactgagttcttccttaattttcagtgataggtgtctctacgttgaagaaaatggttcctatttctttctgcagttgtgcaaagatgaggctgctgtagcacctgggctttcatattgcaagggagcctaaatagtggcaatatttgaaaggcggaaagggaggaatatgtatagatctcttccaaagccctttccgtagtccttttgataatgaaaaagagtaaagatctaagaatctaaatgctatatgaatgccttatgctcttctatttttcagaggcgttaccaacaaccattttcactgacttgtgtctgaggtaaaagaacagctacataaagaacaagtaatatgatattcatgttagcttctatccccctgatttgtgtactctctagagaaacaatttgtatgcttttgaagggaagaattttaggatgatatttcccaaagccttagctttttttaaaaaaaaaaaagacaaaatagacttctatgattagtagaggaattggtggaagaagggattgggagatctagtgctcattagggcttcacaaatactccaggtcttcaccttccagacacgtaagaggatttcacctttctcccccctctgattacatgacttgccttgatcaaggcaaatgtgaataaaattggcatgtgccatatctaggtggaaatatttaatattcaatgagatgcactgaaaggagctcctttctttctttctttctttcttttttttttttttttttttgagacggtttcttgctctgtcacccaggctggagtacagtggcccaatcttggctcactgcaacttgtgcctcctgggtgcaagagattctcctgcctcagactcctgagtagctgggattacaggcatgcaccaccacacccggctaatttttgtatttttagaagagagggagtttcaccatgttggtcaggctggtcttgaacccctgacctcgcgatctgcccgccttggcctcacaaaattctgggattacaggcatgagccaccactctcagccaaaaggagctctcttttcagttgcaattgtggaagcctgtgtctagctggagcccttgtcatttggattccctgaatgaccaggataaaacaagcatccttgataacactgcagacttgtagtttgagtgagaaataatccactgagatttaaggactgtttgatactgtagcctaaaataacccattctgatgtttacaaaaagtcatccctagaaatggggcgctgccataacggaaagctgaaatttgtgtattaagggatgggcagcaaatggcaaggaaattgatgctggaaactggaaagatggtaatctgagtattactgagtattatagtggcaagtgttatagtatttgagtattatagtggcaaagcagttggtaaaaactgtggtctgtgatgacttggaagctccaggagaagttggaaagcaaaatgttcatagtgtgttgctgtgtgtatctgtgtacagcagttgtgtactctgttccatcctggaacataaaatcctatggaaatccataggattaaattttatgttttctcttttggatgtgcaatgttgtatattttttaaagtactttctctaccagtgtaatggtgtggatggggtatctcttaatcataattatcttaattcttaactgggaagcaaatgtagcagctgatatttttcctgctttgaatatcatagttattaaagtttaacaaaaggaacttagttgtttacctctgaccagagaagagttaatcaacaaatgattattatcttaatatacattaaatatggtatggagagtaacataataatcataaaaatacaataaggtaataaaaagacctaagaatcaggggaaatgtcaggcagaagagttttggtaatagtattagtaactagtagtttgacgtcctctacagagcaactcatttgccattattaagtgaaagtgaattattatttgttttatgagccatggttcaaaactaagggatgtggagagtgcaggtgagggttcatctgagacaagttgagacctgtgacagtccccattgatgagcagtctctttctgggattaggctgctaccattgcccagatccagcgtgaattcccctcagcactgctggttacatagtgccagctcttgttttcaaaatatcttttttcttcatttcccctgctgtccagagctccctttgtgtgtgccttctttctttagaataagggataaatgcattaaatatattgacggttgaaatgctttgatgtttgtttttgcaccaaggaagttttctgacaaactagaggtagaatctataggcaggtgtcacaggtcagatgagtcagtctctgaattagttctcacaaaagttaaataaaacctgattataatggctgggcatatgagtgactcgtattccagaaaccaaagaggaaccaatgtctctatgtgtaagctggacaaagctttgctattaagtcagagaaaaatacatgcttaccttatttatatatttgttcatattgatatctttcaattgtgttagtccttctgggaatgtaatatggaacaagaaacatacaccctgatgaacagagttgcaacaattgcttaaaaatactagcaaaccaggctggggtgcggtggctcatgcctgtaatcccagcactttgggaggacgaggtgggcagatctcttgagttcaggagttcgagactagactgaccaacatggtgaaaccccatctctactaaaaatacaaaaattggctggacgtggtggcacatgcctgtaatcccatctactcaggaggctgaggcaggagaattgcttgaacctgggaggcagaggttgcagtgagccgagattgcaccacttcactccagcctgggtgacagagtaaggctccgtcaaaaaaaacaaaaaacaaaaaactagcaaaccaacttcaacagcacattaaaaagatcatgcaccatgaccaagtgggatttatctctgggatataagggtgattcaacatctgtaaatcaatcaatgtaattataccacattagagtaacagaatgaataaaaaccacagttatcccaatagtacagaaaaagcatttgacaaaagtcaacatcttttcatgataaaaactctacaaacttggtatagaaggaatgtaccctcaacacgataaaggtcatacatgaaaagcccacagctaacatcatactcagtggtaaaacccgaaagcttctcctctgaacatgccaaggttgctcactctcccccacttcttttcaacatagtactagaagtcttagagcaattaggcaagaaaagggaaacaaacaagtccaaattgttgcacccagacatagaaagacatttaacctatcagacatatgagacatattacctatcagtcattacctctgtagtgaagtctccttataatctccttataattctattctagggcaactatcattcagtgcttcctgtattcctggtactgggcttttcacattcgttgtttcctttaatccacactgccactcttcatggtaattatcattattagctgtattttaaagacaaaaatctgctgtttaagttgcatagctagtgaacctgggaatccagtgtgggcagagcttgcacagtactgcactgtatggcgacagttattctaagattttaagatatttaacatatttaaaaatgattaatcatattttcaacaaatgtatttactataaccctttctttctccttgcaaatgaatttgggttatgtaaaggaagacaaaatatccaggaaacccttggagtttatctacttatgttctattacccttttattattgacaaagaaattgaaacaaaaataagttacttgtctaagcacaaaattaatgtttctgtggcagtgagcacccaggactactgattcctggtctagcagacttttgactatttcacattaactccctatattctttgttgttgttgtttgtatgaaagagtcaataaaattgaaactaaaagaatttgctgatgattagatatattgagataacaactcttttaagtcagtagtaacaatcagaacattctgtgtagtttaacttgatataattgtatatcattttctctcaattatggaggttaagcaagaaaaagatgtacagtatatagttcaatttgccagtaaaacatgatgtattaccagaaacttcacttaatttcacatataaaaagccagttgctgttatttttattttgtttatcttcagggttttcaggggcttaatttctttaaaacatatttgcaaggttgaaattaaatactatagttgatgtcctaaatgttggctatattaagcacaacaaaagcccagcattttattggggacactagaagtaataagatactacacattatagctactcaaataataactgtactccttggaaaataatgagttcattgttcctgccaaaagcatctactagggagataacattccagcattggttgcaagaacagttggtatctaaagttctttgcattctaaaataatataattctgggtagtctatttccttgtctaaggtcatctatgtgttcagacaaacatgaagtcttcagtataatgattaaaacaactcaaagtaacatcctaagaaaatgttaaattagttttagcatgctcattccatagaacacaatctagccactatcttttcactatctttggaaagatatttaatgacatgggaggtggagaaaaaaagatactaatgtaggtatctttagaaaacagtgtgttgactgggaattttaagaattaatatgaagggaactagacatgcacaactgtattctagttggtagagttatttctcatggggttaccagttaacaactctgagcttgctttacatgtttgctagaattgattgatgagtaaatgaatggtagatgacagaatccagatttctcactgtcaaagactgaagttaacagagaagcaaggggttggggacaaactataatcaacaatgtggtactggattagagacagagacatcagtatgaattcatgtttagcttaatacatagaaagatggatagttacaaggataattttagctatgtttgtatatagctcattctaacatagaaagatggatagttacagggataattgtagctatgtttgtatatagctcactctatctgctgagagagcttagatagaataatacctcagtggtaataagcacaccccctacccagatcttggtctctgacatcattctccaataaaaggaaccagggctctttggagaaatgactgattctaaatctggggtagagaatatagaagatgatcctgcagcatcgtgtcatgccagaaagtaaggaagtgttcaaaaaacagaatgatggagcatttcaaagggatgcaagagtcaacccaaaagaagtctcaatggccaaagctagagaaatttggtcaacaaaatgaattacatagtattagattataacccaaactatcaagtactcatgagttcatacttagataaaaatgattaaataaataagtaaattggaaagaagagacaaatctcctgtacagaagaatttacataatttatgtagatattcctgtcctcaagatggtgaagcttaactccccaccccttgagtatgaactgaactttgtgacttgcttccaaagaatagactgtggaaagtggcggaaagtagctttacagtagagaaatctgacaaacattaccttgaccttgtgatgaaacttaaagttatcagtgataagtcatgttgatagaatgtaggttatacatctgtaccataaaaatgctgtaccattataaatattttatatctatttgggcccaatttttaaaatactgtatcctagttagaatagaaagataaaagagaaggccatctaagggggcttctcccaaattattcattaatgttcagttgtttatagcagaagattttgttgttgcctacttatgcataaacctcaaggctgtagcaaccactctcttatagccagtgtgtgtgccctagcataagcttctaactatggactatttctttactgatatcattcagtatagggataaatcaaatgtgcaaaaagttagaataaatttgtgatctgtagttgatcatgtcttcctcatgagcatccacctagctgctataatgtgggatataggggttcatcacaaaattttaaattagtaattaatgatatctgtgaaacttttgtctaaatggtatctttcagagaactcagtcttatttggttaagtctattttgaataaatgtttagttttttagatctccctctttcttttttttttgagacagagtctcactctgtcaaccaggctggagtacagtggcatgatcgcggctcactgcaacctccatctcccaggctcaagcaattctcctacctcagcctcccgagtagctgcgattacaggcatgtgccaccacgcccagctaatttttgtatttttagtagagacgggatttcaccatgttggccaggctggtctcgaactcctgacctcaggtaatccgcccgccttagcctcccaaagtgttgggattacaggtgtgagccaccatgcctggctgatctccctctttcactccatcttcttgacttctttaccttactttataatgatggaggaggggaagtctgtgtatctttgatggtctcaactgttcatttagccttactcatggacagtgatggttgaagtccagcttcctgtttgatcttttaattcctagccttgtgtctctggtcatgaattccactcacctacccctcccttcaggtccccacagtccagggacttagtcttggactgctgggacctaaagggtctttgaatccaggcctttgcagtcttctcatcacctttgcatcctcttagtgaatgcaggaacttctgggtcatctgcaggactttgtggcattggcagagagaaaaggagggcatccagagctttctcagtctcctgtgcctacctatatccatttacaaatgccctagactgtgataatcattcttttataggaaagacctgccatctcccttgggctacagtcagagaagccctgatgcaccttgagtgccttcatgtgaatcttgtcacttctacatatcaccactccctccttaaagtagatgctggtggtataggggaataagatccttgctgtctggctttctcactcttctatccctcttttgctgcctctaggtggaagggaagatttcctccattttcatgggcaggagtttcttttacattgtgtccatcctgcctattctctccacctctgtggtcaggtcagtcaggcctcttgatatagtagctctgagatgttagaaattaggaactaccaaggaataatgtattggcttaatagttccaaaacagaatccccattacatctctatagcaagtagtgctataatgccacaaactaggctttctagcaatataaatctttccagaatgctacattctctaaatcacatgttttggtggttatagatccaggaaggtgttgaaactatttaatagtaagtgtgaaccctgataaaaaagtcataaaccaagaattcaaaaacttttcctttttttttttttttagtgctagtcttcttcttttaacttttattttaagttgaggggtacaagtgcaggtttgttacataggtaaatttgtgtcatggggtttgttgtacagattatttcagtcacctaggtattaagcctagtatccattagttgtttttcctgatctctccctcttcctaccctccaccctgcaaaatgccccagtgtgtgaacacatagatgaatagaagggaaagattttttttttttaacctttcttttcagtcctcagttcttgggccattccatatgaatttctttacacgaagttctcctttttcagcattatcatcccagtgtttctgtagatgacttgagcctttcccccataccagaccttactcaaccccccagaccttactcaacccccataccagaccttctcccttcatggtggcttctacctagatcatcatttggaactagatccctcagtttgtatgactatttgatggagtctctttcttacccccaaagtagaaatttacttattttgtacacatggtttcaaaacaaaggctattaagagtgttctgcttttctccaaattggcacttcctttgctcctaagaataggctgctcacattttaaaccaaagcaccctcttctatataaactatgagtttttccaagttttagggtcctgtttcctgctattcagattggagtttcacctcagttaactaactcagccaaccagagcttatacaggctgacttgtgaggtcctaaagcaaaccaatgcaaaaaacagaaattcaggtcaatgataagcaaaaataccaaagctgccaagagaagcttctgaaaagtataattgtttgcctcgttctgccaattggcttggcccttccagaagataaagaatttctgggatgtgatccatcatcctggctgtcaatctactgcgcttccatattttattaactctgtgtgggcttttactgtactctccttttttggtaaacattcttccccaccatgtcctagcccttatagcttcccttctaatatgaagaaaagacctttaacttcattctcatcccatgtttacctgtctctgccttgattctcttacacacacccacacacacacatgcacaacctcatatatgcacacacccaagcatgcacatacaaacatatattggattgattataagccttgattcactacagttttagtattagcccatgcaagaccatcttttatctatacatctttgtatcaatattaggcgttagagattttatttgttaatctgcccaagaacccaaaatatacaagttctttaaattagacctttttgtcccatctatacttaatctgcagattcattgatgactcttctctacatccttcatctgtgccaactctagcacaaaggggaaccagggatgagtaatgattttttttttttagtttttctttgctttctttgtcttcttcttctccttctcctccttctcctccttctcttcctcctcctcctcctccttcatgttaatataaaaggaaattacctttggcaaaatgccaagtattggaaagcatgtgaagcaggatgtgaaagtcactgggagcttattttttgtctctgaaactctatcgccatgtaagtgtggtcccccaatcgcttgatctgtaaagcaggttttgcttttgaatacccttttagtaaataaactaccccagaggcaatgagattttgctataagaaatcagtgagtgcaggtgtcattgtatggtaaactggtaatttaaaaaaatcaccataattttgctctccccaagcccattcatttcagtcttcctcagctctcttcccaacctccccaaagccgcgtctggaaagcctggggtagagagaccacagtaactccaggcttctatgcagcatctgcccttttccccttccataaggaatgagaatgctgagctcagtgcctgtagatatgcatgatttattcatacttgcagtcttgatgagaatcactgaatgctgcattttcttgatacagtatttttatgtgtcttcatgttagagtggcaatttggggtaaagaaaggaacaaagactatatgtcaaagaaaaatacttagtatactttattcagttgagaaagaacatacaacttttaggtttcccctcacacttctaaaatatagttggctgggattctcttgtaatataccatgaagtaacatagtgcttaatgaaatgaaatttgagtatcacagagaggaaatgatgagccaagaaactgccatgaaactacattaaaatgtacttggcatacatctgaattaccgcagttgcattgcaaaaatagtgcagtgatacagtttctggaattaaaagaacagcatgttgccaaggttgaaactatcaaaggcaatttagtatgtttttttctctatgaataaatgaacggatttttttccttttagcataagatgattacatatagaatcatataatctgaattctaatttcacacctacattatatgaagatacttttatcatttttcccattaaacaattttagtatataaacatcttaatcagtgactttaccacagtatattttttaatgtaaaatatggtaatgccaactgcaggtctctgaggttaatgaattggacacttagcatcattgcttcttataaatccgtcctcgctgtagcagattccagttaagctgtccatgattttctgcactatggaagtattatttaacaaatttgtgtccacagtggattaaagttactggactgggtttggagaaggaagggtactaacatctctgagactctctactaagactggtgccttaaatatatactcacacttaacttgtaacagccctgtgagatagatgttacaatcactgttgtatgaggaagaaactcaatttatctgactaacgtcgcaaaaacagttttaaacacccatacacatgttcatttcgccccatcatgcagcttatagactctacatttacatggcgctctaactgtttaataaaataaatagcaaaaattaatacagctcctgaggaaaacattttccccctttgggggaaccaccatgatttcttagagaaccaggcagaattgctaccactatttatttagaaatttttcttcttgcacctgtttcacaatctgttcaggtctcatggccatcttttccatgtaagtggttattgactgagaagtcatctctctggataagaatgggatcactggggcagagataaaggtcaccagaaatgcccttgaaatagcatggtgatagaattaattatttcttttaaataaggtataataaccattagacctctgggttcagtatcatagcttctcatctatcctgaagtagggagagtttacctcatttatatcccaataaactataaatataaatatatatatgtgtgtgtgtgtgtgtgtgtgtacacatataatatacatgttgttatgggctgaatttatatcccccaaattcacatgttgaagtcctaatgcctcagaatgtaactgtatttggaggttgggacttcaaagaggtgataaggtaaaatgaagccattagagtgggccctagtctgatatgactggtgtccgtataagaaggtgaaattaggatacagacacacacagagtgtagattatgtgaagacacagggcaaagacagccatctataagccagggagagaggcctcagaagaagccaaccctgccaacaccttgatttgaggcttctagcccctggaatggagagaaaataaagatctgttgtttaggcatctagtctgtggtactttgttagagcagccctagcaggctcatatacatgtgtaatataaatacaataaaaattggcccaattaatcccaatcgccaaagcaaccaattttttttttaaataaggagtcaagaaatacaagcacaacttcatttcatggattttcacaaaggcaatttctaggacctgcatgcctttggctcaagacatggcttaggattggacttgttatgctttaattcccacatattcactatttgcattacagggtcatagcagtaacttgatttgcaaaaacatgaccctgggaactttattatttgcagtcatgaaagaaaagattcaccctgctttgggagtccaaggcaggcagattgcttgtgctcaggagtttgagaccagcctggacaacatggcaaaaccccatctctacagaaattagccaggcatggtggcatgtacctgtagtcccaactacttgggaggctgaggtgagcagatcacttgagccttggaggttgaggctgaaatcatgccactgcactccagcctaggtgacagagagaccctgtctcaaaaaagattctgtcatatgtagtctattacacttacaaaagcaagaaaatggattatttgattttacttgcaagttggaacaaaatgggttttggggttggctagacagctctttctgcctaatcatgtggtaaggcagaacaaactttactgaaaagaaatctcatacttctatatttgaacaataattttattttatatatgtcgcattttcatagtgctttacaatgtagaaaggtcctttttgagcattgtctctgcttctgtgaagccttcccaggctcctccaatagactcagcaccatgtgatttcaagtccctgtcttacagcattcatggcactgtagttgtttatttcacatgttgatctcctcaagggcagtgactaagcctgtttagatttcttttcccaaggcccaggatagattctgccacacagcatgtggctactaaatgtttgtggagcatcttatgcctttccagaactactatttttatagctgaagaacgtgagatccagaaagtttaattgacaagatgacttagagagagacacaaaacctggaggttaagggtagggtgggtttgggagggagggagtgataggggagagttggcagcagtcagaggttagatcatctcaggtgaaaaaattttgttctaagagagataggaagtgatggacagttttaaatagaagcacaatatgatttcaattacatttttaaagattgttctggctgctgagggaagcaagaagaccaattaggaaagagggcattgcagtcaccccgagagagatcatggtgacttgaactataaaggaaacagaggacatgaaaaaaagtagatagattctagaaatgttttggaaagaaaactttgctgacattttgtatgtgaggggcctaattataaatttgacaaatagtttttacctgttaggtgtcagtgactatttgaggtatcgaacatatgtggaaaaaacagataaagtaccttctgtcaggacctgcagtttacattctggtggagttatacagacctaaataaataaaagatcaccagtcaatcaataaatcccataatggcatatgtcataaagaagataaagcaatgtggtgatctgaagagaccacttcaaattatgagccaggaaaattcccatggatacctaatcagagaactgaatgactggaaggaatgagccatgtgaaggtctaggacaaagcatcccaagtgcagtatatagttaatgcaaaggctctgggtggggatatgcttggcatgttccaagaatagaaaaaaaggccagcatatcctataggaagtgaaaaaggtggagggtcatttgagatatggtcagtccaagaagtagtgggcaagatgtggtgtggagcctgtgggccacacacagggtgtagcagaaacccattgtgaaattttaggcaactttataaaatgattgctctagttgctgtatggagaatggattataggaaggcagtacaataaacagggatctgggcaagacagggatgttggcttggacgaaagtggcagtggtacaggtggagagatgtacatagatttggaacatgtcttatagggaaaatagacatgaggaggaatggaaagaggctatctccaaagatgacttaacttgtggccttgagcatctagtaatagtgccatttagagatggaaaaactggtggaggagcaggttgggagaagaggatcaagatttctctttggacagatgcctgctagccacccaagttatgatgccaaattagttgattatcagagaatgaaatggggagaaatgtttgagcttcaaggtttctggtcccagcaatgaaatgttacatgttagattgagatgcctattaaacatcatgttagagatattaatgaagtgtcctagcttagttaagaccatttttacctcagagtcaccccactatgacctcccattagttgagatgtgatcacagttccacagtagctgccagaggggaacatgtgctcatggggtccaggtaaatgtaccatgctacaggaaaagacacacagcacagcttatgtgcattgcccagggattttggaacaattcacttctagattctctttgccccacttctcacctttctagaaaccatcttttgacttcttctaatctctggaagactttccctctcatttgcctccttgctttgtaaagctgatagagacaatagatatgcttgtatttccaccaattcccctgtttaagatatcctttgggagccataattaatctgtagcatttaacaagtgttagctttaactacattggaagaaaatttgttatagattacatgcatgggctttggggaaaaatgtttctctttattccaataattttaatatagaacttcattaagcacacaaatcagtgggaacatttgcttataaaaataacataaaccaaactaactttgcattttaaaaatcctcttgttcagttttgtgagctctgcagtcacatttctgatgtatatgctaatggtgtgttttctcacacgttatgtaaaagcaacctattatcttcatttcagattcagattcctgagtcaagcccctattatgacctcagtatggtattttttttactgactcgtttaatcagagcatgaactttgtgaaataatactgttttcccagttttatacataaggaaacaggcttagagtggttcgtgacttgctgaatattatgtagtcagtcagtagaggggctgacccctcgatattttctatttcctgcttttgaatggtgatcaaattagcttggtttgaaaatacgtacccaaaagggaactctattttcctctcaattctgcttttccctcttcccctccacctctctctctctgaaatggcaatgtcattcatttaactttgttttccatttttcacctctacatccaatcaggtccttaaaattcttcctttctttcttttcattactgtggaatcagctatttgctatcctccctgccatttccttgttcagattctcaccctctttctcctgaagaacatcaacagccaacttacttatcatcctgcctacatcctttcttcctcttagtaaaggctcttctgttcttcactaaaagacagatcaaaatgtcttaaacacaaattttattttggtacttccctatttacaatcatcaattggctcccctgtgctcttataacttccaaacattttaatagaatctcaaagctgatattatgcgtcttttttcttgggcctttagcttcattccttgtcactttccacctacaattctctttgacattctttgctctagagataatacatttctttaattcctagatggctgaacattgtcacttgcctttggttctttgaatattttatccctcctccctgaagcacttacaatgtgttctttttaaaaattgtgaaataaaacacacatacacacatacacacatgtgttaaaaagatttaaacacaatgtactatataatgagtaattacaaagtgaacccctgtgtatcctctactgccaagaaataaaatgtcatcaacattccagattcctccaattctcttttatattacattcttcttatcccctttcttccactccaaggacttattcaggctttgtggtgatcatttccttgcttttctttatcatttcaccaattgcacatgcattcccaagcaatacagttcaattcttcctctttttgaaataaataaccacactctgtgttttccttttttcactcataataatgtttgtaatgtttatacatgttttagagtgtatctctagtttcgttttcattattgcattgtattacattgtatgaacatagcctttaaaaaaatccattctcctctcgatgggcattttagctatttcccatttttagctattagaaataatgtcttcaggatcattcttgcatacatgtctcttggatgatgggtatccccataactctagaatatgtatattcaggagtaaaggagagatacatattttcaccttcactagataatctctacagctttctggaatatcactttacacccccacaattagtgtatgaaagttatctttgttctacccgtttccttcacctaatgtttatagacttacattttagccaatccggtggttgttcagtaacatctcattatggcttcaatttgtattcccctgattattgtattgaccattaaaaatctttgtttctgaagtgcctgttcaagtttcttgcccatgtttccattggtttatatgtattttcataatagaagagtttttaaatattttctgcatgctaattccttgtcagttgtatatggtgctcatttggtacctggtctttttactcttcttatgggttaaagcataaactttgatgcaaaattgtctgattcaaataatggctctatctcccttaacaatttgaactttggtaagtcattaaacttctccatgcctcttctgtaaaaatgagaatagtagtagtcctacctcacatggttgttgcttaacctatataaagcagtaaaaagagtgcctgaaacctaggaagtattatgtaaataaacatttgctgttctttatttttattttttgatcatgatttcttaattataatatagtcaactttttaaactttagtaacttttagtgttttattaagaacaaaaaggttctaaagttattaagatattctttgtattattttccaagcttactgctttgctttttaagtctacaatccaactggtgttaagtggttgcagcagaagtaaacttttattttttcttatatagataaaccattgtcccacaaccatttatggaaaagtttattttttttccactggtctgcagtgctacctttgccatataatgtacatttatttgtgggtctattttttaattggcctagttactcagtaccaatatcacattctcttaattactgcacatttattattgatatatgttgaagtagttcctgccactttgctctgcttcttcaagagtatcttcataattctttggttctttatttttaactttaagaatttttccatttaactttatgaatcagcatgtcaatttccacaataaaattggaatttcgactacaattttattgagactatagatcaatttgtgaagaattcacattttaagaattatgaaccttccaatctctgaatattgatacatattcctttatttgtgtctttaatgtttctcagtaaacaatatcatgttctcaattacatattcctttatttgtgtcttctttactgtttctcagtaaacaatatgttctcaatagacgtgtttgaaatattactagcacttggtatttttaaatactattgtgagttatagttttttttaatagttttctttcttacttttgtacataagaatccactcaaatttcatatattgattttgtagccagcaagcttattaaattattatactaattttaatgatttatatgcagtttatttttgatcttattaatatcatatctcttgtgaatgacagctttgttttcactgttttcagttcttttatcttttctctctctgtcttgccttattgtggtggttaaaaccacccaaacaacacttgaaatgagaagagttgagttgttacttatttcaataaagtctttattaagtatgatgtttgcagagagttcatagtttacctttatcagcttaatgttgtctccatttctagtttgcttagaattttattatgtatggatgttgaatttcatacaatgattttctgcatctgtggaaataatcatatgatcatatatatttcagttaatatagtaaatcacatttatttattttcttgttttctttttcttaatttttttttgaaactcaagtacacagaattagattaatcataatccttgattcaggaagctgtttcttctctagttcattcatggtcacgtttaattacttggttaactatttccaataatatgttaaatatgtatggcactgacatgcaaaacaatagctacatcactgacaataattgacatttaccttcattccctgcctaccaaagcaaaaatcatccaaaatatttattttcctttaaaaatattttattgtatctttcatttttatttatctttatgaaaaggcatcatagtggcattttcttttccacgtgatattatattgccaaattttatcacattagtgtctttgtctataattcattgattttgactgctgaataaaattctattaggtgaatatatgcaagttattcgttctcattttgaagagcatgtagtatgctttcaagtttttgtgattattaacagtgcatttatgaacattcttgtatgttaatttcctaatattaaaataacctacataatctggtataaacagaatttagtaatcttgcatcttactctccatatattgctagattcaattgccaatatttcttaagagtttttgcctctaggttcatatatgatattggcctctatttttcttttcttgcactatccttgtgtctctatcccgattatgctggcatcataaaatcagttggggattgtatactcttttccttctcaggaagggtttgtataaaaatagttattgatttcttgaatatttggtataactcaatgaaggcatttgggacaagagctttttctatgagaaattttctttattaattattcattttctttagttgttagaggatgatatatagtcatattctatttctgtcttcagtttgttttgatgaattatacctttttcagcatttgtccagttttttctacattttcaaatttattgcatgaagttgttcttaattttctcttagtatctttagagtctgcaggatttgtagtgatggcttttttatcattcattcctaatattggttatgtgtgcttcttttcttcattattattttctatagtttttcaaattaattattcatttaaataaactaatcttggtctttgttgattcattttattgcatgtttctttattttcttaatttctgctcttttttaattctccttatttcctacattttttttgctgtttcttttcattataccttgaagtgaatactgaaataattacttcacaggcatactttctttttcatatatgcatttcagtatctaagtattactttagttacatatcagcattgtttacttatctattatttatttctggcataattaaattgtgttagattatatactgtgtgtaatttcaacattttgaaatttgtcaagacatactttatatctctttatatatcatcactttttgaaaatctcctgatatgtttaaaaatgtgtattctgtattttgggagtacatgttttctatgtatccattaggttatgtttattaactgtgttcaattcatctatatttttaccatttttatgtgtctacttcttttagttactgagagctacatgtaagtgtattaaaaccctcaaatagtaatggagtccattttttcttattatgctaataatttttcttagtattttgaggacatcttaagtggtgcatagaatttgtaagccatcattttttgtcattttgaagtgattctcttcgtactctctctagatatatttttttgactttaaagtctgttttgtctgatattaatatagaaacaccctttttcttttgttgtcatgggtatcattttgcctactcttttactttcaatcatttaggatatttacgttttaaatgtttcctgttaaatgcacagttagatttttagaaacaatctgaaaatcttttttttttttggactgggacatttggcccatgtgcatttaatgtaaacactgatatacttggatttaaatctatcatctaaatttgtattttaatttttaccttttttgatgtttttgattggatcagtgtttttccacacttgcatttatactcccctatcagtataaaagttataaactctgctttaatataagaatttttaaaaatgtatccttaacttattaaagtcttacattcacttattttcccttcttccagtttgctttcttttattttaattcttttcttcatccattaacttgtctctgggatcattttccatcattccttctgcttgaagtaagttctttattattccttaaagtacaggtctgttagttacaaattcccaggtattgtttccttgaaaatgtcttactttaatcttatagtctatagtcattccaaggtagtctgtatttgggaattctaatcttgaagaatattttgctgactatagtattctaacttgaaattcttttttacattaaacatattgaatatacatttcaaagacatcatttcactctcttctggtttccattgtttctgttaaggagatggccgcttagtctgtcctttctctgtagctacttttgacatttactctctgtttttggtctttctcttttataatggcatgcctagatgtgaattttctgaaaattttatttatcattcttgtgatttcttgggattattgaaatagtagattggttttcattcctcagttttagaaatgttttagtttctagcatatatatatatatatagagagagagagagagagagcgccattgtgccattctcttccacttttctatctgaggtgccagttaaatacatattaagccttctttgtgtatgccctattctctgacactctcctttgatttctcccctcttaacattttgtctctccatgctatgctttcaataggttctcctagcctatttctagttagttttcttttcttctcttaaacctgttcttaatttcagccattgttttttacttctagaatttctatttgtgtttttgtcaaagctgccatatcctttaaaaagttttatctccttcttgaaattttaaaactgaatttttatttcttgactttctttcttagaatataataagcgtggttgtttaaatagtttgtctgcaaattctaatatttgaacattttgagtgaatgtttctattggttctcagtgttgatattttgttttcttgcatacccagttatcactggccctataataggcggtttatattttaaaaacactttatagcggtaatttcaggcataagaggatagcttctttttcagagtaggtttttgtttcttttgctagatgctacagattttcgtcaatacaagttcaaggcttgaggcatcatgaacaacccagaatgaagtaataaagctgggatgggagttcacgcaagggccactttattcaaagttcacctgtcataaggatgtagtctttcatgctcccaacttaaagtcaggaaggaattatcagagcccctacccttgtggataattcagctttcattttgaatcatgagcggttcaaggttgctaaaatcagagttagcaggtcccttccaagcagaactaggcttccttgcaaggccagtaatacctcactaccttgttagctctttgatgcttttaaagaatattctttctatatgttttgcaggctttttagtttttcagcaaggggtttgatctgtttcctagttccccattacttgaagcagaagtttcaagatacatctgattaaaacagtcacgtttcatctgcttagtttttcttattctttgagatgtgacagacgtcatttcttcagtaaaggcttctgaagcccccggacgttgttcgaataggttttttttttaccttcatagaatataattctttccattacagcacatattctacattgtaatttacacttgtttatataccccccattagtctgcaagctcctttaaaacagggactataggccaggcatggtggctcacgcctgtaatcctagcactctgagaagccgaggcaggcagatcacttgatctcagttcaagaccagcttggccaacatggtgaaacaccatctctaataaaaatacaaaaattttctgggcatggtggcatgcacctgtaatccccgctacttgggaggctgagtcaggagaattggttgaacccagaaggtggaggttgatgtgagccgagatcccaccaccgcactcccgcctgggagacagagtgagaccctgtctcaattaaaaaaaaaacaaaactgggactatagctatttttgattgtttaatcatcattatctgatataattcatggcatataataggtattagatacatatctgttgaataaatgaatgaatgccctattacatcagggcacagatgaaatagtatcagttgaaaataagttaatgcatttgcattatgcatgtagagaaatattatttttgtatgcattgagaatatactcaataaaacagttatatctgcagacatttattcagcactgctgtgtgaagagttttaggacactaaaactcattaatagaatcatgagaaaaaagagccatgaaagtaattctttcttacatatcatcatggctttgacttcaccattgaaatgattaaattctcacatctcttaaaaactgtgaggaaattacagataagaagtgtctgtgtgttttgcaacaaaacaacaaaacatttattagaaaagttaaaagagttgagcataggaaagagggtgaagcattacttaatgaaccagtttcgtgtgaagtatctttacaaatattgtaagtacataaggagaagagctttcaaactgatttttgtatgttaaatgttggtttagttgtacataatagtaaactctcagtaaaactttatggaagggaaaatagaaggaaggagggaggggagaaccaggctactaatgtgtttcatttttactaaatcgagggattttatacatatatcgctatgaaaaaactcaacctacctgggcacagtgatgtgtgcctgtagtcccagctacttgggagggtgaggcgtgaggcaggaggatggcttgaaaccaggagttcaagactgttgtgtgcaattatcgtgcttgtgaatagccactacactccagcctagggaacataacaagaccctgtctctaaacaacaacaacaacaacaacaacaaaactcaacccagttgcaactcccttcttaacgggaattcttatagcatgtaaagacaaaggtatttttcttttacccatctgtggagttcaaagaaccagttcaatgctggattcaactaacaaactcaaatggtttcaactagttgattaaaaatttttatcaacttatcttttaagacaaatgcactcaattgatcatggtataccacatgtgatcttttcttcttcttttcttcattatcttttgtgcttgatactgtatttctttgaattctgcctgaagttgctttagattattgtgacaatcatggcacattgtgcatttaaattgagcttattgtcagaaatatctgcattaatataggtttctccatttttcaatcccagtgtagggttttaaatttgcctttgttaaatatatttccttatttattctaggttcagagtataatttctagcttgtcacaatccgctttgtgattttgtctttcacggtattatgtttctcaactttttattagtcacaaatttcataagcgtatcttctcagtgtgtattcaaataatgggtgaaaatgttgaacagaacaagatcgaacacagatctggcaacttattagttctcccagcaagtatacagcataactcttactatttgttactttttgggaatggtaattcaacaagctacaactgtacctgtggcattaaggattgttctatcagaaaattttatcaaatacactgaaattaagatgttcctgtcacaatattcctcttatttatcaagattaaaccttttagcagcacagaaattgttatttttgtatgcctttctcttcttaaacccatgttggttcttagcgatctcaatattcattcaaaatagtccaaatttgttcagtattcagttatagaaactttctaatgagaggtatcaaatttaccagaatattgttttcagaagtatacaatggaaattaggacatttgatgcttttcacgcctgtagcatcttttctatcaacagttgtcaatggtaccagtatgacaatttatatgccagatatttaatatcacaaaatatagtcatatgcccacatgcacacatacacatgctctcatacactaaagagtgttataaaaaaaagatagttgctattttcctctttatctttataagtggctgagatactacctcatatgacttttttttaaatttcagttgtaaagatcatttttgatatataccaaataaatactggtaatttctgctttccatttgataaagtaacatattctattatttaataacttacagaaatgacttttgaatagaaaatgcatgcagatgaaaaaagatcagatgaaattaaaaggtatttgggtaaaagtgactgccctgctatattagcattccatttaactgagagtgacagaaacctatcagcaacagtgacctttaaaaagttcagaattgagccatgtattctgctgcatgatttatagattcccaacctccttatattttgctgcactgctatctttgccattctaatttatgggtcacagtagatgcttgaaatccagtttgaatcttcacattccaggttgtaggaagaaggaaggtgattatgaaaggaacatgtctctttctccttttaaggccatttcccaagagttgcacatatgactttcatttataccctgttggctcaaatctagtcacatgcctgcccttggtgtgactgccacacacttattgaataatcaagtgttctgttctaaggaagaagagggaacagatattgcaacaattggtggtctttgctatcctctccttatctcccagttacccacgacttcttcccagaaactgtggctaatttcttttgtatcacttaagaaatcggtatgtatatgtttgtgtgtgtatgtatttatagacatatgtttatgttaatgcttttttatttcttgtatataaatatgggagtatatcatagagactgttttgcacaacccttttcatttaatgatatattttggagacctttccacattttatagaaaaaaacataatttattaagccacttccctattaataccaatttaagttgttttcagatgtttgcagtgaatatcaatttacatatattatttcacagttgaatgaagctatatgtatgttcctagaaatttagctcttgggccaaagggatatgcatttttaattttgataggtgttgacaaattgcttttctaagttgtaccaaatctccccactattgaatcatgcattggattagagtcttcccttgttatccgtgtgaattggtttcagagcccttgtggataccaaaatccatgaatgatcaagtcccttgtataaaatgccctagtatttgcatataacccatgcacatcctcccttacactctgaatcatctctagattatgtataacatctaatacaatgtaaaacacaatataagcagttgttatactttattggttttttagatgtactattttttattgtgttttttttttatgctttttttccaaatatttttgatctgatgttaattgtatccacagatgtggagcctgcacataagaagggctgaccatatctgataatttgggctttgtcagacacttttaccaaaacagtataatatcaaaatttttaatccttgtctttgatagattaaaaagacatagtgattccttgttgttttaatttgtatttttcttactttgaatgagattgataattttcttattatttggtgatagtggacaattttttgccacgcagaaatattttatttttacgtgatcaaatctatcaacctttctgttgatgacttcgagaatttgttattattagagcgctctcctactccaagattatgaaaaacattttctctttggtttcttttggtagttttgtgcctttatttttgtgtgttgaggcctctgatccatctggaatttgtcatatgttatgagataagaaacatgccatgatattttaaagctggcaaaacagtagtcccacaacaatttgttgaatgattcatcttcccccacagttttgatatatcattggcattatatactaatctctggacttcctagtcttctctatagatccatttttaaaaatctttctatgcatactaaattgttttaatcagtggaactttataaaatattttaacatgtggaggaatggtccccatttattttttctttttcggaatttgcttggctattcttctctttcctgtttaaatttgagaataagtttatgttacttacaaaataaggttgacgtggctctgtttcttccttcttgctctgcatggagttcagaaatctctttgtgaatatttaacattctcctcaagtctcatcatgttttccagtcaactcccagataatttgtcttttttttttttacttttattttagattcaagggtacatgtgcaggtttgttatataggtaaactcatgtcatgggggtttgttgtacagattttttcatcacccaggtattaagcctagtacccaatagttattttttttctactccacatcctcctcctaccctccaccctcaagtagaccccagtgtcttgttcccttctttgtgttcatgagttcttatcatttagctctcacttgtaagtgagaacatgtggtattgggttttctgttcctgagttagtttgctaaggataatggactccagctccatcgtcatccctgcaaaggacatgatctcattctttttttatggctacatagtattccatggcgtatatgtgccacattttctttattcaatctgtcattgatgggcatttaggttgattccatgcctttgccattgtgaatagtgctgcagttaacatttgtgtgtatgtgtctttatgatagaatgaattatattctatctatatatattatattatatctatatgtatagatatccatacatattatatatgtatatagatatctatacatatagatatattctatctatatattatagtctatctatatattatattctatattctgtattatatatatgggattgctgggtcaaatggtagtttcatttttagctctttgaggaatcaccatactgctttccataatggttgaactaatttacactcccaccaacagtgtataagtgttcccttttttgtgcaacctcgtgagcacgtgttgtttactttttattaacagccattctgacttgtgtggtatctcactgtggttttgatgtgcatttctctaatgatcactgatattgagcattttttcatatccttgttggccacatgtatgtcttcttttgaaaaatgtctgttcatgtcctttgcccacttcttaatggggttgtttgtttttctcttgtaaatttgtttaagttccttatagatgctagatattatacctttgtcaaatgcctagttcacagatatttcctcctgttctgtaggttgcctgtttactgatctttgatttttgaatctctcttgtatttatttgtatgttaccttttcaatgatagcattatcagatttaggtcagaatagaactaatgtctttatagaatatctagaaatgggtcaataggtcattatcttgtatactttaacaacagactcaattagaaagctatacctgagagtttacacactcctgaaaatgtaaaaattagattaaatactaattttaaataaataataactaaagtataaatgcattcaaaccagttatccttttttaaaatttaattgacaagtaataattatatatatttatgaggtacaatgtggtgctatgatacacacacgtatatcatagaatcattaaatcaggcaaattaacatatctattatttcacacacttatttctttgtgatgatacacttaaaactccttcagcaaattctgaaatataaaatacgttattattaactatagtcactgtgctgtgccattctgatcgctaaaacttattcctcctaactgaaactttgaaccttttgactgacatcttctctttccccatccaccccccaccctcccacctctggcaacaatcttctactctctacttctatacattcaactttttaagattccacacataagtgagtgagaccatgcagtacttgtctttctgcgcctgacttatttcacttagcataatgttctccagattcatccatgttgtcaagtgacagaatttctttcatttttaaggctgaatagtattctgctgtatgtatatacatttcctttatcctttcatccatcgatgggcacttaggttgatttcatatcttagctattgtgaataatgctacagtaaacatgggagtgacatatacctttgacatactaatttcaatactcttgtatatatatccagacttggaattgctggatcacgtggtaattatatttttagtgttttgaggaactttcacatggtttttcaaaatggctgcactaatttgcattcccaccaacagtgtccaagggctcccttttctctacatcttcaccaacacttatcttttgtcttcttgataatagctattctaacaggtgtgaggtgatgtctcactgcggttttaatttgcatttccctgatggttagtgattttgagcattttttttgtctatctgttggccatttgtatgtattttctccacccataatccaataatttttattctagcaacacaaaacaattcaacattaggcaaactaatgtgtttgtcttttttggataaatgtctgttcaggtcctttgcccatttttaatcagatttttttttcttaatattgaatagtttgagttctttatatactttagacattaaccccttatcaaatatattgatttcaaatatattcttccattacacagattgttttttaattctgttgattatttccttggctatgcagtaggcttttcatttgatgtcatctcatttgtctattttgtctttaggcaactggtgatcgtatacaaaaaatcattgcccagaccaatgtcatggatcttttcctcagtgttttcttctaattattttatagtttcaggtcttaggtttaagtctttaactcactctgtgttgacttttgtatatgaggtgagataagggtccaattttattcttctgtattttggtatcagtttcctcagcaccacttatgaagatactgcatttccttattgtatgttcttgtcttctttgtcaaaaatcaattgactataaattggttggcttattcctaggctgtctgttctgttccattggttggtgtgtctattttatgttagtatcatgctattttgattattataaccttgtaatatattttgaaatcaggtagtgtgatacctctagctttgttcttttggatcaagactgctttgactattcagagtcttttgtgattccatacacattttagagtttttagagtttttttttctctttctgtgaagaatgccattggaattatagtagcaattgccttgactctgtagattgttttgggtggtatagaaattataactatgttaattattccaatccatgaacactggatatctttccatttatttgtcttttcttcagtttctttcatcaatattttatagttttcaacatacagatttttcaccttcctggttaaatgtacttctaagcattttaatttttgatgctattgtaaatgggattgttttttaaaatatttttcaaatagtttgtttttagcatgcagaaatgttactaatgtttatattgattttatgtcctgcaacttaactgaattatttatcagttctaacgtttttttttttgttggagtctttagtattttctatatataagatcaagtcatcaacagaaagaatttcacttcttcctttcctatttggataccttttatttctttcaatttacttatttaaggaaaaagcttagggagcaactaacaaaatgctgctgagaactctggatagtatagtaagatgactaaagagagtgcttgtggtggacattagaatgattgttaggaaaaaatcagtcaggaaaacagaactttctataatcccaaattagcctacagttattggttggaaatgaccatttaaaagaaatacattttatatacaatgtacatagcatcaaaataactccgtatgggaattatccaaaacaattattgtatgcaccattttttaaaaactacttttacttgttctaaattaggttagagcattaagaattttaatttgatcagcatctacagactaacaaagagataaataaatatgagaattataagctcagtttctcaagctgagtcatattacattaacattacttacgtatatctaatttttatgaaccatgcataaaggtaggagttttatttttgcaagtacagtaatggacactttactattttgatatatgtttgtaaaagatcttaagaaacatttagttttccctccctagtagaactaaataataagatattctgggttttatttttatgtaatagaataaaataaatttatatgttttcttacaataaatacattaaccacaaggagaattggaagctgccagaataaggtattaatatgtccacaaatgtttatgctcttcttaaagaagactgtttgcttttgccttgaaaaatgtatttttcgctgcttttttccagcattgtaacttaatttgctgcacactgtattttaaaaagccaattcagataagatgtttagtgtcatcatttagacatgccactttctcctgctacaaggaatttaagtgacagcaatatatgttgaacattttctgaaaacacactttttcttttaatatatacacaaactcaattagcgtccaggtcagtcagtggaaaggcatttatagaatcaatcattttgggttaagaagtagacaccctgcaagcttactaatggaatggaaataatgcctggaacctctccaaacagtaacagtctcaatggagcaattaaatatgtatgaagaatgtttgctgagaagttcgaacacatcaacctggggtttatatttgtggtttaatttattcagcaccttccagtgagccgatgcttgatggtctaaaaacattgctgggccctgcatctgttgcatcctgcacagagttttgagtgacagtcactcagaagcagtggttatttttaatcatctcaagaagtacaggcagagaggggagaatgggagtttttgatttgcatttagatacccaacactgcctcattaataaatttggcactcttaagagtatgtcaggcaatcttcagcccatttaatagaaagtattggcataggcaaaactcctatttctgctcacagcagtggtatttaggccttcaaattacagttcacttgtatgattgctgcaatctgtatcttcagatcattacttttctctctcaaaagcgaagtctgtatggtactaactagctgaactttatactattaggaaataatggtgctactgtgttataataccaccgattaaattatggaaaaatttcagggggagatagcaacaggatgagacggcaacattttcttttatgctcaagctttgtttttaaatgccagagaaacaaggatatattttttcttgttttatttttaaatttataattgatacaacaattgtacatatttatggtgtgcaatgttatatttcagtgcatttatacatcatattatgatcaattggagtatttaccatatccatcactttaaacatttatcctttctttgtggtgacaacattcaaaatcttctaagtatcctgaaatatacattacactgttttttgctaaatggcaaacagatgtatgaaaccatgttcagcatcactaatcaccagagcagcgcaaaccttgacctcttaatcggccctttatcatcacctatgccccaaccccatgccagggggcagtatttcacaggaaggaactttcagaggagccaactctgcctggaccagtcgttgaagaggttagtcctggggagagggtgctgtgatagcctggggtctgacactcaccagagggttgggctggcagcagaatgctctctctcccaccgccttgcctgtggaacctcttatgccaggcttgtctggaggaaatgagttctagcttccatgtggggcttgagggcaagggaaaggtagggtttgagatgagaatgaggacttgggttatgctaacagcttccagtttgggtctcaggttctgactcagaagccaagtatgaggatatagcccccagttgggcggggagacaggatcacagggtttgggatgggtggactcctctcaatcgtgtggttcagggaacaaaccctgagcaactagacccagatgggtgaatttctggagaatttgatgctattgccatcactatcagccccaaggcttccattatacccagtcttggggagggtgcaccatttacatagaccaaacatgaatgatgcttcctggagttggctaattgaccgatctgtaccctgaactttccttcctatggcagacattgctcatcaaacacagtttatgttcagtttagataaggactagagtccttctccacatggggctgcagacaagccctgccaattcctcaagatctccagctcaagagtaagcggttggccatcactctctaatgaaccttgatgagcccccaggaaacacagaggcacctccagtagccctggatgatgcagacagcattgaggatgtgacattagcgctggcagatgtggcacatgtgggctagggactgcggtgtgactgctgcccactcctcccgtgagaagtcctccaatgctgcctgcccactgcctcatctccagaatcctggacagtatcagccaccatcagcactgaatgatccaggtgctgagggctgtgttccacagtgcctgatgcaccagggtgccccaacaccaggcttggatcttgatgactgccatatctttgtcagagagcttcttttggttttctgggggttttccaaatttctcattggcattagccactgtttgtgtcttaaccagagccagagttttggcctctgccttcaactttgaggttaatggtcccgaagaaaaatgggccagcatgtccttctgctcaggctcatcttttgtgtgtgtgggtttattcatttttttaggctgcttcctattagttctgttctgcaagttgtacaggaagcatggtgctgacatctgcacagtttctgaagaggcctcaaggaccctttactcatggcagaaggtgaagcggagcaggcatctcacatagcagagcaggagcaagagaggaaataaagatatttaatgtagggaaaggttgggagggttttgtgtgtgtgtgtgtgtttccaggggtttgtattcaaatgtatgtggtatacaactactaatatcttgtcgaagttacatgtttattattctaggctgaggtctgcaggagatagaattagcaaacaactagaatccatacaacgggtaaaattccaaatatggtcaagattttgagagggttccatggataggaagaatcaatatcatgaaaatggatatactctccaaagtaatttatagattcaatgctactgccatccaaactaccattgaaattcttcacagaattagaaaaaactacgttaaatttcatatggaaccaaaaaagagcctgtgtagccaacacaatcctaagcaaaaagaacaaagctggaggcatcacactacctggcttcaaactatactacaaggctatagtaactaaaacaccgtggtactggtaccaaaagaaacatatagatcaatggaactgaacagagacctcagaagtaacactacacatctacaaccatctgatcttcaacaaaccatgtaaaaacaagcaatggggaaaggattctctatttaataaatggtgctgggtaaactggctagccatatgcagaaaacagaaactggacccattccttacaccttatacaaaaattaactcaagatggattaaagacttaattgtaggacttaaaaccataaaaaccctagaagaaaacctaggcaatacgattcaggacatgggcatgggcaaagacttcatgactaaaataccaaaagcaattgcaataaaatccaaaattcacaaatgggatctaattaaactaaagaacttctgcacagcaaatgaaactatcatcagagtgaacagacaacctacagaatgggagaaaatttttgcagtctacccatctgacaaaggttcaatattcagaaactacaaggaacttaaacaaatttacaggaaaaaaataaacccatcaaaaagtgggcaaaggatatgaacagacacttctcaaaagaagacatttatgtggccaacaaacatatgaaaaaagctcagcatcactaatcattagagaaatgcgaatcaaaaccacagtgaaataccagttcgcaccagtcacaatggctattataaaaaagtcaggaaacggtagatactggcgaggctgtggagaaataggaacgcttttacactgctgatgggaatgtaaattagttcaaccattgtggaatacaatgtggcaattcctcaaggatctagaaccagaaataccatttgacccagcaatcccattactgggtatatacccagaggaatataaatcattctactataaagacacatgcacacatatgtttattgcagcagtatttacaatagcaaagacttggaaccaacccaaatgcccatcaatgatagactggataaagaaaatgtggtacatatacaccatggaatactatgcagccatgaaaaggaatgagatcatgtcctttgcagggatgtggatgaagctggaagccatcattctcagcaaactaacgcaggaacagaaaaccaaacactgcatgttcttgctcctaagtgggagttgaacaatgagaacacatggacacagaggggaacaacacacactgaggccagtgtgggcagtgtggggcgaggggagggatagcattaggacaaatagttaatgcatgcggggcttaaaacctggatgacaggttgataggtgcagcaaaccaccatggcacatgtatacctatgtaacaaacctacacgttctgcacttgtatcccggatcttaaagtaaaataaaataaaaataaaaataaagattttgagagggttcttggtcacatgattgctctggtgcacgtcttgactcagcattacatattgtcttgtccaagatgccgtggtgtcatagggttgagggctgatactccagagtgaatgacacctctgatggatgcactacaaagcccagggattcacctttgaattagatttacaacattattaaaggaaaaagctgaagtatcatcataatttaatgggatataaaatgaaaacaggtcttctaaaatggaaacttgaaatcccagggaggcatttaaaatgtggttactgacagatctgtcatgccaatttatgagatgtgaaagcttgttgctttcaaagcctctttcaggacactggtatttaaggcctctaaggccatcggttggatgctttttttatattgatgaaatcctaagggtagcttataagatgatagatttagcttcactgagaactggcatttaatcatctgtgatagtaacatgaggccaagtgtagtatgaccactgccctacgtcactaaggacacattttacagctcattactttatatgtaagatggatttaaaaaaagtatatattggattaatttataacccaaaccacagaataattggaaatatcaaataaccttattagctgacactgaatctaccaacagtcctaactagtctttgagttagtaactctataccctgggtggtcaaagaaaatatttaaagtcatttatttacctctacatatgtcaaacaaaaatttcagaggccacaaagaaataagcaacaaacaaaaacattcagcattagcttcttaaaatgtggattggatcagatcactcttagaaactgttactatcttagtggtaacttcctacccagagatcaccccacccctccttcactactcccttactgcagattccttacttacaggcgaaaaaagaaaaaaattgcgtacttcttagcgtaatgttcaaggctttacagcatctagctcatccttcattgctagccttttttcgtctcttgacatatcagtgcttcaatttatctacagtcttctctcagtttcacaagcttgctgcatgcttcgtctctggtgactctgatcatgctctacccttgcctacaaggcctttctcctttttttccacctattaaactttatccatatccaaagattcagcctgtggccaggcccagtggctcatacctgtaatcccagcactttgggaggccgaggtaggcggatcacttaagtccagagttcgagaccatcctgggcaacaaagcaaaaccccgtcctattaaaaatacaaaaattagccaggtgtggcagcacacacttgttatccctgctgcttaggaggctgaggcaggagaatcgcttgaacttgggaggtggaggttgcagtgagctgagatcacatcgctgcactccaacatgggtcacagagtgagactctgtctcaaaaacaaacaaacaaacaaacaaaaaacaaaaagcaaagattcagcttgaatgccattttttgtgaagtctgctcccaatccctattatgtaatcagggctccatcctcttcatttgcacatcccttggttaagtcttatagaatagttgtctaggatttggctttgatgtttacacaggtttgatttatactgggatggaatccctttatcagttacataacctggagcaccttattgaaccctccaagcttcagttgttttccccacaggactgtgaaaagtatctagcgggatatttttgacacagaggaggcattaaaggggcagtatggacatgtcagtcccactcctgtccaggaaaaatttcactacagaaaaaatgaggataataaagcttctgaagtaaaatttaatggttgtggttattaattatttagcaaagaaaagaagaagaggtcggaaaaagaggaggaacagaaaggagaaagaggagaaaaaaaggaaaaaagcaaccctctaactaagaaatattactgctgtgtgaaacacaaatgtctataaaccaagtgaatttttggactgtggtttaaaatgatatgtttctaacattatctttctactttatgtgtaatcacctgtcaaaacacaggaaaagaataactaattaaacattaatgaatagggggagtgtgtgtgggagggagcacatatttaacctgttagatttattttttaaattatatgatcaaaaattaaaacattatgttactggtccaagaatcaagagacaggataaatactgctaaaattttcaccatatttgaagggatgttcaggatgatgaacttaaaatgttgtcttttatgatttatgcaaagttcagtctatcctaagggaacaccttaaaaggagatcagtaatccactcaaaatcctaaagctgaggtcgacagagggtaagaaaagacccgatatgagcctccccaaattgaaagccacagggcagagatgctgaatttcagttgtgggttataaggagctcccttttcccacagccaaatctagagattagaatccaggattgcttgattgggtccattaactcagcaggtgagctagtgctctctaggttccttgtgtgcttagtttatgccattttcacatcatagtgaagctgacattattgttatccatgctttacacttagaaaatgtgggcatacagagatcatttgttcaaggtgatgcactagtaagtggtaaagccagttataaatccaatgtgacttcagaacttgcataaaagctactgtgctatactgataattcctacacacacacacacacacacacacacacacacacacacacaccttctctctctcaaagaaacattacaaaactgcagagaacatttctatcctcagtagagaaacttggaaaatcatctatttggaaaaaagtgaagtttgatcatcattttttttccccttcacctcatttgaccaaaaaaaaaaaaaaaaacatagaagcaggctaaccaactcaatgacaacaataaccactgtgaagcaaaaaataaaaaataaatatagattacaatggcatatgtgtgaggagttgagaactgtaaaagatttctaagcctaaaaggaaaaatcaccacaagtaaaaagatttatatattgaactacataaaatatatatattcttgacagaaaatagttatcaacaaaattgaaaatgacttacatgctagaaagttgtttttaattagtatgaagaggattaatagtctcagtagatgagaatcaatcaattagaagaacactatgaagtagacagtttacagaaaaatgcatagaaatgacttctaaatatacaaaataaaaacctcattattgataacacaaaatgaaatgaaaactctaagtaccattttcatctatcaaattagcccagatttttaaaaagtttttactagaaaagataaaagtaaacattctcatactctactgctagagtgtaatttgaatcaacctttcaaaaaataaattttataatatggaaaatatccataaaatagtcatacccttgattcagtaattattctgcttctaggggcgagtcttaagaaagtaccagatatatatatatatattttttattatactttaagttttagggtacatgtgcacaatgtgcaggtttgttacatatgtatacatgtgccatgttgatgtgctgcacccattaactcgtcatttagcattaggtatatctcctaaagctatccctcccctctccccccaccccacaacagtacccggagtgtgatgttccccttcctgtgtccatgtattctcattgttcaattcccacctatgagtgagaacatgcggtgtttggttttttgtccttgcgatagtttgctgagaatgatggtttccagtttcatccatgtccctaaaaaggacatgaactgttcatattttatggctgcatagtattccatggtgtatatatgccacattttcttaatccagtctatcgttgttggacatttgggttggttccaagtctttgctattgtgaatagtgccacaataaacatacgtgtgcatgtgtctttatagcagcatgatttataatcctttggatatatacccagtaatgggatggctgggtgaaatggtatttctagttctagatccctgaggaatcaccacactgacttccacaatggttgaactagtttacagtctcaaacaaatttacaagaaaaaaacaaacaaccccatcaaaaagtgggcaaaggatatgaacagacacttctcaaaagaagacatttatgcagccaaaaaacacatgaaaaaatgctcatcatcactggccatcagagaaatgcaaattgaaagtaccagatattaactaggatttataatactgacatataacactgacatatatgacatatagtaactaaatgtctaataacgagtccaagtaagttagataaatttatatcatggaatattacacagctgtgtaagatagcatgtttgaatgatagtgtgtttgatttttcttaaaaatatccacaatgtaagcagttaattgtaaaagcaggatataaacttggacatggtaggatcacaatttggtaacacagacacatgcatacacatatacatgcataggtatagagaaaatacaggaataaaatacagccaaagaataacaaaatactggcaaaaaatcaaccactgcattactggagggataatttcattttccgctatacccttttctgtgtttttctattagcatttaaaaaatattttttaacatggaaaatatgttttggaaaacaatcctcatatttcagaaagagaatgtcattactggacactgatgataactatagtattgttgttcagtgaagcaaattattaataacctgactcagaaagccaatccagaccattcctcatatcctcaagcagattttatattaaattatttatataagtcatttataactcatattactaaaaacactagttaggaacatcatttgtggtcagcatttttgtaaaactttaaattaaaaataaacataaacacatatgtacacactatgtgcatacatatacacatacatacccacagaataaggatatatataaatttatgtatacttaaatttatataaaaattttatatttacacatatgtgcatataaaacaatgtatgtatgttgaaaggaacaagacttttgcctgcttttttattgcattggtcagatatatggaatctcattattatatttaaactacttactattgaatgtggacccaaaatgtcatgttttaaccttttaaatatgaaggaaggaagaaatatgcaatcacatatttcaataaagttaaattccatttcaggtttcatctcattatttataatttgatcagattcacaagatgaaattactcttataaataatacatggatatttcatgtgaattttgatgtagatttatacaatgtggaattttgctgctatagattactatgcattcttgagttttatgatgaaagatatatccagtagtaatataatgcaataggaattgatatgatgtcagaaaccccaaaaagtgtttgcagatgcaattaaaatgtataaaataacatgggctttcatcttacttgatttctgtttctcagaatagcattatttaggataatcaaagaaacgtttgttttaaaaaatcaatacccttgaagcatcatcattatttttaaatatgtgcaattgtttctacaggttattgattttacctgtctcagtatataatgattgtttggttttaagtctttcctaaaagggtttgtaacttggccattatttacacatatatgttctatggttactgccttctcttttcctggtctgtgactgggtccctgctgaccctgacaaatgacttttttattcctcctagttaacccttcttcacataaaggaagaaaggatttatgaaatatctattgcatactagatgtttatttgtatgtgacttgatcgaatcctcaaatagcctatatgctaggtcattggagaacacatcactcaagcaaagaagaaagaggcagagagaaggagaagttgcacacccatgggaagagttttcctcttacggtggtttagaagtagtcctgctgccctgggctcaatattatgtgcttgagcggagccgtaggcatctgcactcctatccatttgctgattcttctcacccttttgacacgttgactctctctctatatataggtgtccactccatttgttgtttgtctttaccattctgttttgggattggagctctgtctcgaatccagatcttgacacaatgtctagtccttttagccatctccagtagaggaaggaccttgcctgtcatatcctcaactacttgctagggttgtgtcttcaaaggactggtagcttgaaacaatagttgctactaatatctgatttcgagtttctcctctacataaaaccttttctcctgaccagaattttcactggtattggggcaaattgccatatagatttcattgtaaatcactacctttggcatcctaaagccaaatcaactactccaacatagatcccacttgacacccatgtctctggtgctgcaccctgaataaaacacattatacaggagacacagcttattttacattttcctctccgaacaaaaatatatcatatgcaataaggaggaaatttatgagaaaatatggtgtttctatttttaaataaagtatatattatgcacatatgtttttggattttgccagaattatttttgacataatctttctgaactcattgctattaagtcataactatgttaattttagtagtattctttagaataatgttaatccagtatatttaaaataaatagattaggaaacctggagattattaatatttattacctttatgagaagacagaacatagtttgaaaattacctttttcataatagagatttaattatcttttcccaaggaatttctttatcttggcttagctttgaattcaactctgtagctaccaaagcattaggtgggcatttatcaacaaaatgcattttttatgtaatttttgatgctagatagtacaaacccctccaaagcataaatgacctccctgttcattctattacattcaaaaatgtttttatatatttttgacattagttcctcttacctcaggtaattactgtctatgtataatgagcagccgtggcctcattgagtaatggctgttctatttctttcaagagtttaaaagacttgtagctcatatggctgattatgaagtttcattcacttatggaaaacattttttcttcttccctcatgacatatggtgtgtattctagagaaatatttttaacattaaagcatcaccaggaaaaaaaagattagagtgttttgacatttctgttatttaaattcttaacagaagaaaaatcaaccttgttaaatgaaagaatctatatttattcaaactcttttgaaaaaataattaaagattggttcaaaacatttgtaattacattttattttggaaagcttttcacaattcaatagtcagggtttcttttaagtcatctcagtggagaatacagctatccttgagaatcacatataaactttacagaattagcaaatgtgtagttgtggctgtgtccagagactgctggaacattgagatgaatattgatgaattcagccagatgttcattaatgttcattttctaatacaggagccattagctacatatagctactgagcacttgaaatttgtctgaattgagatgtgctgtaagcataaagtcaccatggatgtcaagaattcattaagaaaaaatataaaatatcaaattcataattttaaattgattttattgatttgtggcttgtgttgtatttctgcctttgtatacaaaacatttgagtaaaatataaaaatgtacttcacttttcatattagtgttctgttatccctttagcatttcccatgtcattgtttcttactaaactgcataggaggtacagcagctccgctaatggagtgagctctcttggtattgaggtggccagcattatactaaatgttccagctatatagcaacctacaatatgagtccctacaatgtgctgtgtgaattatataaattatctcacatagtcttcaccatactctatgatgtggttattataactgcagttttaagatgaggaaactgaatctcagatgattcaaaaacatgtttaatatgattattacaaagcttactaaagggactgagtcaggattcaaagcaaagtttgtcagtctttatggtctcactgcgcaaatacttttctttctattttaagactttccaggaaattcatgaagatacggacttctttcaaggagttatgttaaattgatctttgggaatgatgatggtcattacgataattgtcggtaaaagttacacaagacttctccaaccttagtaggtaattaagtatgttccacaaggaatagtaagtgatggcattcactgaaataggaactttatctaaatgtttccatgcatccttattgttataatgagtaaataataacagtggccatattaaaaatagaattaccctttttgaattaaaattatgtatttgaattagaaaaaaagcatttgaaacatgtatttttaaaaagcaacaagaactcgttataaaattatttgtaacctggcccacatttagcactactgctatttgatgagttgaagaatgaaggacatcagtttatgtaatgatttttagttaagaaccaatcgtttcttattttaaaaaccgccatgaaaaattttggagatttatatgatatctgagaacatttagaacaccatgtgaaacctcccttgactaggttctgctaattggtttcactggtcagaattggctgtggacattttccctactgctcccaggccaacgtagggaccgatggtacaagaagcgtctttccatgacacttagctcttctgtccagaagacctgccttggccactaaggccattattgccacagatatctgcaggttagtgaaaggtgagaaagcatgttcttcagcaatttgagttaccaccgtatttacactggtaatttttatggtaatgagattgtgtcttacagactcacttgtgattttttgacttgccctctggctaagtggagtctaaacctttcctcatatgctgcctcggccatcaggtgcacaagtacaaagactcctttcatgatgagaagctgtgtgatttcaaatgaaattgtacctaaaggatgctgtaattcatacttacaaagaaaaagtgcttactagtaaataactttccattttctaatatcctctatttttaatccattggtaatatctattattaacctctatggtaaatacaaaaacaaatagaaacatacagtatttattatttggtaatataagggaaaattgctctagtcataaaattattttaaagttggttactttggttatcatttgccccagcatgtacttcagactacatgagtttagaagggaaaaacaaatatctgtttacggatagagattagttttgttttgtcttgtttaaaaccatcctccaccccttcccaccccagctagtttcacagtggaaaaccatgtgcaaatcatagatcctggcagtgagaggagaggcagatgggcataaatcttgagatttaagtatcttaatcagactccacaagtaaaaagagagacaaatttttttagcaagctgcttttaaaatattctattttgtaattgtgagtggcacattgaactttatatagcatgtttcttgtataataatctctattaactgataactatgtcctttacaggacattatccaattatgtcttggatttttaaaatagattttaaaattgtgagtatatacaagttacattaatgcgtattggatctttggtccatcttaaaacatttttttaaaaaaatcaattaaaaaatcaataatgtctataaaacagaaattatttatggagcaatcttataggcacttcacatgattaactcagtaaagaactgaagggtggcttatcgctatctcagatgaagaagctaaggctcagaaaaggtaaatagcttgcttttattattgcttaatcagtaaatagtaaagattcaaacacgactctgcctaactggaaaactaatgttctcacgtgctatctgatttaaaatatcaaactataatgtggaaaatgcaaaacaattctgaaattttggtatttatgaaatcagtagtctggatttttttgcacaatggataaaaagctttttgatattactgaggatttgggctgtcttggtactgctttggcttcaaggtttatattttaaaaaaacttgatgctacagattcttatcaatagtatcgctatggggagaagtcatattaaaaaaataaagcttaaggaaacagtccaatttgaataataggaacatagatggaaggtacgatggtgttgaataatcctgctgttgctattatgacatttcgcttataaagaaaaccacagtaattttcccagtttagtggtaaattgagaagtaggaatctctgagaaaccttcacatgcgcagcattttggatggtgtttggaacaaagcattggagtgaaattcaattaaagcaagccaggaagcccttctgaatgaagttctgaactagcttttcctttacaccctgcaagattcatcttattgtaattctctattgatttgggtatgaattacaagttaatgacttttgttcaaaggtggagaattaccttgtttaatgaaatggaatgtaaacagccaatgtttttgctattaaaaggaaatccatgtggagtttttataaaagaaatacctgtaaggattaatgtaggtgtgaaccagcttctccagagactttcctgaatattttatgcaaaaagtaagtcctgcctttaaaataaggagaaaaaagtgtaaaaggttatgctgactatagtcaataggctaaaattttgatagtaccacaaatttttccatttgtacacacacactatgcggtgtgtatgtacatgtgtgaattccagtgtctagtatatactatactcatacattgtttagttttaggaagctatgtaatataaatatagcaagaaaactttattttcccttggcagaaagtagaaaactgaagagagagttaaaacatgaccaaggatcctgtggttattctggtagaaccagtaaaacagagaagtctgttcattcgtgttgcttccacaaacccacgtgtttgatggaaatgaaagaggttatcttgtccaaactataaaagtataaaagaccttcatactaagatagccaccagagtaaaaaagtttcatgtgatttgctgtcatataattctgtagcagttaaattaatgtgatctaccatgattttcattgcatgaggttcatttacttatttatttatttttgagatggaatctcgctctgcatcctgggttcaagcgattctcctgcctcagcctcctgagtagctgggattacaggtgcgtgccaccacgcccggctaatatttttgtatttttagtagagatggggtttcaccatgttagccaagatggtctccatctcctgacttcgtgatccacccgcctcggcctcccaaagtgctgggattacaggcgtgagccactgcgccccgccgaggttcatttttaatattgctgtcttactaaaatgaagcagttactttaagaatggaaactaagtaagaaaaattctcacaaccagactttgttttaatctgtgctctattttttatgcaataattctttattgaaattgtgctttttataaggctgtgacttttcttttgctatgtcacagacaggcaatgacatttataagttaacactttaaataggctggtgtttgaaatagcattttcactttgaaaagttaataatatcgtgaaataaattctgttgcttttatctataacaaagttttctcagaaatctgcttctctgtggtgtttctttaatgtggtcaaaaaacatatgaaaaaaagctcatcatcactggtcattagagaaatgcaaatcaaaaccacaatgagataccatctcacgccagttagaatggtgatcattaaaaagtcaggaaactacagattctggggagaggatgtggagaaataggaatgcttttacagtgttggtgggagtataaattagttcaaccagtgtggtgattcctcaaggatctagaatcagaaataccatttgacccagcaatcccattactgggtatataccccaaggattataaatcattctaccataaagacacaagcacatgtatatttattgcagcactattcacaatagcaaagacttggaaccaacccaaatgcccatcagtgatagactggttccttacagaattgtttttaaaaaacgaaataacttcttcatttgttattttcatcacctttaaagcaagataatgccacttagataagaggggtaattagccatttgattgatctgccataataatgctacacattctttggacttatttgtcattatgcctctcataagaaaagataatggaagaacagaccactgtgcatggaaaatataaatataaaatatacagtctcttcactttgtaagataaaataatcaagaatacttttagttcataatttatttcagtgaaggtgcatttgtatcctggaggatcatattaatattttcagagcaatagaattgtgtgatgttttacaacagttctactcaattagaatccctgttttatgctttaaaatgttgctatgtcagtttcatggctttctaaagactttagagttctcagtatacctacaaatagcaatgactgtctacatatacaaaagattcagtgaatatggtaaaactataagttgatgagtgtttaggagataacctatttttttctgacaagtttgtttttctgtctatttgatcattgtttttcatctttgttgtttacctggatgatctcccactagctggaaattcaaaagccatttctcagtgagccctctcacttccttgattttataactattactgaagcttcaccctaagacagttacttttccctcaccaagcacaaatgtgaatgtggtgttgtaccttcagaatcccctatcagctatgctagtcccctccatatttgttaccttaactctgtggctctcaggacactggagccagtgtttctgtgaggtgggtatttgtgaaggaatatgtagactggagaaggctactcacagatccctcagataagaagaatgttgatgggaagctcttagggaagggataaggacagcagagatgtcccacctaattgctgcaagggaagtaaaggactgagcaacttttattattttgatagtgtatgtatgtcagaaggatgaaactgctcacagaaccatagaaatctgaaaaaacagatgctttttctaggtaacataaaaccaacagaaaaagaaaaaaatataaagatgtggtttgaatatatgaaaatcataccaaatgtcatcatttatatggatgatcactaaaagaattgaaaataaataataataataactagcatatactacagctttttagcatttactaaagttttaagcattctataaaaattacatctaagcttcacaacaaccttatgaattatgtacagatattataatttgccccaaaagtgacagagctgggattagaaacctagcagtataattccaaaatatgtgctctggggatagtagatgataaagaaacgaatgagaaacaagccaaagaaaataccagctttgaagatgcttgtcaagaagtaaaatactatgacaaaaagaaacgagtgtttaggtggctacttttgcctgggagtttagagaactctctgaggtttaagcggaacactatataacgagaagccagtaaaggaaagagaccaactaatccaaaggctgcacagcagaaaggaggctgttatgatccagaaacaaaggaagggccagagtgaaaatggtaccacatgactttggagaagggaacaaggtgtagatcatgtagtggggctaaggtagggtattcggatttcattctaagtgcaatgacacactactggaagaagtgagtgataggatctggtttaagtttaaaaggtcatttttggctgctctgtggagcatgtatcatagagaggcaaaactaaaagcagtaattccagttagaaggctatgtcagtggtttgggtgagagagggcagagctttgactagaaggtgaatagtgaagatggagacaagtgaacccgtttgggaaatagtttcttttttccaacctttatttttttattgaggtgaaattgacataacataaaattaaccattttaaactatacaatttagtagcatttagggctttcataatactgtacaaccactctctctgattctgaaacattttcatcactccaaaagaaacgccctacctattatgcagttgcttcccattctccccttccccaggccctggaaaacatcagtctgtgttctctctttatttatttacctattctggatatttcgataaatagaataatacactatgtggtatttttagctagtctttcacttagcataatgctttcaaggtttgtccattatggagcatttattaatcattcattactttttattcacaagtaatattccattgtatggataaagcaaattttatttacccattcatgacttgatagatatttgggttgtttctactttggggctattagcaataatgctgctatgaacattcacatactttatctatggatatatgtttttatttctcttgggtgtatagctagaagtgaaattgctgaatagtatggtaaacctataacattttgaaaaaactcctgggtaatatagtaacatttaacattttgaagaactaccaaactgcttaccaaactggctatagcagtttgtaatcctaccagcaatgaatgatggttctaattgttctctatcctcttaaacatttattatcgtctgtcacgtttattgtaaccatcctagtggatgtgaactgctatctcattttgatttgcattttcctaatgactatactgagcatctttttatgtgcttactggccatgtttatatctttcctggagaaatgtctatttaaaatatttacccatttttaaattgggttatttgtctttttatggttgagttgtaagagtttttatatattctgcatataaggcacatatctgataagtgatttgcatgtattttctcctagtttgtggcttgcattttcaatttattttgctgtcctttgaagcacatatgtttttaattttgatgaagttcaatttatctgtattttctttggtcagacttcaggtatcacatttaagaaacagttgtctagctcaagttgacaaagatttattcctataatttcttcatgagttttatagctttagctcttatatttaggttgttgatccattttgagttattatatatggtataggatagtatctaacttcattattttgcatgtgattttccagttgtcccaacaccatttgttggaaagattattcttttccccattgtatagtgttggcagccttgtcagaaatcaattgaccatggatgtatatatatgggttgctttttggattctcaattctgttttgcctatgtatatatctttctttatgccaagggtcccttgcatttccatatgaattttaggattagcttgtcaatttctgccaataaagcagctgggattttggtagggattatattgaatatgtatatcaatctgaagagtatgtccatcttaacggtgttaaatctttcaacacataaacataaaatatatttctttttatcttcgtcttctttaattttttcaactatgttttgtaattttccgtgtatgggccttgacttattatgttacatttatttttaaatatttagttctttttgatgttatcataaatgaaatctttttcttaattgcatttttagattgttcattactagtgtataagaaataaaattgattatttaaaaatagttaaggtatgattgacatacaaaaagttgtacatatttaatatataccacttaatgaatttggaaataagaatacactgtgaaaccatcaaccacaatctatgccatgaacttgttcatcccctctaaaagtttgctcccaatttctttattattatttgtatgataagaataattaatgttaagatttactttgttagcaaaattgtaagtttacaacacaatattgttaattataggcactatgctgtccagtagatctctaggacttacacaccttgtataaccaaagtttatacctttgaccctcctttctccctccaagtccctagcaaccattccattcactgcctctatgagtttgacaattttagattcatcttataattggtatcatgtagtatttgtccttttgtgtctgacttactttattcaacataagcctgaataccttaaaaaagaaggaaatgctgtgatttttgataacatggatgaagctggaggacattatgtatgccatgttttccttgtccattattcatcagtggacatttaggttgtttctatgtctcagctactgtgaacaatgctgcattgaacatgggagtgcagatagctctttaacatacttatttcatgtcctttggatatgtacccagtagtgggattccttgaccatatggtagttctatgtttaatttttaatgatttttataaaggttatgggtctgtaattttcctttgttgtagtgtctttggaaaaaattctacttgatcatgacatcttttttttttttgagacagagtcttgctctgttgcccagcttggagtgcaatgacgtgatctcggctcactgcaacctctgcctcccaggttcaagcaattcttctgcctcaagctcccaagtagctaggactgcagacatgcaccgccatgcctggctaatttttttttttatacttttagtagagatggggtttcaccatgttgcccaggctggtctcgaactcctgacctcaggtgatccacccgcctcggcctctccaggtcttgggattacagacatgagccacagcacctggccccatggtgtcttttgttcaggggagaaatgaagtcatttttaaaaattatgagaaatactacatatgtatgagtttatcatatatagaagagtgtattataaatatatttgttacatattacatatgtatgagtttatcatttatagaagactattataaatatatttgttacatatatgtatactatacagtatatgtttctatgtttaatataggtatactaacaactctcacattgttggcaaactagtaggtgtatgcaaatgtatctttgtggtttaaattttaatttccttgaaatctaataagtatgagcactattttatattgaaattggcccatagtcttccttttctaataagtgtcaagtacccaccactcaggtcaagaaatagacaagtatagggaccccaaaaacctctgttgtttccctcccagatcacagttccctcctcccttaagatagccataatttgtgctttgtaataatcagttacttggtttcctttagttttaccaaccttacatggatccctaaataatatagtcgattatccatttctgaattttatctaaataaatacatacttttatctcttgctttttttcactcaacattacatttaagagattcatctctgttatttttatacctgtatctggtatctaaggcaagttttctcctttctctattgtctgacattcaaactggattgcttttgggttagctatgtgataattttattactctaaaagtaacacatgcaaatggtaaaaacaaaaataaaaattcaagtaacaccaaaaggcataaatttaaaaggaaaacactaccaccccaatccacactccttaatgactacacaacccttcttgtaattgactccttttgttttaaaatcctaaattattctattatgctaattttaaaaatgtatccgtttcacacagtaattattaacaacacacaatcagtgataggaaatttactgtcttatattactaccctctactgcccctcccagactactttttgcaattattcttattttttttttagttttgttttttctattcttatctttaaataatggctccatgtttctctctacctcgtctcccttcctcatcgtctacatttttatgagctatgttgttttcacattgttaaaattaaacattctctcattggaattatgattaccttcgattttgtttattgattcagcccaacatttgtaaatccactaattatatttatattatgttatatttttcaatttgaggaatgatactttccaagtcctcattgggtcaaaacagatacttatgtttctatatcagcacatatgcttcttatcacttaatactaccaaacaaagcagagaaaattattgtcaataagaaatctggttttgtggattacagatatcatctctggataaaaagaaatcttaacagtcttataatttgaaagaaaatttccccaactacttgttagtgggataatttatagtagctttatcttggaatacctgtgaaacgacctggaaaaagaagactaaagaatgactaaattgttgtcatttaagtgcaataataacaaatatatttttcagtgttatttcacattcattatttcatttaaccttcacaacaaaaccataattaggcacacccaaatagcacagtgtctaagagctttggtgttggagtcatagagattagggtttaaatttaaactccatatttaataactttgtaatgttaaacaggctacttaatctctcaaagtataatgctccttacacagaaagaggttgttaatagtttctttcagccatgttttgtagttttccctatagaggattttcacctccttggttagatacattcctaagtattatatatttatttatttatttgcagctattgtaaaaaggggttgcgttcttgatttgattttcagcttggtcgctgttggtgtacagcagagctactgatttgtgtgcattaattttgtatcctgaaactttgctgaattcatttatcagttctgtagctttttggaagaatctttaggattttccaggtatacgatcatatcatcggtaaagagtgacagttttacttcctctttactgacttggatgcccttcatttctttctcatgtctgattgctctggctgggacttccagtactattttgaatagaagtggtgagagtgggcatccttgtcatgttccagttctcaaagggaatgctttcaacttttctccattcagtattatgtttgctgtgggtttgtcataaacaacttttattacattaaagtatgtcccttctatcccaattgtactgagggtttttaatcataaagagttgctggattttctcggatgctttttctgcatctattgagatgatcatgtgatttttatttataattatgtttatctaatttttgtttttaattctgtttatgttaattctgttttaattcacattaaacaatacattaaaaagatcacttgtgtttgttaaaccatccctgtttcctgggtatgaaacccacttgaccatggtggatcatatttttgatatgctgttggatttggttagctagtattttgttgaggatttgtgcatctatgttcatcagggatattggtctgtagttttgtttttttgttatgtcctttcctggttttggtattaagatgatactggcttcataaaatgatagtatttacctcataggatgtgtttgaaaagtgagtatatgggtatagtaatataattttaactacctaataaattttagcttttataatcattgtctccttctgcccattctgcttttccttcttctccttcttcatttcatagattaagaaattaggcctgagagcataactgtcttttccaagtacacataaacagtacaaaaaatatacatataggccactggaacagaatagggagcccagaaagaaatccatccatttacggtcaatcaatttttgacaaagatgccaagaaaatacaatagggaaacaagcatcttttcaatacgtgatgctagaaaaactgacagtccacatgctgaagaatggtttttgatcctccactcatatcatatttaaaaatccacttaaaattgtttaaggtcttaaagataagacctgaaactataaaactactagaagaaaacatagggaaatgttccattatattctgggataatactcaagatgatcaaaacacaggcaacaaaagcaaaaacagacaaatgagattacatcgagctaaaaaatcttctgcacagcaaataatcaatagagaataaataactcatagaatgagggaatatatttccaaacggtatatatgataaggggttaatatatgaaatatataagaaactcacacagctcaatagcacaaaaacaaatagactgataaagaaatggacaaaggagctaaatagacatttctcaaaagaagacatacagaaatccaacacatatgtgaaaaaatgcccaacatctctaatcatcagggaaatgcaaataaaaaccttgagctatcacctcatactcgttagagtggctgcaatcaaaaagatgaaagataagtattggtaagaatgtagaaaaaagtggaaccttattcactgttggtggtatgtatattggtacaaccattttggaacacattatggaggttcctcaaaaaattaaaaataagaaatccaaaagctaaacagactcaataacaagtaacaagatcaaagccataataaaagtctccccataaagaaaagcccaggacctaatcacttcaccactgaattctatcagacatttaaagaactaataccaaaacaccaaaagcaatggcaacaaaagccaaaattgacaaatgggatctaattcaactaaagagcttctgcacagcaaaagaaactaccatcagagtgaacagcccacctacagaatgggagaaaacttttgcaatctactcatctgacaaagggctaatatctagaatctacaaagaactcaaacaaatttacaagaaaaaaacaaccccatcaacaagtgggcgaaggatatgaacaagacacttctcaaaagaagacatttatgcagccaacagacacatgaaaaaatgctcatcatcactggccatcagagaaatgcaaatcaaaaccacaatgagataccatctcacaccagttagaatggcgatcattaaaaagtcaggaaataacaggtgctgaagaggatgtgcagaaataggaacactttcacactgttagtgggactgtaaactagttcaaccactgtggaagacagtgtggcgattcctcagggatctagaactagaaataccatttgacccagccatcccattactgggtatatacccaaaggattataaatcatgctgctataaagacacatgcacacgtatgtttattgtggcgctattcacaatagcaaagacctgcaaccaacccaaatgtccaacaatgatagattggattaagaaaatgtggcacatatacaccatggaatactatgcagccataaaaaatgatgagttcatgtcctttgtagggacatggatgaagctggaaaccatcattctcagcaaactatcacaaggacagaaaaccaaacaccgcatgttctcactcacaggtgagaattgaacaatgagaacacttggacacaggaaggggaacatcacacaccaggacctgttgtggggtggaggtggggggatagcattaggagatgtacctaatgtaaatgatgagttaatgggtgcagcacaccaacatggcatatgtatacatatggaacaaacctgcatgttgtgcacatgtaccctagaacttaaagtataataaatatacatatatatatatatttaaaaagaactaataccaatagtactcaaattattctgataaatagaggaggaaggaatacttccaaactcattctacaaggacagtattaccctgacaccaaaatcagacaagaacacattgtaaaaagaaaactacaggccagtatatctgatgaatattgatgcaaaaattctcaacataatactagcaaaccaaattcaacaataaattaaaaagatcattcatcatgaccaagtgggatttagccctgggatgccaggatggttcaacatatgcaaatcaatcagtgtgatatatcatgtcagcagaatgaaggacaaaatcatatgatcatttcaattgatgctgaaaatgcatttgataaaattcaacattcctttatgataaaaaatggaatcctcaaaaaactgggtatagaaggaacacacctcagcataataaaagccatccaaacagacccaaaactagtatcatactgaatgggaaaaaactgaaagcctctcctctaagatctggaacatgacaagaatgcccactttcaacactgttggtcaacatagtactggaagtccgagaaatcagacaagaaagaaataaagcgtgtccaaattggaatggaataagtcaaattatccttgtttgcagatgatattatcttatattttgaaaaacctaaagactccacaaaaaaactattagaaatgataaattcagtaaagttgcaggatatgaaatcaacatacaaaaatcagtagcatttctatgtgccaacagtgaaccatgtgaaatagaaattttaaaaagtaatcccagtggccacacacacaaataaatacctagcaattaactttaccaaagaagtgaaagaacttagtaatgaaaactataaaacactaatgaaagaaattgaagaggacaccaaaaaatggaaagagagtccatgtttatggattagaaggatcaatattgtttaaatgtccatagtacccaaagcaatctacatattcaatgcaatctctatcaaaatactaatgacattcttcacaaaaataggaaaagcaattctaaaaatatatgtaacaacaagagacccagaacagccaaagctatattaagcaaaaagaactaaactggagtagttgcattacctgtcttcaaattaggctatagagctatagtaaccaaaacagcatactactggcataaacacagacacatagaccaatggaacagaatagagaacccagaaacaaattcatacagctacagtgtactcatttttaacagacgtgccaggaacatacacgttggaaaagatagtctcttcaatacatggtgctaggaaaactggatataaatactcggaagaatgaaattagacccctatctctcaccacattaaaatcatatcaaaatggattaaagatttaaatccaagacttcagcctatgatactactaataagaaaacattggggaaactctccagaacattggtctgggaaaaagttttctggagtaataccccagaagcaaaggcaaccaaaggaaaagttggcaaatgggatcacatgaagttaaaaagcttctgcacagcagtggaaacaatcaacaaagtaaaaatcccacagaatgggaggaaatgtttacaaactacccatctgacgatgaatgactagaatatataaggagttcaaaccactctatagaaaaaaagttgaataacccgatcaaaaaatgggcaaaagttttgagtagacatttctcaaaagaagacatgcaaatggcaaacaggcagatgaaaaggtgctaaacatcgttgatcatcagagaaatgcaaatcagaactgcagtgagatgtcgtctcaccccagttaaaatggtttctatccaaacgacagacaataacaaataatgaagatgtggatcaaagggaaccctcatacactgttggtggcaatgtaaattagtgcaactgttatggagaacagtttggaggttcttcagaaaactaaaaatagagctaccatatgatcaagcaatcccactactaggtatatatccaaaagaaaggaaatcagtatatcaaagatatatctgcagtcccatatttgttgcagcactgttcacaatagccacgatttggaagcaatgtaagtgttcatcaacagatgaacagataaagaaaatgtggtacatatatataatggagtactattcagccattaaaaagaatgagatcctgtcgtttgcaatgacatggatggaactagagatcattatattaagtgaaataagccaagcacacaaataagaacatcgcatgttttcacttatttttgggatccaaaaatcaaaacaattgaactcatggacatagagagtagaaggatggttaccagagtctggaaaggcttgtgggggcggggaggtgggaatggttaatgggtacaatagagatagtgaggaagaatgaataagacctactattttatagcacaaaagggtaactatagtcaacaataagtgtatatttaaaaataactaaaatagtataattgcattgttcgtaagacaaggcataaatgcttgaagggatggatagttcaatttttatgatgtgattattatgcattgcatgcctgtatcaaaacatcttatgtatcccataaatatatacacctactacatacccacaaaaattaaaaatagaactgtcatgtgatcaagcaatccctctactgggtatatatccaaaggatatgaaatgagtatgtcaaaaagatacctgcactgccatgttcattgcagtagtgctcattactcacactagccaagatatggaatcaacttaagtatccatcagtggatgaatggataagaaaatgtggcatgtatatagaatggaatagtattcaagttttaaaaagaaggaaatcctatcatttgcaacaatatgaataaagttggaggacaatgtgttaagtgaaataagctaggcacagtaatacaaatacagcatgatctcacttataagtgaaatctaaaaacttgaactcatagaaaaagagaataaaatgggtatcagcagctgggggtgaggggactggggagatgttggtcaaaggacaaaaagtttcagttaggcaggaggaagaagtttaatagatctactgtataccatggtacctatagttaataacactatgttgtatacttaaaaatttctaagagagtaggttaaatgatgtctcccaaaaaaataagtctgagagataatgcatatgtcaaatagcttgattaagccattctgcattgtattgtatacatatatcaaagcattatgttatataccataaagatatataatttttacttatcaatctaaaagctaataaattaaataaattcaatttaaaaattaattagtgtgagctatgtctattagctagacctgttttttttcctttgagaagttctttttaaatacatgaaaagtttgtgtgtgtgtgtgtgtatgtgtgtgtgtgtgtgtgtgtgtgtaatagatcctgactagcaatcttctaaggctgtggtggttaaatttagctaagagaaattgcatttagatattaggtagcattttaatatgcctggatgggttttgaaggcattattctttctcgtgaaattttgggaaaagaggtagatacagccttccttgaacaattatttataaatttgaagacaagtagctggacaagattttctttcaatgctaatttttattttctaattcaatgatcattttcctgtgaatacatgtttttgcttaagccgaggtttattttccagtttgtataggtaatccttcttagttgatcttaattatagctgtcaagagctaaacatttcttttctacatctggactaggaaatgtttccaatgaacaatcattttaggatcccaagtatcctaaatttctaaagctgtattagttttctattactgcataacaaattacaagaattttgatatcttaaaaaaaaagacccatttattatttcacagttctgtaggtcaaaagtttgttgagacatggctgggtcttctgctttggcttcagtaaaattgtctgctgactattttaatacatttttatcttgagcttggggctctttacaaactcttttctattgttggctgaactcagttccttgcacttatagaactgaagtccccattttcttattgtctgtctcgtagggctgctgtcagctcccagagtcactctcaaatttaagccacatgatttccccccatttcagcaacagagaacttccctcccatgctgcatctactgccactagccagacaaaactctgagcttttttttttttttttttttttgacagagtcccactctgtcaccaaggctagagtgcagtggtgtgatctcggctcactgcaacctccaccttccgggttcaagcgattctcctgcctcagcctcctgagtagctgggattacaggcgcatgccaccatgcccagctaatttttgtatttttagtagagatggggtttcaccatgttggtcaggctggtctcgaactcctgaccttgtgatctgcctgcctcggcctcctaaagtgctgggattacaggcgtgagccactgcgcctggccaaaactctgagcttttaaggggctcatgtgattgggttaggcccctacagataatctcccttttgatgaacccaaggttatctgattagaaatcttaattaatgctgcaaaaatccctttgccatgtaaggtaacacaatcatgagagtgatgcctcatcatattcataggttctactcaggattaaaaagagattacacgagagcaagcatcattggagatcatcttaagagttttgcctactaaaaagtactagtatctggggcaagcaacataggtttttgaggctatctgaatatctgtcttacagtcttctattctcaaacaagctttctttccaaattccctgtttctgtaagtgtcatccaagtttagtaataagtttcattaactttcctttcaaacatattttatatttgttctttatatcattgctatttagctgtaagcatgccatacatatattactgcagcagtctactttctgctgttcctcaatgtgagctctctcttccctccgtgacagaatccatcctgaaaagcaatgatgttaaagaatattatactacttaaaaatcaatcaatgggatctcttttctgtaacattaaaataagtcttcattgaacaattttaagaatttaagaattttaagtccatcagaaatatggttttgcccataaatatctaaccttattttgcttggataagcatggatctaaacccagtccatatcccctatcctttttcttgtctaggcagatgtatccacttcctcacaacacaatggtgttaattcctgctaattttatccctagatatcacatgatcctttctcttgattttatttgctctttcttcaaggcaatggataattttagtgccttcttgagactttcctttattcttcattacagttagaagtacatgatagtcttctctacctaattaaattatagcccattttccaaattatgttataaagtgcttgagagtagatatatttgtatcttataattttgtgcctatatataattgttcctcaaaatattaatgccaactactttctcttaataaggaaatgataaagtcaaagtcaaaagctatgactgagaaatatgtttctacaaagtggaatgacttgatattaggtagcattttaatatgcctggatgagctttgaatgcccttctccattcatgaacataatggaaaattaaagtactaaatacctttgcctccgatgtttgggtaaacgctaataaagttgtcaattacttggccagttgcagccaaattgttttaaataaattatccaaataatgtttttttctcttcacccttaccaagagagaccctgggagcagaacacaaattaagcccatatctgaatttacaaggaaaatatctgaaactatatttacatccaagtttgcaattttcttttcttttcttcttttttttttttttttgagatggagtcttgctctgttgcacaggctgtagtacagtggcataatctcggctcactgcaacctccgcatcccaggttcaagccattctcctgcctcagcctcctgagaagctgagattacaggcgcatgccaccacgcccgcctaattttttgtattttagtagaaacggggtttcactgtgttgcccaggctggtcttgaactcctgggctcaggtgatccgcccaccctggcctcccaaagtgctgggattacaggcgtgagccagcgcacccggcctacaattttcaaagcaatctcgtgttgaagaaggaaatgtcttcaacagtggtccatcttcagtctttatcctatgaaacctctatgtggtttttggagttttgggccactagtttgttcctgaaattctctccttccctagatttttactggttttctctggatttcttaagctatctctggctacaccttactagtctcaatctgtctctgaatacaccataaaaagcagtaatattcaagattctatttttgtttttccctatatatactttttatttttattttttttacctgaaaaaattcattcatcgctgtgactttaactttcatttgaaagattcaaaattcaggccctgaccttttcttggtctagattcctatctccagctgactgttgttaatccctgtatagatgtcctgccagttcataaatttaacaatcagtgcaaaaccaaattcatatttcatttctatttcctttcctatttctcagttgagttaattgtttcacagttcttttattcacatagtctagaaactgtggaaatatctgccattcttctcccatgttttactacccacccgctacaatttcagcatttcctttcaaatttgtcttcctgcctgcagtatcctttctactgtggaaatttactcatcttttaggtccaatttaatcagaactctcagccacccctcatacatggataaaaatcaatcagatattcttagaaacttctatagcatcttttttttttcctgaggtatgattatttgtgtacatattggcatccttcaattggcagcaagttacttaagggcagaggtcattcccatgtctctatattttagctctgtgtctttatcatggtggttgctcaaaaaatgtttcctgaattctctgtgcccttgcctacatgacaatataactttcaaattcaaaaagcaatcctattttccaatcttttacattacctgaagtaacattttcggttaagggaatttctaaattctgatgaaattatactttttatatagctttaaaattccccactgagtttaccaaacaaggttgatgatttgcctttaaaatgccgacaatcaattcttaattcagtcaaactgatgagtgggtcccccaatcacaagtgctgtcatgcattttccttatttttgagtgaagtatggttgttttcccagtttttcctgaattagtcttaaataagtcagcatcttcacaagttcccaagagaaattaagtatattgctacagtaataaagcattagatgctttaaaaaatctttccccttagaatttaagagtgaaatatcttacatgaatcctaatattaattttttgatctttcattgtgacatgacattacatcctttaaatatttacgtataatttcaggtaatttttgtgttacttttattttatagttttctttcacaacagaaaattattttatgtttataatatctgccttcctagccattatgtcatgcggcccttatcatggaaaacattgtctcttttaggggtacttttggggcgttatcaaaatatgtttcttggtggaaagtctcatgatgatatatcctcttcaagagatgtttgagatgcaactcagacatactcttgttcttagccttgatttatgtaaacactttgtcttcatcaaagtcacaaaattttatcagaaccttatttttaacccagtatataaattcatcctatttagaaatcaaataaaacatgcttttgtcctgttcactgccatttgacagcatcccactttttcttttcttttttaaaagtacttttaacaacaggtaaaagatgcaacttgatacagttagttaagaaaattctactttgtatttttaaaagctgagacaatgtttggagtactgtaggtatcattttattttcactacatgaataataatggatatagttcttcctggcattgtctgtattaatgggcattaatctattgccatatctttattatgactttctttaccaatcttgcagtaatattttatgcctggggtaatgattaatagataatattttgtgtatttctgttatgatttggctgtgtccccacccaaatgtcaacttgagttgtagctcctagaattcccacgtgttgtaggagggatccaaggggaggtaattgaatcacgggggctggtctttcccttgctattctcatcacagtgaataagtctcacaagaactgatgggtttatcaggggtttccacttttgcttctttctcatttttctcttgttgccaccatgtaagaagtgcctttcgcctcccaccatgattctgaggcctccctagccacgtggaactgtaagtccaattaaacatctttttcttccccgtctcaggtatgtcagtgtcagactaatacagtaaattggtaccattagagtgggacgttgctgaaaagatacccaaaaatgtggaaatgactttggaactgggtaacaggcagaggttggaacagtttggagggcccaggagaagacaggaaaatatgggaaagtttggaacttcttagcgacttactgaatggctttgcccaaaatgctgatagcgatatggaccataaggtccaggtggaggtgaggaacttgttgggaactggagtaaaggtgactcttgttatgttttagcaaagagactaacgtcattttgcccctgccctagagatctgtggaactttaaacttgagaaagattatttagggtatctgcagaagaaatttctaagcagcaaagcattcaagaggtgacttgtcattcagttttataagggaagcagagcataaaagtttggaatatttgcagcctgactatgtgacagaaaagaaaagtccattttctggggagaaattcaagccagctgcagaaatttacataagtagcatggagcctaatgtgaatccccaagaccacgtgtaaaatatctccaggctgtgtcagagaccttcacagcagcatccccatcacaggtccggaagcccaggaggaaagtggtttcgtgggctgggcccagggtcctcgtgctgtgtgcagcctagggacttggtgccctgtgacccagccactccagccatggctgaaagaggccaatgtccagctcaggctgtggcttcagagggcggaagccccaaactttggcagctcccacgtggtgtggagcctgtgggtacacagaagtcaagaattgaggtttgggaaactccgcctagatttcagaagatgtatggaaatgcctggattcccaggcaaaagtttgctgcaggggcgaggccctcatggagaacctttgctagggcagtgcagaagggaaatgtggggtcagagcctgcacacagagtccctactggggcactgccttgtagagctgtgagaagagggccaccgtccttcagaacccagaatggtagacccaccaagagcttgcaccatgcacctggaaaagccacaaacactgaacgccagcccatgaaagcagccaagagggagtctgtccactgcaaagtcacaggggcggagctgcccaagaccatgggaacccacctcttgcatcagcgtgacctgattttgagacttggaatcaaaggagatcattctggagctttaaaatttgactgccccactggatttcagacttacatgggctctgcaacccctctgttttggccaatttctcccatttcaaacagctgtatttacccaatacctgtacccccattgtatctaggaagtaactagcttgcttttgattttacaggctcatagacggaagggacttgccttgtctcagatgagactttagactgtggacttttgggttaatgctgaaatgagttaagactttgggagactgttgggaaggcgtgattggttttgaaatgtgaggacatgagatttagaggagccacgggcggaatgatatggtttggctgtgtccctacccaaatctcaacttgaattgtagctcctagaattcccacgtgttgcgggagagactcagggctaggtaattgaatcatgggggctggtctttcctgtgctactcttaggatagggtgaatatgtctcacgagatctgatgtgtttatcagggtttccacttctgtgtctttctcatttttctcttgctggggccatgtaagaagtgccttttggccgggtgcggtggctcacatctgtaatcccagcactttgggaggctgacgcgggcagaccatgaggtcaagagatggagaccatcctggccaacatggtgaaaccccatctctactgaaaatacaaaaattagctgggcatggtggcgcagcctgtagtcccagctactcaggaggctgaggcaggagacttgcttgaacccgagaggtggaggtttcagtgagccgagatcatgccactgcattccagcctggtgacacagcgagactccgtctcaaaaaaaaaacaacaaaaaaagtgactttcacctcccaccatgattctgaagcctccccagccacgtggaactgtaaatccaattaaatctctttttcttcccagtctcgggtatgtctttagtagcagtgtgaaaacagactaatacaatttccctctgttgaactggtgaacaatttagcatgtaccaggtaattcagtagtaagaaaaatggggctggtgagttactaagagacacacaggattaacatgcccattaggtgcatccaacctaattttgcaatgcacaggcctctttgctttgtaaagaggaatgtaccattatttgcagtagcatctcagcttggtggatgataaaggatgaacattttccacctcaggtcaaatagatgaatttattcattctactagttattaagcagcagcaatgtagcagtcattggtaatcaataataaatggcataggccatctcctaatggctttgcattctactaggtattttttttctattttttattctacaccctaaaactgtgaaacacagagaaactaaaatggttcttcctaaccaagattaactatgttctataccaataagctacttttaagtgcctctcagtaaactaacatccttcagatataggtagaggaattcaagccactacaataaatacaattatttcaatcatcactttttatatggagattgccaatgtgcaggatccaacatagttgcagtggctgggcactgcagaactccaggggactttatttacgtagattaggatgctggcacactgttcacatacattacaatctgagtgaccaaatgctccaacccagacgtatttttttcagccacctcttttatggcctgtcaagaacaagcattaccaagttgttccttcattttattttgtttacacttttgaggtgctgctgtgctcagggttcttttcttgttgaagtaaagagatatacaaagataaataacacgtaaatgtgtactttaatggacaacattagagtctagtaatttcctttacagactccagatctcaatggagccacaaacaagataagttcataactgcatctccgttctcaaggatgctatcttaacaaatgtgttcagattggccaaaaaacagcagcagcatttacttactgaaagccatatggagaagctgtactctttcactaggtcacttggcaaacattacctttgtgctccctcgacatttcctgatctcaagagtaggaaaccagaagagaaccaaatcacttccttccctacttcctaaagagcaacgttgacctcatcagctgggcttcagggttcagtaaacccacatatttcaggataaactggcttgagtacatgagtggtgattgcttttgttacagagttgaggtgacaatattgatcattaaaacaaggaaaatgaaaagtgttggcattctttcatggccatctgtgacttcagtgtgctggtacttagtgttcacaggcaactgaatgtttgaactggttcttggttttgcagtgaaaaatgaaggaaagcattcttctgcttttgcctgtttatttttttctcatgaacaacatggttagaaattatgacatttaattgttttaaattccattgtcatgccatattttgtttcatgtatttagcattttcatatgtgacactatatcataatttaattgtaaatttaagtttgctatcccacttcactttaaacctttctatttaataagattcacagatttttatttttctgtaagaaactgatacattatttgacttttttggttgcattccaacattttaacattagtattataaaaagaaatcaaagttatttttatttcctttaagattttataataactgtgcagcatgaacataaggaatatgatattcatgactggaatcaaagattataaacatttagaacatgaataatagttaatgtattaaaacagttttatatatataatatatataaacataataaatatgttttattgtgttgaatcacatgaagtttctatttttgatagaaaaaaatcgtcaaattttggcaatcagcttatattaggtaattctgcacatttttgctaccagtttaatgaaaattaaattgcatgatagttaaccaccataaatgagtcagccctttgtggattgtctaaacctaataccacttcctctctcttttgatttaatgactgctttcaggctgactactcaagaagtctatcttaagtggtaatgaatgaaagaaaacaatatccataaatttagatacctaaagtaaaagttccgtattttataaaacccaggagttagaataaaggagcagttaagactatgaattaaatcttgttttgggagattatctggatttatttacatgtgctactatgtctctaatcccatatataataaacaattgagtaggctctaaaatgcatgtttccaacaaatgatatcaagatgatattatatttttgagaatttgtgcagctttttagctgaacagaaaaaaggtggtctactacaaaacttgaactctactacaaagcaaatccttactgtcaatagatgtaaattctcatcagttctgtcactggcagcctctgtgacacaagcaggtggcctaacctctatggaagcagtttatttgttcactttaccgagatcttagtgcacatatgcattcacacttttttaacaacaactctgtgattctcaggagcccaccccagaggttaggaaccattggattataaaagctctgttaacccttcttagtctcacattctaatttctattaacctaagaggtattagcaacaattgaggaaaaggaaatagactaactggaaatatggaatcattataatgaagattccaaccactcaagctgataattatgtatgagttctttccatttgactagaggccagaaaccagagagggtggaattgatgagccagcgtgtcttgctggcagtggctgcagcctgaaaggaaagtaatccagataattatttaattggatactatttaaaaagagaagtagaaaccccccaagaagtatggtccagattaaacatcttttccaccatattggttaaataaaaacccaaggatggtgcactgatggccaacatccatgaggttccattttcactgccatgaaatttccttttaactgttccctgctgtccttgacagtctctgtcagctttacttttcaatgttaagtacttctggatgatgattttacaatagtatgcttataatgaaaaatgaaaatgaatgaaatcctagctacaaacataataacaggagggtaatattcaagtgcttcctatgaaaggcattgcagtgcagtgcttatgacaaaaactgtcatgagtcagcctggacttgaaccatcttacatcatttctatcttatatgttacataatttataaaatatgtgttataagtttggtttagttattgaaacttcctgtgattcagtttcagcacttttaaactgggtgggatggtattggggtagtagtaaacattacataagttaattggtggttaatttgtataaagactttatgccagtgcttggcttaagtgccatatgtctgaaatagtaatttgctattattactatttcctgcatggcagttttacagaaaagtgactctttttatatgacctaactaactgagccctggctctttaaaagtattggttttggctgaattatcatagcatggtgaagtctatcaattttacaagaagtggctcagaaaaacaaatggcatgcaatacaatacatttgcatctgcagttatatctacataagacgctgagcataattttggaggtgatatgaccaattaaagtattttgctccctcttttctgttttccattctcttgagattttatttttaggtctttttctctgagctgtatgcattgatatttaatgattgccatttttattccttttggagaattaaatattaaatatcaggcagaatacctcctttaatttccctttggagtaataaaatggtaccagtaactgtttcctgagatctgtagcaataccctttgtcaaaatggaagtacattataaagccagaaaaccacgtatcaagagctcttagaaagagtgttttatattatataaatatgtcaaataatgaaaacatccaagaggtgaattggtgctgatttggcctcaggaatctctcacacaaaatgttacaataaattctaattaccgaagtacttatcaaattataaaaaagttttaattactaattttaattactttattcacaatgagataattagcatgaataagaattactccctttttcagctttattggggtataattaacaaaattgtatatgtttaaagtgcacaacatgatttaatatacatatgcatgtatcaacacaatcaaattaatgaacatattcatcatacatagttaaccattgtgtgtgtatgtatgtatgcatgtggtgaagacactcaatacctaccttcctagtgaatttcaagtaaaacttcagtattattaattatagtcaccatgctgtacattagatcctcagaacctattcacttataactgaaagtttgtacacttcaaacaacatctcccaattttccccactcataatccctgatatctgttcttctactctttgcttctatgagttctactttttcagatatcacatgtaagtgataccatacagtatgggtatttctatatctggcttattttatttagcataatgttctttaggtgcatccatgttgttgcaaatggaaggatttcatctcttttaaggctgaatactatcccattttgtgtgtgtgtgtgtgtgtgtgtgtgtgtgtgtgtgtgtgtaacattttctttcttcattcatccattaataggtacttaggttggttctacatcttggctgttgtgaataatgatgatatgaacaagaaagtgcagatatctcatcaagatactgacttaattgcctttagatatatattcagaagtggatttgctggattgtatagtagttttatttttaattttttgaagaacctccttactgtttgccatacttgctgaatcaatttacattaccattcccactaacaatgtaaaagagatctgttttcttttcttttctcttttttttttttttttttttgagacagagtctccctctgttacctaggctggagtgcagtggcacaatctcagctcactgcaacctccgcctctcaggttcaagcgattctcctgcctcagcctcccgagtaactgggattgcaggcgcccgccaccatgcctggctaattttttgtatttttagtagagacagggtttcactatgttggccaggatggtctcaaactccttcctgatccgcccgcctcagcttcccaaagtgctgggattacagccactgcactgagtctagggatcccttttcttaacaccatcaccaacacttgttatcccttgtctttttgataataaccattctaacagcaatatgtcattgtagttttaatttgcatttcccagatgattagtgagataaagcaccttttaatacacctgttgggcatttgtatgttttctttggaagaatgtttattcacaccccttgcccattttctaaccaggttatttcattttttgctattaacttgtatgagttccttatatatttttaatattaaccccttgtcagatacaaggtttgtaaaaccatctcccatttcatagcttgcctttttatttcttttgcagtacataagtgtgattgtttcttttgcagtacataagtttcttactttgatgttatcccgtttgcttatttttatttttttgcctctgctttttgtgtcatatacaaaaaatcattgccaatacgaatgtcaaggagctttttccctgttttcttataagagttttatgatttcaggccttacatttaagtctttaatccattttgagttaatatttgtgtatgatgtaggtgtctaatttctttcttttgtatgtggatattcatttatcacaatgccattctctttgtattcttagtgcttttgtcaaagattagttgactgtctatgtatgggtttatttctggctctctgttctattggtctatgtatctcatttttatgccagtagcatactgttttgattactgtagctttgtaacataatttgaaatcagaaggtgtgacacctccagttttgttcttttttattttttaaggacaagtgtctctctttgtcacctgggctgcagtgcaatggcttagtcatagctcactgcaaactcaaactcctggactcaagcaatcctcccacctcagcttctggagttgctggggctataagcatgcaccatcagccccagctggttattaattttttatatataaaagcgaggtctcactatgttacccagggtggtctggaacttccaatctcaagatcctcctaccttggtctcccaaagcactgatattttaggcatgagctactgtgcctggccctgctgtactttcccaagattcgtttggctattcaacatcttctatagttttatattaattttagaaatgtttttctgatttctttgaaaaatgccattggaatttttatagggattacattgaatctgtagatttatttgggtaatatggatattttagcagtattaattattcccatctctgaagataggaagtattccatttatttgtctcttcagtttctttcatcaacatcttacaattttcagtgtacagatctttcacctctcgttaaatttatttgcaagaattttattctttattattcttttgtaaagtggattgttttgattctttttagatggtttattattagtatgtagaaacacagctaacttttgtatgttgatttttttgtcctgcaactttactcaatttgtttattagttctaacagtttttttttttttttttttttttggtggagtctttagggtttcctgtatgtaagatcatgttatctgcaatcagaaacagtttttcttcctttctgatttggatatcttttatttcattttcttgcctaattgctctggctagactttcagtaccatgttaaatagaaatgatgagggtgggcatcttttcttgttcctgatcttaaagtaaaagctttcatcttttcattgttaagtacaacgttggttgagaggttgttatatatagccttagttcttttgaggtacatttcttctgtaccttattagttgagagtttttatcatggaataatgctgaattttatcaaatgctttctctgcatttgagatgatcatatgatttgtatcctttattctcttaatgtgatgcatcacatttattgatttgtgtaagctaacatatccttgcttgccaaggataaatgtcatttgatcatggtattcttttaaagtgttattaatttggtttgattacattttcttaaaaatgtttgtatttatattcattaggaatattgacctatgattttctttttttgtagtatccatatctggctttagtatcagaataatgctagcttcttaaaatgagattggaggtatcctctccttctgaatttttagaagaatttgagaaggattgatactaattcctctttaaatatctgatataattcacttgtgaagctatcaggttttaggcttttctttagaggtttttactcatgatcggtctgttcaggttttctacttcttcattattcagtcttggtaacttgtatgtttctaggaatttatccttattccaggttatccaatttgttggaatattattattcggagtagtctcttatgaccctttgtatttctgtggtatcagttgtaatgtcttcccttttatttataattttatttgagtcccttctttttttcttggttggtatggctaaaggtttatcaattttgtttatattttcaaaaaaccaagttttagctttgttggtatttcattgttttattagtctctatttgatttatttttgctctgatctttgttacatcctatcttctactaactttggcattagtttagtttgttcttcttttcctagttccttgaggtataaaatttagcgttttatttgggatctttctttatgcttattataggcagttatgattataaacttccctcttagaactgtatttgctgcatcctatcagtttgggtacgttctgtttttattttttgtggtctcaagatactttctgatttcccttttgatttcttctttgacccattggttgttcaggtagcatgttgtttaattttcatatgcttgtgaattttacaaaatcttcctgttactgatttctggtttcatactattgtggtcagaaaagataaagtgctgttttgtggcttaatatatgatcttatcctgaagaatgttccatgtatgctggagaagaaggttcattttgctgcttcagatggaatgttttgaatatatttgttagtcatttggtgtatggtgttattcaagtccattgtttcgttgttgattttgatctgtatgatctattcattgttgcaaatagaaattgaagtcccctattattattgtattgctgtctcttttttttcagttctgttagtagttgccttgtatgtttagatgctctggtactggatatatatatatacaaaattgttacattctctttatatattgacacttgttattatataatgaccatctttgtttcttgtaacagattttgactgaaagtccattctgtctaatttgaatatatccacccctgctgtcttttggttaccatttgattagaatgtcttttcccattcctacatttcagcatatgtgtgtccttaagactaaaatgattctcttataggcagcttataatgggctcttgtttttgctttttgaatctattcagccactctgcatttttagattgaagaatgtaatccgtttacatttaaactaattattgataggtaaagacttatgacttccactttttaaaatgttttgctattcttctgttcctttctttttctcctgctgtctttctttgtattttgatgatttcctataatcttatatttttaattcctttttgtcttttgtgtgtctactagaggttttttctttgtggttacaatgaggcttgcgtaaaagatcttataacattccattttaagttgataagaacttgacttcagttgcatacaaacactctacacttttactccccagtcaacgttttatgctattgatgtcacaccgtgcatctctttatattgtatatctttaacaaactagtgtatctatagttatttttaatacttttgtttcttaacttttactctaaagttaacaagtggtttatatacaactattacaatattctgaacttgactatatttttaactttactagggaatcttatacattcagatatttttattttgttaattagcatcttttcagttcaatttagcattaagttctaccttcagcattcttttaaaagtcagatctagtggcaatgaattcccttagccttagcttctgtggaaaagtccttctctctcctacatttctgaaagacagccttgttggatatagcattcttttttaactcttcgtttcctgaacactttgaatatatcattccactctctcctggttttcaaggttttttatggagatgttcaccaatagttttatcagggtacccttctttgtgatgagtctcttttcccttgctgctttaaagtttccctctttattgaagactttagtcaatttgatcataaagtattccctctctatctgtgaggaataaattctaagattcccagtggatgcctgaaactgtggatagtactgaatccaattgccatcagttggaacctgtttctgttcatgtcttctacaaacaaatttaatgccttttccatctttgcttatcacacattgtgaccataacttctgcagtctgaagtgcaacagcaaatggaaactagtatgaatttccattttttcttcttaatttcatgggtagaagatttgttcttaccatggatcttgggaaactcagcataccattttttttctttctttactaagtcaagagctttcacctttccacttgatggcttctctttggcatatccaaattgccagcatcactactcttgtgctttggagccattattaagtaaaagaagtattacttgaacacaaactgcaataccacacagtcaatctgataacagatggctactaagtgactaaatgactgttagcatactcagtgtcatatcctggaaaaagggataatccacatcctggacaagaaagagcaggacagagttagatttcatcactctgctcagaacagaatgcaatttaaaacttgtgaattgtttatttctggaattttccgtatagtattttcaaactgtggttgactgactgtaggtaaatgaaagcattgaaagtgaaaccacagataaaggggaactactgtaatgtgtctcagaaaaatattctctgggtgggtccttctttagattctttgagcttcataaatctggatgtctgtatccctctgggaagttttcagacgttatttctttaagccttctgtttctttctttctctcttctcctgtgactttcataaatcgcgtatttattatcttgatggtacccataggttagtatgctctctttctatatatattgtatttatttatttatttatttgagacagggtcttgctctgtcacccagactggagttgagtggtgtgatcttggctcactgcaacctttgcctcctgggctcaagtgattctcctgcctcagcctcccgagtagctgggactgcaggcgcaggccactatgcctggctgaattttcttttttctttttttaagagacagggtttcactgtgttgcccaggctggtctcgaactcctgacctcaagcaatccacctgccttggcctcccaaagtgctgggattacgggcataagccactacgcttggcctagtatgctgtctttactcttttttaattgtcattcctctaactggctaatttcatgtgacctgtctttaagtttgatatttttttcttctccatgattaaatatgatattgtagctctcttttgaatttttcagttctattattgtattcttcaatccaggatttctgtttttttttttatggtttctattttttatgaacttctaattttgtccatgcattgtttttctgatttcatttagttgtctgtttcctcttccatcccattgatcttctttaatatgattgttttgaattctttgtcagacagttcatagatctcaatttctttggggttgttactggtgcttattagtttccttctgtggtgtcatgtttatctaattctttattgtctgtgtagctttgcctttgtgtctgcatttgaaggaacaaatacctgttcaagtctttacagattggctttggcagatattgaccttctcctgtagggttcccagcctgctaggattggttttgggaccacagtcgactggaattttaactgggtcacgagacttttgctggttcttacaaggagcagagtgtatatggatcctgtctggtctcaagacagattggactttgggcagtagaacagacactagggcaagggtgtgctttagattccacagttggctccacagatggtaggcctattaccaggtatactattcggtgtctttctctccaggttcttaagagggctcccactgggtcactaggtggatccttggtcaggcagaactggtcctggactatggctgagaggggctagaactgagttagagagtgtgcttcagggtccacagctgagttcagtgtttttaggtctctctccagggtcacagacaaatgtacctcctgccaggttcttgattgggcaagactgcccctgactgcagccgagcagggctggagctgggtcacaggtctacttcaggatctacattcagcctgaggcctatttctgggagcatggataagcatgtttcctataaagtcccttggtgggcagaactgctctcagatcacagctgagaggagctggaaccaagttaaagggctctttcagcatctacagtgggaccaaagttggtgggactgccaccagggcatgaatgggcatatctcctggcaggtccctgtgtgggaagaaatgctgtcagactacaggtgagaatggctagagctgaattacagggcctctttatggtcgacagctagggctgagatcagccggtctgttgtacaaagtgcatgtgggcatgactcctccctcattccttggtggatgattctggtggcaggacaaaggccaaatggagttgtagccaagttcatagggggctgaggctgtttctgggtctgtatccaggaccactgttcataagcctggcaactgggtacaagcctgccctctcagacagccctgatcagtcttggacttcgtatctgaatccaaagctcgaaaaaggcacttttttccatagatagctgccaaattattgttctgtgggaggatatgagtagaggatctcctattctgctatcttgctgactcctagaatagttcctttataaatattgtactagatgaggtttctaatttctcagcagacacttattccaaactcctagactttcacacctaaaaatgtgcctctgaataaatatttaattttacagtatcagtttacatttttagacctatgaagtaatattagagtattaattcttcttaatcaactgtctttactaaagggggttccaggtgaaaatacagtaatgatattaaaaataccacagagcacaggctctgaccaatagaatagacactggctatagaattagagtgaggtactagagtacccttgtttcaccagaggttaaccaggcagtgctggataacagggaggtgagaggctctgtgaaggaggctggggagaaaaagaaagtgggatataaggaaattggagccccaactatttaccaacctatacagccatatgagtgcattcctgtaaagtgtatatatttatagcatccttgtgggaaatgcatttgaaaagccaagaatgataagaaaatacccttactaccaaaaaactttgaataataatcaatatttattcttcatcaaggttgctatattccttcttgaaaaaagaaattgtggtgatttcattcagagttgtttgaggtttctcaagctcaagaaaacaaaatcaaaaacacatagacttaacctggagaaaattttgcttaaatcccactattcttattacataatacttgcaatttctatctattgagttataataattagttagaacttctcccatgcttatttaattcatttgaatttttgtgatcaaagttactctacaccacagcaggagacaatctgtattttatattttagaggtcgtgagtcaaattcttttgaaagtttgcaattttaataaaataatgaggtttaataggaatgtttattttctaaaattttaaaaaataatgtatctttccattcatgaggagaaaaaaaaacataagaagtgtttctttatatccattatattaaagtataacttgcctcaaataagaaattgtgaaaaggaaaaccaaatttttggcttagaggtttacactatgtacaattgaaaagagaattctatgaagattcatattattttatatgagtttcaattattataagacattagagggcaaaaacggttttgttaattgccaaaacggatatgtgttctacaatgttatttcacctctatgttttttcttctgttttcctttatttcccttttctttcttgcatttttatctgattaaatttatttcaagtaattgtttttttttttcttcttataattctaaacaatatctagccatcaatatagccctgaaaagcacaggcttaactacattatggacaattctctggcagatcaaattttcatcacccacatttcagatctactttaaaagtcagcattaaagactaatttgagtatttttctgatttttaaaaatgctttagtttcaactaaccctcattgaattccatctgtgtatacttatgcaagattttatgggggctacaaagatagataagagaaaatgtcaggctcctagtatcttatctagcagggagcagttgctctgacatggagagaggtcactagaccacaagccatggatgatatatgtcctatgagaacaggctacattattggcttttagaggtggtccctgtatggagcttatcaagtcttagagatggtgatgagtctggtctaactatccctctcttttgtagaaggataatggaatccaaagatttcctcacccattcaccatctgccttatcttcttacattgcatgtccactacccttggtaaacaatgtacaggtttactaagagctacacaccaatgttttcttgggacacttactgcactaaccaaagtcatttttaatattgttgttgttaattatttgttccataattattatcttaatgttctttggggaaaactgcttttgatagaaggcatttaattttttttttttttttttttgagatggagtctcgctctgtcacccaggctggagtgcagtggcgcaatctcggctcactgcaaactccacctcccaggttcaagtgattctccagcctcagcctcccaagtagctgggactacaggcgcacaccactgcgtttggctaatttttttgtatttttagtagagacagggattcaccgtgttggacaggcttgtctcgaactcctgacctcaggtgatccacctgccttgggctcccaaagttctgggactacaggcatgagccaccatgcccggccaacttttttcatcttccttttggctaatataccttagggtaggtgcttgccaaggggcagacatttaatacaacacagataacatgcactctctagtatctatattttatgccttatgttctttaatgagtgtcttgttccttacaggacagttctttttactctgacgtctgtggttgtacttgtgattacaacggactggatcagctgggacaagctgaatcggggatttttgcccagtgatgaagtttccagagcattccttgcttcttttatcttggtctttgaccttcttattgtgatgcaggtaagtgtatttccctcccctcagtgaagctgctgcatgctctgttcccagtataacaaacaggatatggcaacaggctccataaatctaaataagtacagcatttacagttacttttgatggggccttctctgtttatattttcagctattatactgggagggaaagccaattggacttttataagaggggcaccaaaaatgtattttatgaacattgcaaggtgggcccctagaaaccatatagcacattggtattttctgcctaggctttagggggaaaaaaaacacactcagaaacaaaaaccaaaaatccttgtcatttagtaaatggaaagctgcagacatgaggattatataaaagcagcaaagcagggaaaagcaattgtcaaagcaactcagggttttatagcagttgaaatgaagtgatgtaaaaattctttttctggttatggaaattgttactttctttcagtattcaccagagatcattccattttcatgtaaaccatatttctgccctgcttagcaacagatttttcatacaatagcatcacactaaccagtgttactcatgtaatctggtgtgactctttggcgttttaggactattcttttgaatggggcagaaagagacactagctatttcttgctcattaaatatccatccatttgttagacattttcttattgctttcataaggcaatttttttccctcctgaggcattgtaagtcaccagaccaaagactacaattactgaaggaatactccactgtattctgaatttatgtgagatttcacaggatagcagattggttttctcatttctagaggcaaaaagaggcctttatgagagatattcagtgttgtctcaaaagagaataacagtttatttattgattttttttaaatttgttaaataatatatcttgggcattaggttcaagatggttctttgagtatattactactttaatggataatattttaaaatacactatcatttttaaaaattatttaaagaggtaaaacggaatatttttgttgcatttgaaaattgataaatttcttatttcctgaaatagcaatggaaaaaactttccaatctgactttgagttagacagcactggcaggttctagatctgcctgtcactaagctgtaggacgtcccatgggtatctacagaattgaatttttagcacttatgcaataatgtatcatgcattacttatataaaggctatttttatcttcctctatttcctaactaatataatttctcttgtaaaatgtccacattggccagatggcctactgatacctctctgaacccatcttaaagtcaatggtattagtagcccagtagactgttgtctaattgaatttgcttacattcatatatttgagagcataaattctttgattgtccattaccatcctcatgcttctactctgtttgtgtaagttttcagtattcttccaataagttcactaaaatcaaggacttcaagtgggaaaatataacattgtaatttacagatattatggattcactcaaaaactgcttaataaagacagatggaagaaagaaaggatagtcaggatttacataggcagagtcagcaaaggggaagggaaagacattctagatgaaaaaatatcataacaatgtaaaatgttaataacatgctgaagtgttcagagagtagtcagagcaccaaatgaccgacgatgaagagtttatgctgaggaatatttaagtttggaccattttggctacaagtagcaataacccggccaagctaacttaatcaaaggaggaatgtattgctgcattttagggatatcctacccaattcaagaggagggatgtagttgcctctagggacacatgaaagcagagaccagggtgtaacagggaatccagacctagcatttattttccatctcttatcttttttgtttttgccttctctttttttttctcttattgtaaaatggcctttccaggtttctcgttcaaatggaagaaaatggctactgccgacacctcagagggcaatcaccctctagctgtcaggcctgattccagatttcctaggaaggaattggagaaactcatgggctcagcatgggaggctatggtgatgaggtcatctgaaagaaaaggggagagaggttgggctataactccaaattagtaggtttctaatataaagatgagtaaaaaattagccccaaaatttaggtctcttaacttcttcttttctgtctcccctaacactaagtcagctagccaggcctactgatttatctttatgcctttaatatcattcttctttctcgtttccttgccaccattccagtcttgactcccctctatactatttaatctcctatggatcttctgccaccacacatccacgtaccatatgccctatgcagctcttcttcataaccttccagttggaaatgtcatgttttacacttctcagccctagatattgtccatgactcctcattgtccgagaggagagtccagcctctgggagctctctgagtgccctccatggtctggccctgactctgtattctcccacgtcttctatgctctagttccacccagatcaacatatttgctgctgggcatttgcccacagcatacttattccccagtgtcaggagtctcttgttcctctacagattgtgccttttctgttctgctcatttggatcctaccattggagaccatttcaactttctcttcattaaagtcatgtgatcacttcctcttcagaactcctgtagcactttttacctgaactgcaaatcaatatgtcactttttccttataactcttcatatccatggagcttcccaagcaaagtgccttacatggcaggagtaggcccagagtaataactgcttgatgaggataaagaagtgacagctaagcactgagtcatgtgcaaactgtatccctctttgtgagcatcatgtagaagttgtaggaactagtacatgtggtaagagagttaatttaaggaaacagagccccagaaagcatatgtactcaagacatttgaaaatatataagacaaatatcctaacaagttcacaaccaactaaactgtgttctaattcatcccatatttacatattccagatgaaagaaaaataaagaagtaaaattagtgtcactgaaacacctgtccttattagaattatttaaatgatttgaaagcagtcgatcctaggttctctattggtaggaaaattccacttatactatagaaaggtattgtattttttttttttctgatatggagtttcactcttgttgcccaggctggagtgcaatggcgtgatctcggctcactgcaacctctgcctcctgggttcaagcgattctcctgcctcagcctcccaggtagctgggattacaggcatgcaccaccatacctggctaattttgtatttttttttttagtagagatggggtttctctatgttggtcaggctggtcccgaactcccaacctcaggtgatccgcccacctcggcctcccaaagtgctgggattacaggcatgagccaccgtgcccagctggtattgtaatttttttttaaaagaaaccattagaatttggtgctacttttgtaaagttctttttattatttttaataaaattagcaggccagttctgaatacttttagagaaagtaaatcattaatttttatagatatttactaaataggatttttctacctttattgttgtatcacatttttctgtggttttagtaaactcactagaactagggcataaacagataccagcaaagtgtaacgtgactcacacatgctacgtacaggacacaagaaataaattgtagagaaaacattcttctaaggaaaactttatctcagtttctgttaagtatttgtaattatgtcatttgatttatatatatccctctatttctttgcataagtatttgacttgtagcatatcccacccaccgttcttctttgctaggttaaggaaaagattcaggtaatggataccctaaaagtgcagacttcaccactacacaatctatccatgtatgaaaattacacttgtaccccataaatttacacaattttttaaaaaagagttaaaatatgtttgtaaacaaaggaaaaaagtgggacaaatggagcaaaatatccaaatagaaccttccagtgatcgtccccctataggagcatgaaagttaacaattcatataagaaagcacctccataagaaccaaaaatcagatgaatgatcacagtgcttggttttaacattatattaggaaagaggcactgaagagggtaagagagacagtcttgaattgctgatacctctcttcccccatcccccagcagtggccacgtggcacagaatctatgtgcttaggggagggaggagagcacagtgactatgggactttgcattggaacttagtgctgcctgtcatagcagaatgcaacacagggcaaaattcagctggcacacatagagagcatctagaccagccctagccagaggggaatttctggtagcctcccaactgcaggctaaagtgctttgggatcccaaataaatttgaaaggcagtctaggccacaaggacttggaatttcttggctagtccttgtgctgtgctgagcttggaggcagtagactttgtgtcatgcgacctagtgagacaccagccagggtggccaagggagtgcttgaaccactccttcttcaatccctagtagtgcagctcacagctccaggacagactcctttcctctgcttcaggagaggagagcagacagtaaagaggactttgtcttgcaacttggatactagcttaccacagtagaatagggcaccagagagagtcctgaggcccctatttcaggttctacctctggacaacatttctgggccagaagggaacccactgacttgaagggaaggactcagtcctggcaagattaatcacccattgtctaaagggcccttgggccttaaatgaacataaggagtagctaggcagtactcactgcagccttgagtgacatccagagccatgttggtttcaggtgaaacccaaacatccccacctgtggtggccatggcgagatattccttctacttgaggaaagcagagtgaagagtaaagggaactttgtcttgtagcttgggtaccagctcagccgcagtggggtagagcacagagttggctcctgaggttcctgactccaggccttggctcctagatgacacatctggactcatcctgggccagaggggagcccattcctgaaaggagagagccaggcctggcagtatataccataagctgactaaacagccattggatcttgtgtgaacatcagcagtagccaggcagtacttgccatgggcctggggcagtggtaaccatgaggaaagactcttccttcttgacattggctttggcaaagaatttatgacttaagtccccaaaagcaattgcaacaaaaacaaaaattgacaagtgagacctaattaaacaaaagagcttttgtacagaaaaagaaataggagagtaaaaagacaacccacagtattggagaaaatatctgcaaactatacatccaacagaggtctaatatctagaatttaaaagatacttaaacaactcaacaagcaaaaaacagataatcccatctaaaattgggcaaaagaacatgaacagacacttctcaaaaaaaaaaaagacaagcagccaacaagcatatgaaaaaatgctcatcatcactaatcatcagataaatgcaaatcaaaactgaatgacataccatctcacagctgtcagtctgacctattataaaaaagattaaaaagaataacagatgctggcaaggctgcagagaaaagggaatgcttatgccctaatggtgggaatgtaaattgttcaaccactgtggaaagcagtttggagatctctcaaacagcttaaacagaactagcattcaacccagcaatcccattactgagtatatacccaaaggaaaagaagttgttctaccaaaaagacacatgcacacatatgttcatccagcctaggtgcccatcaacagtggatcagataaagaaaatgtggtacctgaacaccatggcatactatacagccatgaaaaagaatgaaatgatgtcctttacagcaacatggattcatctggagaccatcatcctaagtgaattaacagagggacagaaaaccaaataccacatgttctcatttataaatgagagctaaacattgagtacaggtgaacataaaaacaggtactacagacactggggactactggagagggtagaagggaagaggggaatggaccgaaaaactacccatcaggtactatgctctctcctgggcaacagggccatccataccccaattcttagcatcacataatatacccatgtaacaaacctgcacttggaccccctgagtctataataaaattggaaattattttaaaaagaaaaagaaaaaaatggaaagtagatgataaacctagcagaaatctactcatatttctatatcaataaatacaaatatatgtgtgcctatatacatagatatatatgtgcaggtgtgtgtgtaatatcttagatttatgtgcatcaagttcataacagaagctgaatagaggagagactattaaaaaaagaaagtttcaaagatcaagttttggatccttatactattgatatctttcaatacttctgtctcctgtaatttatctaagtacctgcttgtcacctgtgtacatacatacctcctataatgtgtaagctccttgaggagaggaagtgttttatcaattttttcattcccacagcatgattagtgcattgcagttttaccataaatattttgctttgtgaaagagtaaaggaattaatgtaacattatttcacatgcaccaaataatgtgatttttcaagaggtgaaataccagcagcaggagaatgaactatcaataatattacatttggtcattttcactgaagtatgatcttacagtaattaactatctaaatataaatctgaataaattgtcgttaggtgttaaaaagcactctgtggtatagtcaaaaggcacttggagagaagtgatatttcctgaaaagcaattgttaatgcactgaaaaaataatcatgaaaattgcattccacaaacatttcaccatgtaacagatttgaagtgtgtttgtattctgttttgtgcgtggctctaagaagtaggttgactactttaaaaatagacattgtgactcttggtagactttattttaaaaccccattgacctgacgttagtagagcatttcttttgaggtcacagttgtggaaagtggattcagtcatttcagagcatatggcagagcaacaagcataaacctatgttaattaaatagtcatggtgttttaacaagttggaatatattttcaagataagttattccaactgattacatttacaggctacttagaaagaaagatttgtttaaatgtttgtccactagatttaacatctccttgagctttgggagtattttctataacttcttcaaactattttaagttcctctttacatgtgtttaacatcttcatttttccttactaaaggaaaaatactatttgaaaacacaatagtgctggcttctgttatagggtcccaagtggtgacgtggaataaagggcttatcacttaggtaatacctggattaaccataaatgcctactctcctcatggtatgtgcttaagggattaaatctcaactttatttactctcacttccctcattactgctagtacagcggggagacagagtgttcagggagaatcacggaggaggactgcatcatgtttattagcagtcctggcaacagacctccaaatagtagacagacttaacacggtgagtttgtccatacagaaggaaggagtccagccaagtgggtagtctgcatgaagtgccaaggaggatgtcctaacaggtggcccatggtatcagaggaatttggcagaaggtaatagtgagctggaagcattgggtttatcaggcaaaaacttttaggattcaatcatgggtactggagtgacaaacgcattcacttgaaaatgaaactaatggtctggttagcatatgatatagatgacagttgaaactgatagtaaattctgtgagggattatcgtgagcgggagagatcactcaggtttttatgtataacatggaaagaatgtagtttgaaggaattataagatttggttaagtaagtggaaaatagagacattcaagttttatcccaatttaaagtaaaatgcttcagtccctggggtattcgtttaaaagagagctagaacatgatttaaaaaactggaaatatataaattctatactactgcagatgggcaggaattttttcaaagccatcctgaagcagcaagatataactcatttgcatttgtctttttccaatgaatgtgctttttcttataattagagcttgaccatcgctctgaaaagaatatttcagccctatccctcactctcatctttgcatgtgtgtcaaggttggccctggaagtcttgtgtagtagttgctacttgtcattgtctcacttgtacccagtaaaaaaaagtgcagcattgaagactgacacattcagccatgctattggcacccaaactcagagcactgctgtacttcaggtcagaattgtataggtgatgctaaatgcaagctatggtgcaagcttttcctagatctgatggactgattctttgtaacttttttttttttttttttgagacagactcttgctctgtcgcccaggctggagtgcagtggcgccatctcggctcgctgcaagctccgcctcccgggttcaccccattctcctgcttcaggcttcccagtagctgggactacaggcgcctgccaccgcgcccggctaattttttgtatttttagtagagacggggtttcaccgtgttagtcaggatggtctcgatctcctgacgtcgtgatccgcccaccttggcctcccaaagtgctgggattatagacgtcagccactgcgcccggcctgtaactatttttaatggatgctgtcagggatatgaagtatttctatgggctcctctatgagctttttaagttacaatgataaagctaaggaacaaattacaaaagaactttgtaggcaatggaatcatggaagccagtataacaatcctctataattcagagcattcattttaaactcatgcctaaaataagaaatgaaaaagagctattgttagaccgacaagttcattaatatcatgaagtcatgaaattttagagcaggaggaaaatttaggatcactttttcatatcttgagttttacagctgaagcccagggaggttctttaatttgcctaaggtcataaagtcagtcagtggcaggacctgatgtagaagctgggtcttctgaacctctacccactaccccaacgggcagtttctaagtcaaggtttattaactctggagttggacgtgaagaggcacgttggagaatgttgtccaagaggctcagtgtcaagtctagttagattaaatgtggaatccagtaacaggagaccatatgagaacactgcacagtgaaatgaggaacaagctactaagatgggcagaatggtgcaatgaaaacactactggactaaaaagacaggagttgagggagggaagaaggcagaaaaactaaaaggccaacattcattgagcacttaatatgtactgggcactgtcctggatgcttagatgtactttatttcatttaatcttacaaaaccttccaataaggataatattattaatattatttataactttacaaatgagaagaaaatgggaatttcctaaggcacacagatacagtctggattcagcagaatgagaattaaaaaaaaaaaaaaaacagatctgtctgacttcaaagaccatactttttttcataacttgttttactgttgtgcatataaaatgaaataatatgctgtatacaaagttgaaaacaaagcacattgcaggtgataggaagtttagtgaatgacgggaacactcttgcaatagactaaagtcagggctgcatagttcttagtggcagtgtgaccttagttaagtcagcttgtttctaggaatccacttttctcgttgatagcatgacagttttttccttcctcttgttacaagatttttttgtgatggtcaattttttttaaatgcttgaagtatgatgtttttgcatgtcaaaagtacataatgtggatagaagaaaattaatttagttgaaaaatgtttcagtttttctttgaattacaattgatcattcagacctttggttttaactaagaaaaactatagtaatatgacggtatataaagaatttggagtaggagaaacaatgtagccataacctacaaatagaggcatactctaaggcagtgattctcactgttatctgatgataagaatcactgggggcagggcacagtggctcacgcctctaatcccagcactttgggaggccgaggcgggtggatcacctgaggtcgggagttcaagaccagcctgatcaacatggagaaaccccatctctactaaaaatacaaaattagccaggtgtggtggcatatgcctataattccagctactctggaggctgaggcaggagtatagtttgaaccctggaggcggaggttggggtgagctgagattgcaccattgcactccagcctgagcaacaagagcgaaactccgtctctcacaagcacacaaaataatcaccggaacctttacagagatgtgagttctctggatcagaagagctccaggagtttcttgtttagtaagtgggtaatggtgcctgggatatatgttcctttaaatcattacagatgattcttgcaatcatagttacctgcattagaagcacctgggttctgcttaaaaatgcagattcttgggtcttcctcttacatctagtagtatgagaatcactaggggattctgcctggaaatacgagtttaaaattagactatgatttctcagctctcatgtaactctggtaataagtgaatgtttgctattgctttgatcagatggctgtacatgacagaactgcaagaaaattctaaactgctagatgatagtctcagtttattgcatttgaagatgtttggggaattgttcagaattttgaatttctcctataaaactatatcactactgttgtgtatttgtggaaagctgaaaaataaaactaaatatattctggatacatttttctcaatttttatgtgagtatatatatatatgtatatacatatatgtatgctgaaaacgatatttatatctgagagattaccgtttgttcaacctttgatttcagtagctgagtacattcatttggcaagtcgaataaggtctaaagcagagaaacagcaggaaatcaaggaggtacatatatctcagttttataacaaaataaatttacacacaaaaatgtgtctagaaaaaagataagtagttgtttataatcccttcctgggccttctaaagagggtgaatgccaagaaagatcttttgttttaatgaatagggtggtgggtgtagatgcaaactggagaagctcaggaacctaggtgagtattcctgcctatgcagaaggttgagaagacttgttatggggaaagaaagagggaggacgtagagatgacagctgccacagccaacagaaattgtaacagagaggattttcaaaacaattttgctgtattatacataatgttacatcttacatccagcttcagcttcccaataaattttcagttaatattaaatatatatatgtatatatatatgtatatatgtgtatatatgtatatatatatgtatatatgtgtatatatgtatatatatgtatatatgtatatatgtatatatatgtatatatgtatatatgtatatatatgtatatatgtatatatatgtatatatatgtatatatgtatatatatgtgtatatatatatgtgtgtatatatatatatatatttttcctcccattcttttggcatttgatggccaggtcaatcctcctctttacatgccagatgggtttctgggcaagagccaggggaaggaaaaggtcatggaggccaaggtacattatttttcttaataatttcaacttttattttagattcaggaggtacttgtgcaggtttgttacatgagtatattgtgtgatgctgatgttgatgaatgatcctatgaatgatcataggatgatgatcctatcatctatggtgtgcatcatcctatcacctaggtagtgagcatagtacccaataagtagattttcagtttttcagcccttgtcccttcccttccctctctagtaatccccagtatctcttgttgccatctttatgttcatatgtacccaatgtttagctcccacttataagtgagaacatgcaggatttggttttctgttcctatgttaatttacttaggatgacggccttcagatgaatctatgttgctgcaaaggacatgattttttctttttcatggctgtgtaatattccagggtgtacatgcatcacattttctttatccaatccaccgctgttgggcccttagattgattccatgtcttttgctattgtgaatagctctgtgatacatatgtgagtgcacatgtctttttggtgatggaatgatttattttttattgagtatatacccagtgatatgattgctgagttgaatggtagttctgtttaagttccttgagaaatctccaaattgctttccaaaggggctgaactaatttacattcctaccgtcagtacataaacattcccttttctctgcagcctcatcagcatctgttatttatttttataatagccattctgacagatgtgagatggtatctcattgtggttttgatttgcatttctctgatgattagtgatgatgagcattttttcataagcttgttagctccttgtatgtcttttgtttttgagaagtgtctgttcatgttcttttgcccacttttagatgagattatatgtgttttgcttgttaagttgtttaagtatattacagattctggatattaaacctctgttggatgcataatttgcagatattttctccaatactgtgagctgtctgtttactctgcttttcattttgctgtacgaaagctctttatttaattaggtctcacttgtcaatttttggctttgttgcagttgcttttgaggacttagtcataagttctttgccaatcctgttatctacaatgttattttctaggttttcttttatgatttttatagcttgagattttacatttaaatctttaatcccatcttgagttagtttttctatatggtgaaaagtagggggacagtttcattcttctgcatatgactatccagttatctcagcaccatttattacatatggagttctttccttattgcttatttttgttgactttgtcaaaggtcagatggctgtaggtgtgcagcttgtttctgggttcacttttcagatctattattctgtctgtctgtttttgtaccaatatcatgctgttttgattactgtagccatgtagtgtagtttgaagtcaggtagtgtgatgcctctggctttgttctttttgcttagcattgctttggctattcaggctctcttttggttcaatatgagttttagaataattttttataattctgtgaaaaaagacattgatagtttgaaggaatagtgttgaatctgcagattactttgagcagtatggacgttttaatgacattaattctttcagtctatgagcatggaatgtttttccatttgtgtcatctctgatttttttcagcagtgttttgtagttctccttgtagagatattttatatccttagttggttgtattcctaggtacttttttgtgtgggtgggtattgtaagtgagattatgtccttgatttggctctcagcttgaacctctttggtgtatagaaatggtactgatttttatatgctgattttgtgtcctgaaactttactaaagttgtttatctggtctaggagcctttggcagaggctttagggttttctaggcatagaatcatattgtctgcaaaactgagatagtttgacttgctcttttcctattgatgcgttttattctttctcttgcctgattgctctggctaggacttccaacactatgttgaatagggttggtaacaggatccttgtcttgttccagttctcatggggaatacttccagcttttgcccagtcagaatgatgttgactgtagattttttatagatgactcttatttttttgatgtatgttccttcaagggcttatttgttgaggttttataatgaagggaggttggattttatcaaaagccttttatacttctattaagatgatcatacagttttggtttttaattctggttttgtggtgaatcacatttatttagttttgtgtgttgaaccaactggcatctcaggaataaagcctacttgattgtggtgacttaactttttgatatgctgctggatttcatttggcagttttttttctttttttgaggatttttgtgtctatgtttatcagggatattggcctgtagtttcttcttctttttttttttttttttaagacaaagtctcactctgtcgccaaggttggagtgcagtggcgcaatttcagctcactgcaacctccgcctcctgggttcaagggattctcctgcctcagcctcctgagtagctgggactacaggctagttttctttttacattgtgcctttatcagtttatggtatcagggtgatactagcttcatagtatgagttaggcaggagcccatcctcctccattttttgaaatagtttcaatagaattagtacgagctcttctctgtacatgtagtaaaattcagctgtgaatccatctgatccagagcttttttgtatgtaggtttttttgactaattcaattttgtaactgggtattggtatgttcaatgtttcaatttcttcctgattcactgttggggcttgtgtgtttccaggaatttatccatttcttctagagtttctagtttgtgtgcatagaggtgttcataatattctctgagaatcttttgtgtttctgtggaattggttgtaatatcacctttgttgtttcaaattgcacttttttggatcttctcttttatttgttaatctagctagcagtctatctgtcttgtttcgtctttcagagagccaacttttgggttcattgatgctttgtatggattttggggtctgaatttcattcaattctgctcttattttaataatttcttttcttctgctagctttggagttagtttattcttagttttctagttcctctagatgtgataccaaactgtaaatttgagatcttcctaacttcttgaagtagatgtttagagctataaattttcctgtcaacactgtttttgcttcatccaagagattttgctatgttgtgttgactgttcgtttctttcaaagaattttttactttctgccttaaattcattgtttacccaaaaattgttcagagaaaagtagtttaatttccaagtaattgtgtggttttcagataccttcttggttttgattttatttgtattccactgtggtcagagcatatggtgggtatgatttctattttttctaatctgttgagacttgctttatggctgagcactattgtgtggtgggctaaggcttttcatagatataggagtatttgtattattaatgtgggtgctccgatgttgggtgcacatatacttaggattattaaatcttcttgttgaattgaacctttcatcattatataatgtccttctttttcctattttattattgctggcttaaagtctgttttatctgatataaaaatagcaatgatataaaaatagcaacccctgttcttttttgttttccattttcatgatagatctttctttctccagttctttactttgagcctgtaagtgtcatttcctgtgagaggggtctctggaagacaggagacagactttttaatccagtttaccactctctgtgtcttcttagtgaagcatttagactattttcactcaaggttaatattgtcatgtgtggttttaatcctatggtgaaattattaactggttgctttgtagttcctgttatataattgctctatagggtctgtgaactatagacttacatgtatttttgtggtagcaggtattgttattttgtttccatttttaaaattcccttaaggacctcttttaagcctggtctaatggagatacattctcttagcgtttttttattgttgggggtgtctggaaaacattgtatttttactttgcttataaagcttagtttgatgggatatggaattcttggttgaaatttctttcccttaaggatgctgaaaataggcccccaatctcttctggcttgtaatatttcagctgagacatatgcttttaaattgatgggattccatttgtgcatggtctgaactttttctctagctgcctttaagattttttctttagcattgtccttgggcagtttaatgactatatgccttgatgatgttctttttgtatggtatctcacaggtgttctctggatttcttgttcctgggtgtctacctctttaaaaatactagggacactctttgtactattgcttcaaatatgttttccagattgtttactttttctcctcctctctcaggaatgccagtaatttataaatttgtttgctttacataatcccatatttttcagactttgttcattaaaattttttttctttattttagtctgacttgattaattcaaaagactagtcttctagctctgtaattctttttctgtttggtgtagtatattgataaaaccttcaattgtattttgaaattctttaattgaatttttcaatcctggaagctctgactgattttctttaaagatgtttatctccttcttcatttcctggatttcttcagaaatttctttttctttttctttttttttttttttttggctttcatccttgtcttgaatcttgttgagcctccttgcaatccaagctttgcattcttaatccgtcatttctgagtgtctgttttagtcagggaccattgctggagatctagtgtgatcctttggtggagtcacaatattcagatttttcatggtatgagaaaagttgcactggttctttctcatctggagacactggcacttctaatttttgtaattattaatattttcatgtgaataggattttcccctttctttccctattatatatatatatatgtttttttttttaatttttctttgtttttctccctagtgggtgtaactgtaaagaatgttggctagggtcttttggctttgcttcatttttttgtttttgtttttgtttttgagacaaagtttcacacttgttgcccaggctggagtgcaaatggcgcaatctcagcttactgaaacctctgcctccagggttcaagcaatcctcctgcctcagcctcccaagtaggtgggattacaggtgcctgccactacacctgactaattttttgtatttttagtagagacaggatttcaccatgttggccaggctagtctcgaactcctgacctcaggtgatccaccagcctggccttggctttgcttctatagccctatgcacttctgtcagctggttttatgttggactgtgtggttctacctacaggccagtagatggcacttatgggtaaaagtcagctctggccaacgtgaacgggtatatatttcaaccttgtttactgggaggtctctgatgctgcaggcaatgggctgaactgtttagtgcacagtggtcttagctccctactcaccaccacatgagggaaccaagagagtagggcctggactgggcaggctcacctacagccactcaatggcaggtactagcaccagcacctaatgcgtggccacctagcgcccagaggtatgtctaggcatggagcttggtaacctgcttggccctaagttctctgcatggggaggggtgacggcccgaactcctaatccagtagagtggatgcacctggagatcttcctgggcatgtagcatagggggccgtactgcaccacagtctctccacagaaagtgtggggcaactcaggccactgacccaggcaagggggtacttcagatgcctggagatatgcctaagcatggagtggagagggtcctgttacatcacaatctatgcacaggaggggtgggagactcaggctgctggtccatgataggaagtgctctgattgtctggagatctgcctgcatgcgtggaacagaagaggccctgctacactctaatctatgtacgttaaggtgagatggctcaggctactagtccaggagagtaggtgctctgaatacctggagttctgcctggatgtgtagcagagagggccctgctacaccctaatctatccacaggaaaggtagggtggctaaggttgctgatccaggcaacagggtgctccatctgcatggagatttgcctgggcatgaagtggagagaatcctgctacaagccaatttatgcacaggaaaggtggggtggctcaggctggtaatccagaagagcaggtgttctcaatggccagaaatctgccagggtatggagcagagaggaccccactgcatcccagtctatgcacaggaagggtggggcagctcagcctactgatccaggagagtgggtgctctgactgcctaggcatggagcagagaggtctctgctgcaccacaatctaggcacagagagggtgggatgactcaggatgcaaattcatgtaagtgggtgctccaaatgcctggaaatctgcctaggcatggagcagagagtgtcccctgcaccatgatctcaggtgagcaggatggagctcccagcaaggtcacacacaggccatttccaggtggccaagctaggcctggctacaagtctcattgctcaagagaaactgtcgctgtagcagcttccctctcaccctagaactacacacggggagcacaattccagcacctacaactggggcactgtccacacgcaccattcaattctggctatggaggcctctactcagcaccagagcaagctctgcaatctctgatccaagactataatgcctgcatggccatgctgctgggttgtcaaagaattactgactttgtatgcacctggattaaaaatggcatcctgctctccatcctgagtctgggaaaatgcctgcaggaattcctggtatcttttcctctcaatgtccccaagcctcaccccaagctagtcccaaggcttgggagaaacaaaatgctctttcttgtcctgggttgcatggatccccattggaaaagtgactcacagagggaggctctctgcccaccccctgttctgggtcttcactcacttttatttaccaaatgccttcccaggggctgcttgcccaccttctcctccctggggtctgggacgtccttcactgtcttaatgggttcccgttttcccttttgaattaaaattcatgcatttgaattaaaatgtatgattttgctgtttccaagtggctaagacacactgcaagcttctaatccgctgtcttggaagaaaaataatgcattttctgatgacgtaaatacaaaagtgctaagttcttacatttattaaatgagtgtagaaataagatctggtggctgcattcactttgtcttctgactaccagttaattcaatatttaaaattcattctttggttttcataaaattacctattttttttcttggctcaaaacctaactatatgtctctttctttccagtccagtttgtcaaatttccttcctctagctgtccattatacatactctgtgattctgccctgtgtttccttatcttctcatccaagttattttttaaggcagttctgttcactgccatggcctaacagcctcccaataggctagtctttctcaaatcttcctcaagccctaagacttctgctgaatttcagacctggatatctaactggcaaccagctctatccacctggatgtttacgtgggcatctctggttcatcatgtctaaaaccaagctatcatcaacccttcaaacagttatctatccagtcactcacaccaaaaaaccttttaaaaatccaagatttctctttcctacttatcttccagtcagccatcatgcctatatattcttcttgccaaatatcttttgaatctgcccctcctttagactcttatcacctataccttacagttcatgttaccatcaacttttgcctatattagtacaaagccctttctcttcttttggtcttactccattattccaaagtaatctttttaacaccaaaatcttatcttcaaaattctttaaataataattcatttgcatgtcatctatacaaggccttttatcatctagctcatgcctagcttctgaccttctcttcctggtcattatcaccaccttccctctcctacccccacctcttgcattttacactctattaaattttgaaatacttgttgattaccgaattctgcctttttaaaatagtacagacctttgcatgtgcaatacaagggcatctccccagtgtgcgtgcttcactgccctcagccatccaaccctcagcttatatgctgtcctctctgtgaagtctcatctgcctctctcaaataaactttagtgcttcttttattatttgttcatggcaatttttaaatatttcgattagagttattttactcttccatttaaatttgtttggatgtatttaattgttttactaaaaagttgtaagaattgcctagaatagttcacgtcagacacagagaatattcaacagatgttggctgaatttagaccagcacctaaactagttcctttcaggtcattgggactcaatattcacattttaaagaaaagattttagagtattctcaactgggagcaattttattttttcatttctttagaatttcggatcaatgtacttgtgtgagctatttttaagataaattttctatgtgataattgtatttgaattgatcagaaactgaaagatttgttttacagggattatttaaagcctgttgacattagacaattcctgcattaaatttactgtaagctgtaggagtgtttatgatgtaattcacttttcatagtattttacaaagcacaatcatcatagacccagagtagattgtttgtgctgactcctttatacatctctgagcccagcttttcttctggtaactcttttagttgaaatgggtatcctctatgcgtgccattggcatatctcctagagacagctgcaaagagtagcaaaatcagggggtatgattgttcttccgtgtattatgaagcaagctaggaaaattctgaatgcaaagtcaccaggaagagattctgaacatggcagaccccatgttgtctttcctaatccctagaagaaggaaaagaggtaaaaatattatgataaaatctggattcattttgctactgccgacagggatgaatctggtgactcccacccagaggtgcttccttgagaatggagagatggaaaattgcaatcacagactttcacattaggagtaaaaacttatattatgatgggtgaaaaaactatgcctaacgaagtacaacttttaagagctcataaatcttgagctcagtcatagattattaatttagaaaaataacaactatgtattctcaactgcaagctactcaatattaataacattagtgtgtattgtatatccagatagagaatcactaaaggtttcaagcttagtggcaaatgtatctttaaatatgcatttactatgctctctgtaataaaatgaaaatcatggtttatttgatggaaagagaatgatagtttgtaggctttcacaataaaatgagagaacttgaaacagggattctcataaaatgagatttttttctaaactggaaaattctctagccataatgacctgggtagggatgggagaaagagaatgaagtgtaacaagggcgtaatttcatttgaataaaaggaattggcgacttatgtcagagaagctatgttagagatatctaacggccaaccagctctgtccatggatatctacccagatgttgttacttcgtagcatggctcgggtattagttctctctgcatctgcgtggtgagtagctctgagacatattcttttgacctctaggattccttaggtcataaagtgtgtattttctgacctaacgaggcaaaaatgtaaatgaatgatagaacatctttttaaaattgattcccagagatctagagtgtttatacaccctctctgttttcttctcagagttgcagaaagcttcatttcgctactaaaaggtttcctgattcccttatctatcagtaagagtaagcccaattctaaaaaatgtttttagaaaattactttcatctctgcatggcctggaatttgcttgaggacaccatgaatagtaggtcatcaccactacatttcaggaaagagagccaatgtaactatttttgaacgtctttgagatatggtttaaaactatgctataaaaaggaacttgcaaatctaattaatatttaattttagtctcacgatgcaaagtaacctacatggacattttaatgccaaactgccagataggttgtaagaatatactgtacactcacaccaatagtgactggaaatacctggtatagtaggcagaataatgtgctccccgctggccggccccccaccaaaaaagatactcataccctactcccaggatcctgcaaatatgttaagttgcatggcaaagggggattaaggttatactagaattaggtttgctaatcagctgactttaaaatgggagatttccttaaatttccttatccaggagggcccaatataatcacaggagtctttaaaagaggaagagggaagcagaagacaaccagagagatagcagtgtgagaaggacttggccctacattgctggctttaaaggtaggagtgaaggccataagccagagactgtaggtgacctctacaatcaataaaaggcaaagaagcacattcttccttagagcctccagaaggaacacagccctgtcaacaacttgattttagactagtgagacccattttgaacttttgtcctctagatctttaaaataataaagttctgttgttttcaggcactaagtttgtggtactttgttacagcaggaataggaaactaatacacttgattttctccacatctttcccaacactgagtgttaactgattttttaaatcttttgctagccaatagtcaaacataccctattgctctttttttattattattagttagatggatcttatttcctctattagatgcttgatgaatattcatattgttttatgaacatccagctcacgggctcatcctatttctttattgaggttttagggttttttcttacccatttgaccatgtagtatcacttttgctgttggtacctgctaaaacattaagaaaataacttattgttttatcaggaatttatgatgaattttatagagcacctttttacattctaggtaatttcatgtgctttctttaagtatgttttctactttgaactattaatgtaacaaactttaagaatagatttcttaccttatcccaaacttacattactacggtgtgtcccactttgtggtactgcattattcttttaagatacttctgaatccagttttgcatctatatttataaatgaggtgtgtgtattctttttttcctgcaatttttaaaatcatggttatgttagtcttataaataagctgaagcccttctgtcttttgctgtgctctagaaccatttacatatataggagctatttgtggtatactctatttttttcctgcctcattactgatcctctttcttcacctcattttgacatcatttcaataattttaatggtatttagagagaaaagagaagtaaatatagtatctcaaattgttatcttgaggtagaacctgccccatcttttaaaatcagaaagcttttgcattcttgagccattctcatataattatggaaggaaaaggaggtgagacatatgaaaggattgctttggagagttgttggcaagttgacttctgcttgcctgtaatttcattaatttcttttctttccccttcttttcctatgatgatactattattagtagtactattttcaccatcttcaatatcattactatgctctataacatattagagcctgtttacactgcactaaattatagttaatcctttatactgtaaacttgggctgtattaacggaagtgtccagggtaagggaaatgataacttcatgttactttttcatggtcagaatatttcagcagaattatgttgagttcagggtactacattaaaaatgtgttgacattttaagtaacaaaaacattacaggttctttgggaaaaaaaattgaaagactaaatagtaaaaaggaaacaaaaatgaccctgatacaaccttatggataaatccatcattctaggcttcaatctgtgcacataattcatatatatttttacaaaaatagaattatcttctatgttactgttttgcaaacctgctttttcaggtcacaatatgttgctaacatttctcatgtcattaactattctttcccaagatcattttaatgaatgcattgtaattttatctgtaactgtattaacagattctctattgttaaatatttgtttccattttattactatttatggtgcagcaatgaacaagatatggtgattattttcttgagataaattcctggaagtggaattgttggttgaacattatgacttataataagctaagccaaatttttctctagtggttatttcatctctcattccatagtaagagtaaaaaggcaaccattccttaaaccaacaaagaggactgtatttatattagtagtttccaatttgattgacaaaaaagaatatttcattttgacatgcatttctttaattacacatgtccatgatctctagttcaatgattcttttaaaatttggattttgtttagatttttagcaaggtaatatagaactgcatattgtacaaccacctcaggggacctgagatttaaaagctttaaacaaacaagccccttcatctttctacagtgaaaactatgaatatccacactaagtgggggcagacattggccattcatattctcccttattatcaggttttgccatcaggtccagttcagttttgctgctgaatgaatgatgaaaaatctttattttcagagcttttctatttcaaaattgaggacaagggacgaaagatgtgcagtggagatattttttctcaactatttatatttatattatttattatattatttatagctatttatatttattctttttgtgaattggttgttcacatcctttacataattttatcttaggatggttaatatttttctcattgtcttgtaatagctccttgcacattaaagaaattaccccttttcctgttatatatgttacacatatttgttctgagttttatttgttgagattgtttacaacagttgttttcaagattgaatctacccaagaatcacctgatatgtgtgtgtttatgtctgtatgtggtgtggagtgggtgtgtccatgcgtgtatacaaattcttgaacactgctcatagaaaattttatataaaacatataaaaaaggtcaggatagaactctggcatgtgaaggctgggtgcagtggctcacgcctataattccagcactctgggtgtccaaggggggcagatctacttgaggtcagggattcaagaccagcctggccaacatggtgaaaccccatctctaccaaaaaatacaaaaattagccaagtgtggtggcgtgcgcctggaatcccagctcctccagaggctgaggtgggagaattgcttgaacctgggaggcagaggttgcagtgagccaaaatcctgccacactgcactccagcagcctgggcaacagagtgagaccctggttttgtttttgtttttgtttttgttttttgttttttgttttttatttaaaaaaaagaaccctggcttctgaatgttagaaagcccaaatatgttattaatgcagaaatccatattttaatttatgagagggtgtgttcaacatacagttgttttaaatgtatcaatctttttctttgtgatatctgctttttatgttaagctgaatgttctgtgtttcaaatgagacagtgaagaactggaaagtgtgtccagagaccaacatccaggatcttgagagacctagagaatgatattagaggactgatggaggaaagggaggtgtttagcttgaagcatagactttcagtaggaacatgctctctaccctcatgtatttgaaagactgtcatatggaaaagagaatgtagctattctatgttgcatcagatcatatgaagagcaatgtgctgaaattcagggcatcaaatccatcttccactgtgagttttcctttataaaacagctctgatcatatcactcccctatttggaaaacttctgtggcttttgttgtctttaaaacattcaatgtcctatgaggccctttgcaatccaggcctcattggggaacttcaccacactattcaccaaatgtgtcgcccaaatgaatggttctatgtttcttaaaattcagtaggttcacactgtcctccttttcaaactgtagagtttcacaggctacctatatactgaagcctccttctttctagcctgagccgtatgttaagctctagtcaaggcggaggccttggaagtcagtttctcaacagcctctctgcagaatgtcaccaatttgacctaatacaaaagataagtcattaaaaaacttgataaagtacttatatttgtatatatttacctatatttttatgtatttaatatttattggctatactgtaggtactggggctacaaaggtaattaaatacatatcctctcttctaagaaccttaacatctcaaaaaaaaatgaaaattcaataggaaagattagtgaatatttaaaaattgaagaggtgattacaactctgtaattcatatttcagccattgttgaaatttgaatgaatttatagtacattcaggtataaaactatctttggtaatacagtgtttaggaggataaataaaaggaaaagaattaaacttgtttgagttgtgtagaggaataacaggattgtgtttggaatcgaaatgcataatttttgccaagatgattaagtagaagatgtttatgattccattgaaaatttgattggtgttatacagtatgttaactaaaagacacactcatttttacttgctcaggaatccttataatgttcattaaagtgcctgcatgtttttgcataacaaaagagaatgtgcatagttaaccaccgaacatcttgggataataaacattttatatattttaacatctgttatatttatgtttcattctggccattaacggatagttttaacttccatgactttttttttcttattgttacatagaaatatgaagcaggagttctagtttttctagcaatcagttactcaggtgtattgcatattgcatttagagtcagtcctttcagatataagtgtgctgtgcaggaaaagttccgagtcagtaagaactccacagttgccaagatcagaagcccctaatattttaattccatatctccacacttcctgagctggctagtgagctgtcatggaatgcccattaaggaaaatgcatcccaccacattacatactgtgacttaaacatccagacccaggcctgaacttctgtgacggattacaaatgtgtttttctctatggagcggtgagccagttaagtaatttgtaaatagtgaacttgtcaaccaaatgtggcttgatgttatctctagttgatcaaaaaccctagctttttctccagttgattaatgacccttttattctttcactatggaacattctaagagttgatactaattgtattagttatggctgatttcctttggaagttctaaaacagtgcataaccctctagaatatgaactccttgaaggcacagccatcgtacatatcttagtattgccaccatttggccagtgtattgcagtaagagttttcataaatgtgcgctgactcaaattgaattgaattaacttcatttgccatggaagataaaaactattaagaatttcagcactgttaacattctcagttctgtgtaggggttgaagatttacagaaacagtgcattttattctgccagtaagtaaataactctacaagaaaactgctagcttttatagttccttcgttcagctacttttagaaaattagtgtcacggatcagccacagcagcaaattctagccagacaaagcacgtgttacaatcactgatataacttataactaaaagatatctttggttggaatttagatgttttccccaaatttaaaatttttcaaatctttatctttttctaccatttcaatttgcttgtttctacagaattctagaatcttcttgtagcagaaagatcttttcattaccaggaaagtcagataccattcaaaaaaaccaatgtaatgcagaaaagaaagtgtcataaatagttcttaaatatagattttatcagtaaacaagtctcttgttacatcaatgattcctggaatcaggatgaggtgctttaaaggtttagggacctgatgtaataccagaaataagacaagtcttggatagctcaagacaaattatacttctcagaaccctaacttccacagagatgccacatgggtcgcagaagggacaagcagaagccatgaagtgagtagtggatgggagatggactatcccaccacaaccagaacaccttccatcttattgcagattcctataaaacatctctcagggtttcactgtgtaaaatattttgactgctacagctctataacagtggcccaaatgtaatatgaaattacataggaagaatgtaagggttctgagtaatcacagtgcaaacatacagaatagaggctcagcagcaataggtgtgaaaatatcctgttgcacagtatcaaccaataccatgatgtggctgccccactaaacacacacaccaaaactaataagaactggagctgtattaaaagaaataaggaatttaaagcagtggaggtgagcactagtctgaactggtcaacttcacgtagccagaatagtcttcagaaagatgtacataaagctgtaattcccagctgtctgtaccgtatttggtgtttaacccaatctttcttcctgttgtgatagtgttgacatctatcacaatggtctgaataaagtcttccttaccattttaaaaagtgtcagaatattgttttcttcaacacaactactacctcacgatgcatctccagaaattttttatcttgtgactctgaaactctgtgtccactaaacagtaactccccattcctttctccccttgtgcctgagcaaccactcttccactttctgtctttataaatttgactactctatgtacctcgtacaagaacaatcatatagcatttatcctattgtgtctggcttacttcacttagcatatgtctttaaggtttatctctgtcatagcaggtgtcagaatttcctttctttttagggctaattactatgtctttgtatgtatataccgtattttgtttatccattgatctatccatggacacttgggttgcttccatcttttgtgaataatgctgctatgaacatttgtatgatgggcatagaaatgtctgttcaagttcctactttcaggggtttttttggaaatatactcaaaagtagaattcctggatcatctggtaattctatttttaattttttgaggaagtgccgtaccgtttacattcccactgtcaatgcacaagggttccaatttctccacatcctctccaacactgttattttctggatttttctggattgtagccatcttactgaatgtgaagtggtatctcattgtggttttgattgcattttttaatgaggaaccttttttaaaaaagttaacttttttatgtaagttaaaataaaacctttatttctaagttatttggggctgttcctcctaataaccctagaagcctcctgactatgctctaaggcagctctgtccaatggaaatacattgtgaactacatgtgtaatggtaagttttctagcagccacattaaaaaaggaacatgtaacattaattttaataacatctttatttaacccaatatttaacccaattaaaatattataattctacctgtaatcaatataaaattattgatgagatattttacatttttttcatactaagttgttagtgtgcattttatacttatagcacatctcatttctacctgtccacatttcaagtgtttaatagccacatgtagctagtgactaccgtattggacaagtccaagatcttgattctaattgaatactcactaatcttgtgacaaattagaaggcaaaaacaaccaatgatcatatgtgatttgcagaaatcctatgtccataggcagcttgtgcatggaggtaacgtttccacctcaccaacatccacacattgaccatgtgtatgcacactcacacatggaaggaaacctccttctggatagaagtagcaacagggtctcactattttgttatattactataaggtaatggcattgttttatactattttacattttaatttaaaactgagagtatttcagctaaactataagtttaaaaacattgtttagcaagtctgggaacctaaccccaaattatttgatttcccaggaatcaatatgtaaacaaagtgtagaatcacaacatttatgatttggtcaatttctgtgtggaggtgaccactgaatatttgatttagatctccaataagggcttttaattccactctagtatttcttctagtgggacctttttttaaaaaaaaaaaaatctttttttctctttttttttgttggcagcaggtgagccaccttagtagtactatttaaactctttgatcatctaaatgactctttaagttaaggcactacactacaaagtaaataaagcaacctgggtgtcaaatcagacattgtcacaagagaggtaagatcctctgagagctttgtcagctttaataaccatggtgtttcataagctgagagttgtcttcagggcccaactgtcactgaaaagcccatgatggtgtttcttgggctggcatatttatttcctctgtgcacagcctccacactcaagagttaaagagctttcaagtgataagataaggaactgttagataaggaacttcaaatgataagataagaaggaactgtttatcaatttaagcttaaatgttgactgtttagatagcagggtgattgttcatgaattaatgatgcagtaaagttcatttacatttaatggacaatattaactatctttccaagcttcctatagaattcaacaattttttactgctcaaagttttgaataccctttcttgtccactggaaatttttcccttcctctagggagtggatacctggagaccgaatccatgcctgctactagccttcagtaccccaagcacccaatttcacagcagtactttgtgacacttgctaattcattgactgatgaagaaaactttattcttgtcaccttgggcacataggttttatctgtgctgccaaaaataaatttaattaattaagataagatttattaataatgtgtgaatgcctaccaatcatcaactctgtgctagaggcatcacacttatttatcaatttatcacatatctgaggcacatgtagatggaacagccactttttctgttacatgtatgtaaaccaagtcccagagaagacacatcttgactgcatctgttaccagctctggcacactggctatatttaacctctctgggttccagtttcccatatctataaaatgggggtaataaaactaagtgttgctataagaaataaattgcatagttttattttaatagctttccttcttcactttgtaagaatggaataagtttgtgcagagcatttcacttcttactagaaggtggaaaaaatatcttcttactttgaataacaaagccagtctttgggttatgccaaattgctctgtatcagacaaacaactggaccaaaggaaaagaaaaccaagtgggcttatttaagcctacctttgaatattttataataatatgaccactgataaaattgttctagatccctgttgtaatctaagttaaaagttataatcctggcataattaatatctaaattctcaagcactgtgagagttctatcaattctagaatttcatagaattaggagaagtatggaatttattatagaattttcataagtctatgaacttttttttcagagccagcttccagctaggagcttataaaaacaaattaaacaaactactgttactacacacacacacacacacacacacacacacacacacagacacacacacccctacacttagagaaattcttgactagaaataaactgtcctaaattgaatatcagcatttcccagcattttcatagtaagtataattctctgtgtgtgtgtacacagctttaattaatataaaggattgaaaatatccatatctttaagatctcttttactttaaaataatttatataaagctataccgattctgttgcaactgacattaagagattttaaatgtctttgtacattgacagtttcttaacacattacatatttttattacagtttgataagatgtaaatgattactgaagagtgttccttaatatttcaaaactgatggcaattgtgttgtcaaaaccacccagacaatttatagatctctcaccaatttgagactgcattgttcttactggaagtgcctttgatcaacagctccaggtttcttgcttcagaatgcatggagtaagtgtactgcatggagtagtgtcatttatttgataagagctttttaaacccaaacaatatgccaggccctgggcataaaatgtggtggataaaaccggaactgcccttttggagcctggaatcttgtgatagaagtagatattaactaatgaattatagaaataaatacatattgatatggtttggctgtgtccccacccaaatctcatcttgaattgtagttcccataagcctgacttgttgtgggagggacatggtgggcagaaattggatcatggaggcagttacccccatgctgtaatcatgatagtgagttctcacaagatctgatagttttataaggagctttccccctttgcttggcacttctccttcctgccaccatgtgaagaaggacatgcttgcttccccttcctccatgattgtaagtttcctgaggcctccccagccctgtggaactgtgagtcaattaaacctgtttcttttatgaattacccagtcttggacagtttttgatagcagcatgagaacaaactaatacacataggtacaagttgtggtgatttgtattatggagaagtaaagagagataggaaaacactgaaaaggggagagacatggcatggtctggggagcctggttagagtttacctatctgactgatcaaccccatgaagaggttgatgaaaggaaagaactgggctttaaatggatatgagcttgggtttcaaatctgtctgctgttatcctgagggacgatgctaaacctctctgaaacctctgttttctcatttataaaatgaattattgtatttacctcgatagaatttttagagactttaaaatagatttcctggtggctgacacataatgtgcatttagtaaacaataatgttctttcttggacttctcttttgatgacaaacttttgcttcatgcctaataagattgtattctgcttcttaagtatgatttcaaatcctattcatgacaaagactgtcaagacaagtaattatgacataaaattgtatctgctgtggaaatacttatattcaatgtagggctttttatttcaggtcaaatatttggtaatataattaagggaatggattcattgactttaggaaaatagcattcatcctggatatcattagattggctaagcaaagctatgtgacttaatggaaaagctaccttaccaagatttaggagtacatgattgtcgttgaggctcttgaaaaggcatggtgcagctctgggcctcaggtgaaccctaagtcttttttaatcaccttggaaagctgaagaatgtggttggtgcacatttcacctgcatgattcttattctttctgagatttttagcttaagagtcacctcttctgagacacgtggcatgattacttaaggtttggcttatgtggcactgggcttcagaaaggaggttccattaagagaaccttgcaactctttacttaacgcctggatgtaggacggaatcctccaccacatgatgctctccacgaggagtggaatagtggccaccacactcctcaactcttggcacagtgacatttaaaaagtactgtttcatgagtatctgattcatgatctaagaaaaaaaattcagttatatgctcaacactataaaaatcttctgaaaaagtatatagaatggcctttcactgtgatattataatttcacaaggagagcaagccaaaacacaaacaaaaaaatcagagaatgtaaggggggcattataacatgaggtatactctgtatgttcatagcctccagaaattgtcatggaaaatttgggactttggagactggaagagaattcactaagtagaaaagcagacatggtatattgggagcactgtaggtgagatatggaacattatggtgataggcttgagaagagcaacagagtccatgatgattgtcagtggaaactaacactggatatgtggcctgaagtcagattatggaagcacttgaaaattcagaggagtgtagaaaggtggggtcagaaatatggagacattagtagcttttagcatgaaactaacatgcttagaataaaatatttagattagattacaacagatgaactaagtctaaacagaataagtctctgagtaaaatcattttaaagtaatactttatatgaaaatagtatttttaattcactctcattgcttttttctcattgatcatcatagcagttcaatcaggtaagatgatacttgtatctgttttacaaaggaagaagtacatgctcagagaggttaagttgtatattcagggtcatctagttaattaatggcagagccagaattatcagaaaaacatcctgaatttcaactttctatcattaaagttaaaatgtatctaatggtaataactatgtagtcctgattttcatgtatattgtctaaaaacataatcttggtaaagacatgtagagatttttgttggtgaagcttttcacttttttgttaaaaatatatacctgtttgtaaatctgcacaacagcattgaagagaatcaaacagattttgctggattaacccaaatttataatactcaagtaccataatgcttaaacagtagaatacattaattgtcttatgtatgagcaatcagtgacaattcttgccactaaaactacatacactacaatctaaagggggaaatgtttgaactataagaaataagaccagaaatatggatttgttgcaaagatgggtttttctgtagaagagacatgatataccttccataaacagaatcaatttaggatgtggcaagtaccatgtttaacttttaatttcatgagtgcagctatttgattcatactttgcgccacataaaaatacatttcataatttgttgcagaatgttttgagggaaagctgtatagtattgtgtttaaaaggacagattctaaagtcagctttgctgaggtacaaatcctagtcccagcatttactcaccctgtgatcttatgcaagtttgtaagccttattgtctttatctgtaaaatgaagagaataataattcagtaaattttatctatgattgtttttaaaataggaaaataaaaaagaagtgaattgatggtaatgagtaaaaaggttctcatgccagcaaaaccactattatgcgtgtatttcatacatagacacatacatctatatattttctatttgccatgagctactaatttgtattctagaacatgtctaacccattcagttttccaaccctttactatagaagtgtcagcattagatttgcaggaaaatggaaagcaagcttttatgacattttactgatttttagtgatccgtggtgattaatgaagctttatgggaagccagaaacaaataattcctggattcctggttttatgttttagagaaatccattaggcattggaaaagtgcctgaaggttgcatttaaagcctgttttaaaaaaaaccataggggtttttttttggaaagctatatatgtaaaacatggtatcagtcatagagcaagcactttataaatgattaagtctagattgttcttcctttcccttttctccactcaagctacaatctacatcttttacaattattcattcaaactgatgtgagtaaacatcaatcagacctactgtcatctagagcaattcctaaaaagtaataataataattgatgctgctgacgggagcagtattatgaagttaaacgtgtaagaaataagactgatcttttaaaacagtgtttgaaactcagtgtcttcggtatcttttatcctcttttgtgtgtaatattcctttgcagttggggaagcttatagaagaagctgtcttagtccatttgtgctgccataacaaaatacctgaggctaggcaattaataagaacaaaaatatttccttacagtcagggaggctgggacgttcaagatcaatgcactcacagtcttggtatccagtgagggctgctctctgcttccaagatggcatgttgttgctgtatcttccagagagcaagaaggctgtatcctcatgtagtagaaggagcagaagaactgaccctcttataagggatggattttataatccattcatgaggactatagcttcatgacttaatcacctcctaaaagtgaggtgattaatagtatgacattgttgactaagtttcaacaaattaatttgggagacacattcaggttctagcagtacctggtgacattggtcaggtaagaatgtcacagagctgctttgtggagagaaagagatctcaggagatgaacaggtgatcctgcttccagtgacccacgcccttcatccttcagggacatctttccaatagactgacaatctgactccatatttgcaaaggactaagtcatacagctgtgagaggaaaataaacaaatgatgtaccttctgatagagatgaggataaccaaccttgaaagagctccttgggggttagtgtgacggcatgcaatccattctcaaacacatattttcacattaaaatgcatatcatagtcagtagttcaaagtatcttggcattaattgaattagggaatgtagaatatttgggggaaaatgtataaatcaagtgctgatgaagaaaaatgtagcctaacagtgtttctttccattgcaaactgtagaacagagggagcagccatgaatgattaagaaccactgacctacatggggaaatgctgactgaatgtttaaagtagaaggaaaagcactattgatttctgattttaaggatcttacaggctttacgttagagctaaagctttcagaatcttgttttaaaatattttataagaagtatttttaaaggttcattaaagcagaatatttttaaaaacagaccttgaccctctccacaactgatgaattatttgagaagtttaacacaatgtcctgctttaaattaagataatgtgggtaaagatgaagaaaaagtaagtataatttggtggatttgaaactgattaaagattatacctaaaaatgttaataaataaatctatgtcagtctataaagtgatttctaaaggtttgcaggagtttttatctttagacctatcctgtttaactttttgttttaaataaattatataaatttgtattctggtcagatttacaaataaaacaaagctggaaggtataggtaatacactgcattatgaaattctaggccaaatcctttacacacacatacgcacatacacacacacacgaaaaagatggtggaaaataggcctgaaagtaacatgtgtaaaacattttaaaaatagtgcgtgtccatataaatgtgctattacaatggaaattaaggaatccaaggattaaaaaaaaatataaatgagaagcgtaaacatccatgagtgtaaaggaaattaaaggaataatttcaaaagtattttttaaatttcatgcagatatatttatacacacacatattcaaaaaccagcatcatacttagtggtgaaatattagaattatcaatatattttctttaaagttgggagcaagataataatgttttatcattagagtttttggcagacaacagaaaccaatctagctagtttaagtagaaagggccatgtggcaaaattcattttgaaattgttggaaaagtgggtggagcaagctctgggcatagcttccaggtatgtcttgtagaacagctgccaagagagctgctgcatcagctgtgattatgaagctacggaatcttgcagccactgcccaactattggctctatgaccacaccatctcagggaagacctacagtagcaaaatgactaccctacccactgcttctcaacacctacaaaactaggcattaaacactggtatctatgctgtggttaagaaaactccagaaactctctgaccatgttcttggtttgcctaatcaatagaacagaagcacagcccaatctgcttcatttctaccctccaaatttcatgggtaaacatctgcttgctagattgcaggtagaatccaagctcaaagaaatcctgggaaacgtggtttttcattttccagcttctagcagactaaagtcatactaaaagagaaatgacatggccctgattgcaatgatctacaacatccaccatattatattccctacacctgacatttatcagaagtagtagccaatggaattaaataagagatataaagcaggaagcaagatcatcatgcttgctgttaacatgatcctatactcagaaaaccaagagaatcagcacaaatattattagaaaaattaggtttcagaaaggtaatggttataacattaatatactatacagatatcacatagcttttctataatcagtaactaattagaaaatacaatgaaagatgttatctcatttataagcaatcaaaaaagatacaatagctggcataaagtttaaaaatatgtagattttattgtgaaaaagcccttaaaaatttctgctgaggtatataagaaaaaatgtataaaaagtactttgctttgaattggaggattcaatattatcaatacttttaattttccctaagttactcatatatgatttttatatataatatatccaatatacatatattaatatatccaaatcaagaagtgttttccgaacctgacaattctacatttaaagtgaagaaatatatatgcaaagttagctatggaaagtctgcaatgcactgccagatattaaaatattgtaatgaagccacagctaaaatagtttttgcattaaaaagaaatagagaagttaactggattaggatagagatttggaacataactacatatagaaataatttaatataaaatgaaggtggtattttacatcagtcagggaaaggtaaattattcagtaacctttgagacactggctaggcgtctgtgaaaaacaaatgttggatcacaacctgactccttacaccaaaggaataaagatgacgtaaatgaagtaaatgcatgaaggtaaaaagtgagtaaagactataaagagaaagttgattaatataaatggctaatacatttcccaagaaaggctcaacctcatttataattaaaggaaaaccaatcaaaacagggaagtacttacttcttacctatcaaatctaaaggccacaggattgcgtttataaacactgtgatttggctatgctttctactttcctgagaaagtttgccagcattaccacagttccgttctcagtaacatctgtggtgcctgcctgctcttttcagccagtctcgagctacagaggccctttcctcttaaaaatatatgaggcttggggaagaaacagctgagtctcccatgccaaaccatctaactacttagctatgcacgtcaagaatttatttactgaaagaatatctagtagttgcctttacaagaaggagatggagctggaggttgtggaggaggatagatcattgattttgtgttacaagcatctatatgcttacagggcatgtttgaatttctgatcatgtgaacattttttacattgtacacatatttttaatttgcatcaatttatagcatacaagtgcagtcctgctacatgcatagtgcaatggccaagtcagggcttctagggtacccatcacctgaataatgtacattgcatctattaagtaacttctcaccatccacccacctcccatctctcacccttccaagtcttcattgtctatcattccattttctgtgtccaagtgtacacatttttttagacaggattttactctgttactcaggctggagtgcagtggcatgatcacagctctttgcactctggacctattgggctcaagcaatcctcttacctcagcctcccaagtaactgggactacagatacacaccaccatgcccagctaattagaaaaaaaaaattttaaagtcagagtctcaccatgttgcctaggttggtcatgaactcctgggctcaagcaatgctcccacctcagcctcccaaattgctgagattacagacatgagccaccatgcccagcccaagtgtgcagtgcccagcccaagtgtacacattgtttagctccctcttatgggtaaggatctgtggtatttccctgcgtctaacttagttcacttaagataatgacctccagttccattcatgttgctgtaaaagacatgatttcattcttttctatggctgaatagtattccactgtgtatatatgctgcattctctttaatcatccattgatggactgttcagttgattctgtatctttgttattgtgaatagtgctgcaataaacatgggaatgtagggttggtgttagtcttgctctgctctgaggtggtcatcttggcctgtgactgtgtttgggtctctaaatcaactagaacatgttaggagagacaaccatggcatgggagaatttgcagtcacatccgatgacaaaggatccaagcatttgattgggttatatagctgggaaaggaataacggatagaaactatagcagtgttcatggatattgaatctagaagagtcagtaaacatattagccatgggctcagagaatatgttaaaggaaacagttttggattaatgaaacagaacgctaagcagtgaggcactccagcagaggctgacgtggcaagtgagttctctcatcatgaaaactgttcagagctaagcgtattgtcagatcgaataagggacagagatcaaaccctggaattcttagaggctaccatattcttacttgtacttcataggagttcccagatattttaaaagacaaaaaaaaagttccatataataaaacaaacgtaaagtatattgtaaaactacaagtcagctatctagcttctcaggaacaattccagtgtactggcgtttgaaagcagagctacagaaggtcgtttgtcatgtctaaaggccatagaatcacttttattaccttttcgatttagctttgctctctacttttttctgaagttagccagctttactacatctctgcttccaggaaaatctagggaatctgccctccctctttttagccagcttccagctgatggattctgggcaactgcttagagacagcaaaagtagacatgaccttgggagaaggtggtaaagcagctttggtctgacctttccttcctcacagaccaccaagtcctgaaagtgaatgtttaatacccctggcaagattgctggcctctgttccaaacaattactgaactaatctaaattatacaaacacagaccatttatcaaggtcagcctgcaacaatttgcatatgtaggcagagtgttcccagtacaaagggtgaactgaggagaggtaaaacagaaatgagttgctgattagtcaaaaaaaaaaaaaaaaagactcattaaatatctaacagtgggcaagtttgcaggtttggttacctaaattattgtcttattatcatgagacaaaaaggcatatttttcttctttagtaataacttttaaaaagaccatctggcaaatgtagattgagacatttgacctcaaaggtttttaacattcttcttgataaataagaataaaaggaaaaagagaatggtttgtttttgtttttgtttctgagacagtctcactctgttgcccagactggaatgaagtggcacaatctctgctcactgcaacctctgcccctcacctccttccccttcttcaagtgattctcgtgactcgggtatctcagcctcccgagtagctgggtttacaggtgcccaccaccatacccagctaatttttttttttgtatttttagtacaggtgcccaccaccatgcccagctatttttttttattttttattttttgtatttttagtacagatggggtttcgccatgttggccaggctggtttcaaactcctgacctcaagtgatctgcccaccttggcctcccaaagtgctgggattataggcatgagccaccacacccggccggaaaagagactttgcctaggggaagtggtgatgagaatatttccaacccagggaacagatccaactctccctttcagttgttatttcctatgggaataagcaaattccctaaaacttactggttgtctattgatgcccctaaagggacttgcttccagttctccacactcacctgaaaaatttacatcaaaagttaaataatgcagtcacaaaaagagaaatactgtatgattccacttttatgagatacctagagtagtcgaatttatagagacaaaaagtgaaatggtagttgccaggggcctgggggacaggggacatggggacttgtttaatgggtatgaagtttaagtttgagacaattaaaaaggttgtagagatagatggtaatcaggttgaccaaaatttaaatgtcctcaacactattaaattatacacttaaaaatgattaagatggtaaattgtatgttgtgtgtattttatcactgtttaaaataaaatgttaaaatcaattatattcatagacgaaggaatattacagtgactgaactttaaaaatccagttttacatcctcagtgtcagagtctccactggactatttcaagcctggggagcttggtaatgagctgatcatctttgactatgtttggctggcactgaagtggaccatgatgttgagtttatggtcttgctcatggcaaggagccagaagccggaagctggggtagatcagacaggtgggggcagctcatagcggttggttgcctggcttgttcagtgctgagcacaaaggtaatgggtggtaaatatcaaagctggtcttaaattgttgagaaataagtagggagagcaggcttgcatttaaaatcacaactactatgccagggaaatataggtaacctattaacatcacctgagaactgtaaggtatgatgaaaagcaaacatctgctgctttacatagttttgataatagagtcatcatatgtttttatatccctagaggagaagcaactaggagtatggttttcaccaagtaaagactgaacagacacccagggctagctttataagtatgccacttgtgcagttacactgcttcccatgctctgaagaactttgtacttggtttaatgacagttgttgcattcttcatatttgtaataccttttgaacaaggggctccatgttttcatttctgctaggcctctcaaatcatgtacctggtccagttggcaccaataagaatatcaaactactgtccaggtggtcacgcaaggaggtgatgcacaagcctaatttgggcagatatggagtgttaaagaaaggacctggggttggtctagatattatttgggaatctgggtggagatactatttgggaatcttggtggagtcgaagaaaaaacacagatggagaaatatgtagtattgcataaatttgtgactctaagctcatctgtcagtaaactgttggggacagagtcctgtgtccagtcagtatcattgtccagtcacatagttacatgtctgcagtgctcctctccttttctactcatgctgtcattgctacatagaggagatcctggataggaaaaggtcaaggttctgcccagtgagtaggattgcagggtctcttatgccttctgttgggacatctgattgtttgcattgcttctcctgcccttgctatcatctttcatctttatcccctcaacagagtgggcctaccgagagaaggtgcattaaaccagtcatcaagaatcacaacagggatttcaactatctggggactgggaagaagaatgagatttccaagctacaggctgggttggacttgggggctggtgtggaggagcagagattggcccagaagagaaggagtagggctcctttggtgggataacatggtggaaagggggttccatccatgccagtgggactcactgtcagaaggactgttgtccaggcaaagtcaccagagctgagttttctggcgggaatattgagggtattgtgttggctctgaatttctggttatttcaccagctcctatttcttcagggcatattcccctcagttcctttatcatgtggaatagcagcaccttgatttcagtctgacacagattcaatttctagaattgtcactgtatagatgggggagaccttaggtaggttactttacctctctgagatgagtgcatattttctcattttgtaaaacagataaaacacatattcatagtattgattaaatacatagtgatgattaaataagaaaatatgtaaaatgtggagcacaaaatagatcccaaatgatttggatctgttattactataatcagcattataggtgttattcaaacagggaagagctaaagatataccaaacagactaatacaaaaatccgtggagattaagttaaaaagaacgctaattgctattcatttacatagtcaacgtatcattgttatttatttacttatttcctggttgttattgttattttgtatgtacagatgtaattaattctacattttaaaattgaaaatatatatctgaatagtgagccctggagctattagattatctttcagggttctgtaaataggattataattaggcacagtgtaatctcttatcctccacaaaggctgcttattttacttctatagaaacagaatcttctggacctgcaagaaatcttacagatcatctactaaaattccctcttttaaaagatgaagaaattgtgatctgttaaactatatcttttaaagtattgaattattttcccctgaagttttatcagttcgatacaaataaaatcattttatttgtttaatttggttacctttaagtaagttaacttaaatcatttcagtctaagtcttagctgggaaacaagacttctattattgtatccactgctttcctttaattaagctcttgaaatgattattttgaacaaaatgcttggtactaaatttataaatggtgtgttgctttccactgcagtgttctacaaagttggattgaattattttacctatacaactttctgttcctgcataatgatgctttttctgtgtgagttgttcataaatcagataaatgtggtttttcatcctgcttcaaaatatacaatgtggttgctcataatctcctcctcaaaaatgcacaggaaacatgcagcacacacagtactcaatgaagagtctttctctctctcactcttgttcttgcactcattctcaccctctttttccttttcccaataggaaaagtactcattgggtctatttgtctttcagactcttgcacatactgtgcgatcccatggtataggcagcaggacatgctttgttccttgttccccagactgtgtcacttcagcatatgttgccaagttgtacctcgttgtgtcaaatgcggcttgaccaattcccttcagaacacaatttgagtcagcagagtgatttcagagttgagtgcttcctctgaatgtggattttaactgatgaattttccagcacaagggaaaagatgccataggccaaaatatcagtaaaatcttcagctcactgaagtggcaaaatggttgtctctttgcaagtggttgtattaggtaagcatattattgaaaataatgctcttctgagggatgcgctatgagaaaagctaatttttctaggccaatgaattagttttaaccactttttttcctgataaggacatttattttttattgtttagacaactgaatataattcatttgtaaatcttctcccctgtaatttctattccaatctgcctttacacacacacacacacacgtagagcaaattagttaaaagccttctttttcccattgtctaatcctccacttaaatcaatcctacctatattgtaaccttttattccatggtgaatagttttctagattaaaagtttggagtttttcccacaggtaacagattctggaaggacttcaaatgccatgcatttttaacctctacttagggtacatagatgtagaaataaatatgagtgccagaaaattcacaacctgtgatagaatcatacaaatctcaagtatgttcccaagaatgctctagggttgaagggtacttaagttttaagaattcacagaggacaaaggtattagtttctctgaatgattcctatctttcaacataacctcacagtttcaatggtatatatgtgttttgttatgtaggaaacttcctcacattataaaccccaaatctttcatacatgagcataggagctctctggagagacaatcatcaagatcatttatgaattttcttatatctgacactgttcccccaataatttaagatggtaacaatcttcagtgcagctgtcccttctctcttgggaagctttgtgttctgcttactaacagaggtgattttcttacaacagttagtaatcaaggggtcaaaatgagagggcagcatatttttaaaaactcagagaaatagtcaaacaccgctaactgtaccctgtcatcagaatttttcctctcttctttactcagctcttaagtttcaaatctggctgcatgttatcattttgggacttttaaaaaacttctacatcctggccttgctgtcgagcaattgaagcgactctgaaagtggaacccagtgagtcaggattgagcaccatgaccttataggctgaagtatgtgctgaagagggttaatcacaaatagtgaccaatggagtaatggaaactactgctagttagagtcctacatggacatcatcttaaaaagaagctgagggacctttaagggtagttgtgtttctcttcaagaggatgtgaaagttttatcacagagctcaacataaagtaggaacatcacgtaacataaagaacatctcagaaattaaccaaggttgactttaaaacagaacacattctggtttaagatataaaggaataatatctttgacaagggcaatactctttaagaatgaaaaaaaaaaaagagagagctatagagaaatatactctggtgggaaaagggacccattctaatgatcccaactcttcaccctcaaacttctaactatgtcttggggttttattattttgacccttcctgccatcatcaccctttaccccaaggtaccaatacccccttttcttaggtaccaataccccctagtccaaagacaagagccacaaatgaagcaatatgcccaaaacacattctgataatacgttcttagtgcctagcaggtgatggcataatttgctatctcagaactgtacattttaacaatttttaaaacattttgtgtttatagctcttgaattttttcttaaattttctttagaaagttaatgctagacctagttatattaaaaagaataatgggaagggcattttgtttcatttgtgggttttgtctttagactaagaaaaggggatattggtacctttgggtaatgggtagtgatggcaagtaggatcaaactaataaaacctcaagacatagaagtgtgagggtgaagagttgggaccattagaacgggccccttttcccaaaagagtttgtttttcttaacaggtcttattcttttttcattctgaaagagtattgattgaatgtcagtcagagaggtgattgtcagagagatgattcctttatagcttagcctgtatctccaggcttgaagttctacaccagtgagataattaaaacaacatgctttggttgaaagcctttcccaaccacagtgagtaccgaaactatatttgtattaatcaagcataaatttctaacaaagatccactgatacaggaattcaaacaaattgcatttttgcccctcttaaaatactatagactgttatcaatgataacattttcaaaggcatagattgtaaagtttgatggagtgtgcctcttcaacctttcagagatgtatgtttaattcttttctgtgaaaggtaacagctaatagacccatttaactcattctccagggcttctgtcatacaatgaatttctattgtttaaacaaacaatacgtcagtttctttataataaccacatgttgaaagaaagccacccattcaataaaatatgaatgaggtagttattttaacagctatgaaaacttgaatcaagttgtctgggtacttcagctgaattgataatggaggaaattaggcagtgcaagctgctcttttctgagtgcctgtactgtccctccattattaatcacaacatggccattgacattcctgtcagatccacttcagagtgctgattgctggtctgtgtcactccatgtgagaatacattctggaacctgcattttatgttcccagagaagtgctgagcattctgttggaagtagcatccttctttccctgagggcttaacctgtcaacttttcccagtttaggaaagtgcagctgccttatggaatagaaagtcattcattcatcattcactcacttattcattcctttgacaattttttacgcatttgctatgttccaaacactgtaccatgtactagaaacataaaagatgactgagacctagtccttgccttcaagttactccaatctagcagaagagaaagacaagtatcagccaatttgccacatgcaaagtatacctgatgtagccaggaaaggcaaaggtggctcatttgcaaatgtcagttcgaggaagtgaaatacagaatgggtcgtcagagaagtggccagttaatggactatgttttcaatggattctgttcttatccaaagcatatgcccatatcattgatattttcttaaattatcttccaattattttctctctttcagaagtaattaatttctgggaacagcctgtcttcactaggaaaagcttgtcttacatactctttaatttttaatttttgtgagtacatactaggtatatatctttatcacaatctagcagaggagaaagacaaaaatcacccaacttgccatatgcaaagtatatatatcatggggtacataagattttttgatacaggcatgaaatgcataataatcatatcatggaaattggattatctgtgcccccaagcatttatcctttgttttaaacacaatccaactatattttttagttatttcaaaaggtacaattaaattattattgactataattaccctgttttgctgtcaaactagttcttattcattgtttctaactattttttgttgtatccattatccttcccattctctggcaaccgttcttctactctctatctccatgagttcagctgttttgatttttagatcccacaaataattgagaacgtgcaatgtttgtcttactgtgcctggcttatttcacttaacataatgacccccagttccatccatgttgttgcagatggcaggatctcattgttttatggctgaagagtactctattgtgtatatgtgcccattttcttcatccattcatctgctaatggacacataagttgcttccaaatcttggctactgtgaacagtgctgcaacaaacatgagagtgcagatatctctttgatatactgatttcctttcttttgggtatataaccagcagtgggattcctggatcatatgttagctctattcttagattttgaggaacctccaaactgttctccatagtggttgtactactttacattcccaccaacagtgtacaagggttcccctagtctccacatcttctccagcatttgctatcacctgtcttttgaataaaaaccatttttaactggagtgagataatatctcattgtaattttgatttgcatttctctgatgatcagtgatgttttcatatgcctgtttgtcactcatatgtcttcttttgagaaatgtctatacaaatcttttgtctattttttattggattattaaattttttcctatagagttatttgagctctttatatattttggttattaatcccttgtcagaccggcattttgcaaatattttctcacattctgtgagttgtctcttcactttgttgattattccctttgctgtgcagaagctttttaaattgatgtgatcccgtctttctatttttgctttggtttcctgtgtttgcagggtattgctcaagaaaatttttctcagaccaatgtcttggtgattttccccaatgttttcttgtactagtttcatagtttgaggtcttagatttaaacctttaattcattttgatttgatttttgtatgtagtgagagatagggttctagtttcattcttctgcatatggacatccagttgtcccagcaccatttattgaatagactatcttttccccagtgtatgttcttggcacatactcttttattcattcaaggcctacatatatattctgattcatatagaaatccgatttgagttgcacagagaaaatttcattacattttgcttgtggatgtttgactaaaaaatgatttaaaaagccaaacctattgtgtttgtcaaaatccaagtgatttacaacaattataataaagttcagaatatttttgacaactcttcctgagtgatttttgaaaactgaaatgcttccgggatgaggttcccattctctacacagcattggcattagtagatatatcaccatgacgtaccttaaaaaaaagctgaaattgcatttcccagcaatcgccctcagtacagcctttatgcattagggtcagatataaggctggtgactaaatttatcttcctttatttttattcacttttcttgcctttttctcttttgtttcttctttaagacagacatatatgcatggtaagtaaaagctgtaaaaagctaaatacttgaggggatggacaccccatttttcattatgtgattattaggcattgcatgcctgtatcaaaacatctcatgtaccccataaatatatacacctactatgtacccacaaacatttttaaaaataattttgttttgttttgttttgtttttttgtttttttaaattttattattatactgtaattttagggtacatgtgcacaacgtgcaggtttgttacatacgtatacctgtgccatgttggtgtgctgcacctattaactcatcatttagcattaggtgtatctcctaatgctatccctccccactttccccaccccacaacagtccccggagtgtgatgttccccttcctgtgtccatgtgttctcattgttcaatttccacctatgagtgagaacatgcagtgtttggttttttgtccctgcgatagtttgctgtgaatgatggtttccagcttcatccatgtccctacaaaggacatgaactcatcattttttatggctgcttagtattccatggtgtatatgtgccacattttcttaattcagtctatcattgttggacatttgggttggttccaagtctttgctattatgaatagtgctgcaataaacatacgtgttcatgtgtctttatagcagcatgatttataatcctttgggtatatacctagtaatgggatggttgggtcaaatggtatttctaattctagatccctgaggaatcgccacactgtcttccacaatggttgaactagtttacagtcccaccaacagtgttaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgttttttggctgcataaatgtcttcttttgagcggtgtctgttcatatcctttgcccactttttgatggggttgtctgtttttttcttgtaaatttgtttgagttcattgtagattctggatattagccctttgtcagatgagtaggttgtgaaaattttctcccattctgtaggttgcctgttcactctgatggtagtttcttttgctgtgcagaagctcttgagtttaattagatcccatttgtcaattttgtctttggttgccattgcttttggtgttttagacatgaagtccttgcccatgcctatgtcctgaatggtattgcctaggttttcttgtagggtttttatggttttaggtctaacatgtaagtctttaatccatcttgaattaatttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgtggcattatttctgagggctctgttctgttccattggtctatatgtctgttttggtaccagtaccatgctgttttggttactgtagccttgtagtatagtttgaagtcaggtagcgtgatgcctccagctttgttcttttggcttaggattgacttggcgatgtgggctcttttttggttccatatgaacttcaaagtagttttttccaactctgtgaagaaagtcattggtagcttgatggggatggcattgaatctataaattaccttgggcagtatgcccattttcacgatattgattcttcctacccatgagcatggaatgttcttctatttgtttgtatcctcttttatttcattgagcagtggtttgtagttctccttgaagaggtccttcacatcccttgtaagttggcttcctaggtattttattctctttgaagcaattgtgaatgagagttcactcattatttggctctctgtctgttattgatgtataagaatgcttgtgatttttgcacattgattttgtatcctgagactttgctgaagttgcttatcagctgaaggagattttgggctgagacgatgggttttctagatatacaatcatgtcatctgcaaacagggacaatttgacttcctcttttcctaattgaatgccctttatttccttcttctgcctgattgccctggccagaacttccggccagcatcatcctgataccaaagcctggcagaaacacaacaaaaaaagagaattttagaccaatatccttgatgaacattgatgcaaaaatcctcagtaaaatactggcaaaccaaatccagcagcacatcaaaaagcttatccaccatgatcaagtgagcttcatccctgggatgcaaggctggttcaacatacaaaaatcagtaaacataatccagcatataaacagaaccaaagacaaaaaccacatgattatctcaatagatgcagaaaaggcctttgacaaaattcaacaacccttcatgctaaaaactctcaataaattaggtattgatgggacgtatctcaaaataataagagctatctatgacaaacccacagccaatatcatactgaatggacaaaaactggaagcattccctttgaaaactggcacaagacagggatgtcctctctcaccactcctattcaacaaaaaataattttaaaaattaaaaaaaaaatcactgaaaacaaagtgcttttaattcggaaaacaatttttagtagtgttaaactataaagacattagtcacaggaagaaattttatatcttctaaattcttttgaaaattctatgcagaaccataatcactggggaaagcttacagttaaaattaatctgtccagcatactcataataaatacctttttattaatattaaaactaataaagttagcagacccaaagtaaatggatatatgatattctgtttttattattatttccaaaggctaaggtagctaaactttcatgcatgatgttgtaaaaattaaatgatgcacaatcatttgaaaaatggattttccttgtacaagttggccttttcagctctatatatttatttagaaatatatctgtcttctggctgatattgctttagactgatcaaatttgtgtttgaatataataatgggatagtgttttgagtttctcaaaataaatgtctgagagatagcattaattccttttgatttgacacttcctttccattgcctatttggaggttacatagtctttatcctggttattctacttgagatacacagcataacatatgatcactcaatcagtatttaccttgaatcaggtatgattagatacatctggagagtcttagaggatgggcctgccaggagcccatttgcatgacggactgaagagtcttttaggaagtagtccatcctatggcaatagagagttgacatagagaagcttgatataaattcaatgctttgagagtagaaggaaccaaaccatggaagttgcatggttcattctgccaccctccgaaatgtaggcttgagtgtgttgatgatcaaatcctaaagcatcctttaccaaatttttgaacaattttggaaacactgaagactcctgctttgtattctatatatagcaccagaataagcaggggtacatagaactaaaacagtgatggcagcaagaggctggagcagcctactacctgacccagtgaagaagcaggacaggagacatctttggcagtggttagctggaggcaaaaccagtcatgctagcactggagggagactgtttcataaagattggtggctaactcagtggctttccagcatcttccaagcaggttcatggacattgtcttctgcagtagatatctgtttagagtcaggaaaaaaaaagaaaaaaaggcagatgccacatggtaaaagagagaactgggtttatgtgcaattgtgagacccattggtcacttctcagaacttgtgtgtgtgaaggaccttattttaagaatacaaggtcctgaaatgccttaaagtacttttcctcaggaagatgtcttggggaagatagaaaaatctgatatgataagaatgacaaattacaatatgacatgtaaaacagataaatgaactgcatttgttgcaaactgcaaaactaagccaaattcagaattgtaaaggagcaaaccgttaagctcttttcatccattttgtttatattgctgtcttctgaatgagttcatagtgtcaacagcatctttggcaaaaataatggaattaacagaataagagaggtcagagtaatacctcactaggtattcaactgagttcctttgaactattttgttctgcttattttgtctggggtttttctttcagtttatttccaactttgacaagctgcagatccacgtttccagctgtcttctgtatattcccacctgaagatgttattaccttataattattccccaaatcttctgccctctgtattttgttgttgatgttgttgttaatgatgtcaccatccctttagtctctcaagtaaggaaaacagatttactttttccttctcccactcctttggttcccttatccaatatgttaacgtcggtgccattagtaacttctgaagtctcactcctatctttctaccactggagtataggtcttcaccatgtcttgtctggacttttgcaatagcttcttaacacaagactctccccactgtagtcaatactctaccttcgttgttatagtcatcttcctaaggacaaatctgatcatttaatttgctcttcataatccctgttagcttcattgcatggggcataaagccaaatttgtaagcactgaaaataaaacccttcacacactggctccttcagcttcatccctatcacccagattcagccatattggacttctcactgtcatttgcataaaactggcccattcacatttgttcgtatgcagaattctttcataaaatgtcttcagttggcaaaatcttagtcatcttttcaacagagaacaaaatcaccttctcttggattttgagctttcctgaatgctctcaggggcagaaatagtttctccctcttttctgttccttggcactttccttcctaaccacagcatggcacctgccacaattatgatcatttctctatcttgatgtctgtgtccccactaaactgtgtgatcctctagaacagaaaggtattagcaattctctttgtgtccccagagcctcacatgggactacaccatgggtatagaataagtgttgacagagtgaatgaataaagaagcacagcgaagtgactaagtcagaggagggacacttagatcagcttcagaaagtggaactacaagtggatagagtgtggctatacatagagtagaacattctaagtgtcagaacttttaaaaatggtagcgtttccatgttactaatcatcagagacatggaaatcaaaaccgcaacaagataccatcacaccagtcagaatggctattactaaaaagtaaaaaattaacagatactggcaagactgcagaggaaagagaatgcttatacactgttggtaggaatgcaaatgaatccagcccctgtggaaagtagtttggagatttctcaaggaactaaaaatagaactaccatttgacccagaaattccattactgggtgtgtatattcaaaataaagtaaattgttcttccagaaagacacatgcatccatatgttcatcacagcactattcacaatagcaaagacatggaatcaacctaggtgcccatcagtggtggataggataaagaaaatgtggtacatttacaccatggaatactatgcagccataacaaagaacaaaaccatgtccttttcagcaaatggatgccactggaggccattatcctaagtgaattaacacaggaacaggaaaccaaataccacatgttgtcacttataagtgggagctaaacagtggataaacagggacataaagcaacaaaagacactgtggattcctagaggcagggagggagggaggcagtcaaaggttgaaaaactaactattgggcactatgctcagtactatggtgacaggatcaatcataccacaaacctagcatcacacaatatatccaggtaatgaacctgtatatataacccatgaatataaaagttgaaattaattttaaaatgaaataaaataaaattgaaaaaaatgaaataaagaagtagcaagtattctttaattagaaattctcagaggatggttggccacttgtgaacaaatggataggtgatgtacatcaggtagttgttggctatgctaaatgacctctaattctactcagagattgtgttattcttcattaatacacaatccctcatgtcacctgataatttccagtagtcagtgatatctgcctttaaccctggctctgtaagtttatcttccataaatagattggaaatgtattcagttggaaccaagccagggaagggggagagaatgaaaatgagaatatcaagtaaacataaatgacatactatgatttttttaaagatggtacatgaaaactgaaatgttctgtttgtaacattgagaagagctgaggctttgcatttttggtacttcaagtgccaggagggagaagcagcaacctcctcccactcctgggagtttggtgtaaagggacatggcccagcctgcaactaactaggagttagtccaacccatctacttgtgctaaattgtagctgtaatatctctgtgggtttcgtaataacatatataattatgatgcattgtttttatatagcacctttctctaaggagcataaagtgctgtgtggacattatcccattaaatctcacagcactctggagacattgaaagaaggcaggtgatattatatcccctttgaacccagagctgaaaaggaatttctccaaccaaaagtaaataaaagcaagatggaatgaaagcaagatttataagaggatataaggttagagtttaaaggaagatattgactatgttggaattaaagggagatttaaggcaaaaaaaaaaagtaaaagaattgctgtgagaaaataacaaagtgtctagagtgtgtatatatatatatgtgtgcacaaaattaaaataatatacaaatactttcaaaatttgaaaagcaagattattttaaaaccatctataattttactacaataataaaactaatttgatatattaccttatgtctttttgttttgcttttactgtgcatctgtgattttccacataaaattataccatatattcaattttgtattatgtatttttcacttaattatatatcataaagtttgcatacttataattctgagtagccgtataattttccatggaattataaaccataatttgttttactcttttctaccaaaaggcagtttccacattttcaccataataaataacaatagattgaaaatctatctttatgcatatggatcttttatgtttttaattatttccttagcagagaaaatttccgggaatagaattaccagattaatatggatatgtaagtacatttaaacatgactgcataaacatactctcaaattaacatgtaagtgaaaaaaaggaataagaaaattactaaaaaccaactatatttacacgttacaaactatgtttacaagtttccaaggcagctattttaaaagtaaaaatgttagcaattatttttgtctgtgcacaaacaagtagtttgattttatttttatcacatcatcattcaattcaatttctttggtagtatgaaaccagattaaaaataaaaagttgaatctcaaagaaaacataaatttgtacctgttttttaaaagtagatttacttgactggaacatgtaatttctctgtattcttcttaattttaatttacatggtcaaatgttctatgaaaataattaggaaagtgtgtatgtgtgtatactaatacctaaagccccattttaagaaagtaaatataattgtaaatttttcttattaattatggaagcactggagaaaatgacatgtgtgtattactgtttttggtgacaggttgttacatggtatcatgtaccaaagtgattacctcaagagtcaaagattaggtcgggcgcagtggctcatgcctgtaatcccagaactttgggaggccgaggtggaaggatcacctgaagtcaggcattttagaccagccaacatagtgaagccccatctctgctaaaaatacaaaaattagccgggtgtggtggtgtagtcccagctactcgggaggctgaggcaggagaattgcctgaactccaggggtgaaggttgcagtgagtcgagatcacaccactgcactccagcctgggtgacaaagtgagactctgtctcaaaaaaaaaaaaaaagtcaaagattaaaaatactggcttttaaaaacatttaaaacacattaaaaacatattgatgtgtaaggtaaatactgaccaaggaaactgtcaggccagtgtttttccaaatggcaatcaatctaaatgatgtcgagaatatgaagtcaaaactagcttagatatgaatgaggcatacagccttaaccatggacttgagaatcttgttttaatcactgttctcaataatattcttgctgatctgaagtcacatacccctttttatctattgtatggttttaagtaatgttgcaaattgactgaagttaacatgggacaccaaaacatttctactagctgacagaaattttgcaaaccattctcatttttatggctttagcaatagtgttcaaagatatgaactgagcattgaagcagtgctagagattgcattttctatttcaccacacagtctaacaagcagggtctgtcttgggaaaaatggacttaaagtattataagaaagacattttttcacagactctaaaagacaattaatctaaagttagataaattaaagctacccactgagaaaagttcatttggtctctgtttaaaactaaaaactccacgctataatttgttttcaaattatagcaaagatgagcaatttatacagctacatcctactcctgtaatacagtgatgagctacatactctcaacaacctgtggtcaccaagaaaatggaagatagagaatgattggttaatttactcattctctcagagcttgaatgaggaatgtattccccaatgggtccatagggaacttctttcaagactctattactaatacaatgcttccatattatcctgtaagtattgtttaacttgtttgcctcttctactagaggatgagctttcttggaggcaagaattttgattgatgtctttggtattccaaggccttgcacagtttctggcacatggtaaacacttattaaatattggtgaataatcaaacaaccaaatggtttttacttcccaccgcgcatctactattgtgctaaggactgagagagacataaagaagtgtaccttcaaggagtgtataattaatacataaatgtgaagttaatgaacaccacacggtagtctgttgtgacgctgtaatagaagattctttggtgctggtactaggaaaatagtcaagaagagttacatacacaaaaaaaaattgtgccattgtgataggggagtgatagataggcatggccatacaggttaactgagaagtactaaggtctatttccatcattgtttgattagtgttcaactccctttctagactgtgctctaaaaagtcagagtgcacatgggttttcattcaccattgtatttctaagatctagcagagcactggcatgaagtaggtaattgagcacttgctttgctcaatattctctactttttcaagggctagatcattctcatcctcatcccccagcttaggtgtcctttcttccaagatgcctcgcagggtgccctctgttatttcttttctcaatccctagtttatttcctttgcaaaacatatcaccacgtatttggctctttactcattcttttacctgtcactcccaccagacctgatggtaaacctctgtccatctgttttggtcctggttgcaaccatagctcatatcacagcacctggtaccctttccctgcagaggctcttacctcatagaggtcttttcttaccctatctaacgtagcttctcccaatccttatcgtggtttattttctctctagcactaatattttctgaaattattctgtgtatgtagttatgccatattcaaactataaaccccatgaggacagagcctagagccatttctacctgattcattgctgtatcaaggcttagtagggggactgacacaaacagttcttgaatgtgcaaatatttagcaaataaaaggtgatggcacaaataaaagacaaaataattaaaaaaaaaaagcaaaggaaagagattagttgttaactaggatagcaaaacaagtgttagcttagaattgtgatggtaaaggcaagatctattttcaatgaaaaataatggttggaaatcaaagatagttagagtaaagagaagtgacaaggactaaaccagaagagcaatctgaagactttatctctacacaactgtgggcaaacatctctacacaatttggcagcttctttttctttttttctttccttttcttttttttttttatttttttggttggttgcttgttttgagatggagtctccctctgttacccaggctggagtgcagcggtgcgatctcggctcactacaacctctgcctcccaggttcaagtgattctccatcctcagcctcccgagtagctggaactacaggtgcatgccaccacacccagctgtggtttaatgagagacacaaacgaaacaatggttagaccaagacagtaatgtaaggtcatttagagccaggacaagctgaattacttgccatcatgcaaaaacactcatgggactggacagacctaggtttggcttttactcttctatttatagctgtattacagtgggtaaggcaggtgccttctgtgagccacagtgtctccaattgcaaaatgagaaaaataaaacctgccatgtagtatcatttttaaaatagaacaaagaaatatatgtaaaaggctgcacctagtacagaatctactacatgtgggagatcattgaatagtggtcattgttagaacagtgcatcaattacagtacccagctagaagggtggcaagcaaaatatttaatcatattagtaaaggaagatgtatttcctttcatttaagtaactttaaaggacatctctttattttagattattgcatgagcaaccaattgatcataatatataattgtcagggcatgattaatcataaactactgacttgaaaaagaaaaatcattaattatgataattattctttctcattgtatataattgaggcttaggaagtaaaattgaaaaaaatctttcactgattctgagttaattagcataccttgcaggtatttacattaaaacacccaaatgttcttcctatgttttgttctaaaagaagagatttgaagagctctccatttcaggctaaggctaattgaaaggcagatgataaatgattagttgaggtatttgttttgagtgtgtagttgttagagtgaatttttcatttgaagatatatatagtattaaaagtccaggaatctctgagttgggaattaggggcagagagcagtcaacaaatcatatatttgtaaaataatttggaaccttcttcagagaactgatttctgaatagtctgtcacctaaacaatttcataatgatgctgatttgccagcttctcctccagcaagaggcaataaatcaagtgtatctgggtttatatggggaaaaacatattaattgatttatgcatataacattgcagatatccataaagcaaagcctttggcaactggcaaatgtaataatttcacatttacctatggttcaccaagtacaatccattgcttgaaggcaaaactgtatgttttatgtttagtttttacgattgcttccatatagtctctctgtgcattaaaagtccattttcagaaccatgggtttaccaatttttatgagtaaaaattttatgagatattatactgaggtagcataaaattattttctgataatttttaccaccttcagaactccactgttactttgtttccacatatgcctaaggatataatttgtaatacttttaaatatgacacatttcattagaaatatgatatattgcagagatattatatgaagcttcaacctcacaataacattacagattagtttttaatgtaggttacattgacaattctatttaaaatcaaatataaagaaggatatttaataaaatgattaatgatttttatatttataggcaatgtgtcatcttctgatcataattatgagcaaaaagaattaatcctttaagtgaagggcttcttgtaacacagtaacttaaacactccattgatatacaaacaaggaagacttaagataaaatagtttgttaggtttctatgccaaaaaatgttattgttacccatatagatcttcttgtgtttttgcactgccttaagtcatatacgtaacataaaagttttaccatttaatgatatgcacagccgcagtatgttgggagtacaaatcttaaccatcacataagttcctaagaaacataaaagctgtgtctttttagcaagctgtgaagtgatagccatcactagtgggctctaaatcatctcaaaagccattctgtttttccatgcagtgatataggaatctgatatcagagtacctacacatgatgaaaaatctcctcaggtgagaaaagcgaagtgcaaagaagttagggagatagtattcattactagaaatatgataagtttagagccaaatctatgcattggcagtaaaaattctaagatggccataaaccatctacagttaaatgcatatctcagcctgcatattttgtaggctttgtcaatgacttgcaggataaacataggaccacttccattccttcactttgcaatgtgtgttagacaggattccctccccaggtgctccaggtagcaaaaaatcctaagaaaatattatttcaagatcagctgcaacataccactgaaagtcaacctttcattacagatataatttagcatcaaacagaagggcatatcggcatgatagttgggcttaaagtgggtagataattgcaatattaggcctgatgggggaaaatgtcatgaaaaatcttactatggtaaacaaaagaagtcttttcaatcagactgtcctgggtacaaatccttttggtatcaattgtgcagcattggacaagctatttaactgctctgtgagcctcagtttacttccatgtaaattaagaaaaatcctacctaccatatatatttgcgtgtggtttacaatagactaaatatatcaaatgcctggcacagagaaaattcatgacaaatgtttgtttgcttagtctgaattgaatatgaaaatacagtcaatctcctataaaggattttcttttattattattattattattatactttaagttctagggtacatgtgcagaacgtgcaggtttgttacatatgtatacatgtgccatgttggtgtgctgtgaagagtcctcagtaatgtggagggaaatgtattggaatatagttcaggggctactgattgaatttcatctggtctctaccagtaatcttttggatgatatgggaggattcctgtaacctcactgactgtcattgtctgtaactataaaaggaagagtttaatttgattctttatttatcaatgttattttatattctttgagaatagatgtttttcatctagtgagcattgagtaactgttgaattagttcaataatagtgtgatgccctcctatggggaacttgagtgtatcattgggaacttctgtgagaaatgtagacgtcacattcactctattcatgctatgtggaatctataaaacatatttgctgtagccacctcaggctttgaatggattgtgtcggtataaagataggcaactgctaacaaacatgtaaggttctttaccccagcatgtggacttgttttccaaaaagaccctgaggatgatagaatctctctcccataggtgtccaacaaggaaagtaatgtattttagacttttcttggccattgacctctggactaacaatagtttcagaaaatttttcaattcactgaggaaataattctccaacagcaaaatgtattttattctttccttccctctaacctgctccagtgtatcttgttttcctagtctttcctctcttacatgaggatggataatttttctctagagctcagaggatgaatgctcttgacctaaccctcattgaagaaaggcatggaaagcctgccagttcaaatccattgctctaaaggttttactttctgttacatattatcattgggtggtccaaaggggtcagagatggaggttgtttcagaacctgaagtctttactaaaaaagatgaaaccagaaagaaaccacactgggtacaaagcagtgaggatccagcctattgtttccaaaagcctgctacattcaagacacagtgaacttaacccagttttgttttgttttttagaagaacagccatcttgacttcacaaagagtgttggtcagaatatttaactactggtacagcagtggtactgaccaaagagaatagatactgcccaatcagaatggacaccagctgtaaacaaccagtgtatccatattggtgcacactggcttttaacatttgcccttgcaaaaactactgaaaatattaaaagggaatctcacatgtcagagtcctctgttctaccaaaattcaacttattttatgctaacaaaattatttgaaactaatctaatcatagtctctctccagttactgcctcttcaccctacttcaactaacagcaaagctcctcattagagttctgtatttatttcctctacttctcacctcccattttctcttgaaccaactctaatcaggcctttgtccccaatgtcggcttcctcaggagctcaaaggtcttatcaatatcaacaacccccatattgccaaatctgatggttaatattcagtctttttattacttaaaccttcaggggcattagacacaagttgatcatgccttcccttgtgaaacacttttttacctggcttctaggacaccactttctcttgttcttcttctattgcatgccatttcttttcagtcttctttatgggattctcttccagcttataaatgagggagtgcctcagtcagtccctggcctcttttcttggctttctatgctccctttctaaatgattttatccgattctgtggccttagatcaatagactggtgagtccacatctgtatctccagccttgtgctctccccaaagattcccaactgcctacataatatacctccacttggatatctaataagccctgccatattagcatatactgagctctctggatttcttacccacttctctattttctgcaagtgtattggttccccaatgtctcccttctcagcaaatgctattaccatttaccagttgctccagccattcagaaattcagttggtgatgccttcaaaatacaccttgatccgaccacctggccacccttatttaaatggctgtcatttcacacctaaactactgcaacagtctcctaatagatttttacccctcctacagtcagtttataactgtccacatctctcacgctcccgtgaccattgttaccttgctgtttcttcaatacaatcatctcatttcctcctcagggcctttgtacttgctctttcctctagctgatatgatcctcctccagagcttctcagggcttcctctttcatatcaatcagtactccacacaaaggtcatcttcagagaagttttctttttaataattaaaatagaagccacacccaactcactattctccatcccccttctctgctttatttgcttcagagcacttatcactatttgacttcacattatcttgctattttctgtttggtctgtctccccaaatagaatatatcctccataagacattccagaaaaaacatataatcatagaactgaaaccattgtgaagaactctggaggtcattcacctctacccaccatctaatatttagatcaaccttgtactctctccattatttgtaaagtgaatatttttatactgaatcacattttcccactgatctccatcatcattattttttcatggagaaaaatgacctcaatattaaataaaaatgttaccaaggacaataatacctacttttgacagtatgcaattaattttcctatatagcccataggagaaattagtcattcagacaattgaatgtgaccattcctggcagcatgtgcggagccagaacagatactggagcagtgacattttgtaccaaatatgcaaatataataaagcaccaaataagtaggagctatgtgctattgaactgtagccagagcctgaacaagaacacaaatatgttgtctaataactttgttccactagatttcattcattccttattggaggaacatgcatttgagtaagaaatatgccaatttatatagttaactttcattcttcttaagaactgcccactagatcaagttgtttgataactgatgaagatgatctaagatgacttatcattgagtgtgtttctttagactttgcactaactttagttatcagcaactcttcagagctagttatttgtaccctctttccccttttattggtgtctttaagatgttaagcactctttcctgtgtactggttaactatatttgcctagtgaaggagtactgattttccattattcctagatgccacatgatgcatttctattcgttgtaaacacttataagactgacttatattttgtccttcatcacatcagtctgccagggcaagatgtctttaaatgaggcccagtgcgtttcatcagacacatttctaccttgacacttaaaggaatgatgttttcaaggtgtctaggtgtaatgaagtttgttttaaaaacccgctgctatcttgccaaagcctcaaggcaaggcctctgaaaagtaacagactatatacttacttttcaggcctcttctgggcttgacttatttgctttttctataggcactaaactattacttatatttcatttatatatgttgacttcagaattttccaggaaaattcatattggcctttgcaagtaagaaaaatgattgatgaataaaagatattaaacaatcctataaaatagatccttaggataattaaattgcttgagcaacaacaattttgagagttcattgctgtattagaatacacaaaagcacataaaaaagtgaagtttttaacaacatttcaaataagggtttacagtttgacttggatctgttttagtgatgaatgaggtatgccatctttactacttgttgaaaaaagcctacttgaaccagaaagtctagatttttctccacagattttaaattctttaaatagcataagttcctcctgagagaaaactccaaagagttatagaattaatttgcccttgaagggaaaaacaacagtgaatattaagagaaagtgagaatacaacataagagaaaaggggagttgtcaaaggacatctaggaagtaacctcctgcaatgtctctattgttcatccttcaaatttatggcagggcatctcttaacattcaaccttgccttaatgctcctcctgctgtcatccgctatgtgaaatgatcccccaacctttaaaatcacatgttggtttacattctctttccttgttctctcacttggttagacatgtctcatgaacttctttgtatttacatgatgactaaaagggtgacttggttcaacccaacaaacatttttaatcaactctccaaacatttactgcctcttctcacaatatttacaatgacttccactctctctaattgtccactcctttcctctgtgatcaatgacaaatggctcaatctttgtttcactctctgtataattccagtacacctagtttatagggaaaaaaataagacaaccaatttttaataataattaatgtaagatgatgtataacgtttatttacaaaaacaagtatttattgtgttgtttctgtttacttatatccatcctgtgtttccatttatgtgaaaccacagagattctttttttttttttttttttttgagacggagtctcactgtgtcgcccaggctggacaggctggaatgcagtagtgcaatctcggctgactgcaacctccgcctcctgggttcaagtgattcttctacctccgcctccccagtagctgggactacaggcatgagccaccatgcctggctaatttttgtatttttagtagagacggatttctgtcacattggccagggtggtctcgaactcctgaactcaagtgatccgcccgccttggcctcccaaagtgctgggattacaggtggggattgttatatatctttaaccttcagagagctccattcatcaattcaacaaatatttgagttcttactatatactgagcattatttcagccatagaaaattcagcagtgaacaaaacagaaagaaattcctctaagctccctggagcttacattaataaacaaataaataagcaaaatctactgtatgtcaaggtttccaaggatttattcggccaagtgatactaggacaactttgccaattagaagaagtacagtgttgctgaaagaaatcaggcactcaggtttcttaataagaaacaaaaatatcacccaaagcctgagtacaattcttcaggccaccactgctcactgtcatctgaaattcggttgctaggacactgctaagcatagcaaagctaaggacactttacaagctggggaagtttttggtagaatgatgttatgatattcatagatctaaattcagttatgaaatacggggcatagagattaacatagaaagaaataaatatatctgtaaagttgacttttgatatcattcaagcttaataatctaatgcctataaaaagaagatatacaaattattacattgaaaaactgttggtattttatagtaacatttaagaatttatagcttttcactaaaatctaatctaatctatctcttaatttcctcataaatcaggtggctaatttttagcctagaaaatgcaacttttgttctgatactatggctttagtttcgcagggtagggtaatcagtatcattacatttttatcctctaacacttctctaaatagaagtgaggtctcttcatttaatttgggaaattgaatgccagtcagggaattcaaaacagtgttggtttcaagtttgagtttccctgaatagtaccaaattattttccttgaccctgaggcatgggtctcaatgagaaaacatagggaaattatgaatccaagatatcctgagacgatcttgcctacatatttaacagtgaactgaaattttgtgtctattgtggctcatgaataatagggatcagtaactgattttcattgcataggcaaaagtaaaccatccatatatgtaaaaaataagattagatatatgtcatgacactgtccttttatttttatatgggaaatacacccatatgaataaaaattaactgtttgtcatatatgaagcaagatgcaaagttgggagtctgttcacactgtgaacattaccttgaactgatgagaattggagtagcgtaataccttgtgcctaagtaattctcacatcactgaaccacaaatctgatagacctctgcagttattgtaagatttaatagcagagaacgataagaaagctttgaattactaaacactgataacacttcttaaagaacaaaataaatgaatatttcataatatacaatcccaggattagcctctctaccatgggctttgtagctgaacacctcttgcctcgtcattcccttaattcaacatttttatcttgtgttcaaaatatatattttacatttatgtagaaggaaagaaagccatgactctcataacacttctatacaatctgtatataaaactggctatacatccatagttatgatgccaggagaatctcagtgtttgctatgaatcacccattagtcaaatctctccactcatcagagtctgattagaagccaactatccctggggcagttgttttttgaagaaaatgttaaagttggtcttcttgtttacatccggatagtatgaatcaaatgacatccctgtgatgaaaaaaaaaaaaacaaaagaaagaaagaaaatagtttaaagcctctcatggaactggcttttggtgatgactgccttcagtgattctcaattagaaaacatagagcaggtaaaaataattccagttcttaattaaaagcaggaaatgatgtcactttccatagttaaaggcagcatgacctagcagaaagtatgtattctttggagccagataaaacctcagctctgctgcatggcacctatgtcactttggacaagtgacaactttcctgaggcagatgttcacatctgcaggtggacgtgttaattagcttgattgtggttatcattttataatgtatgcatatatcaagacatcacattgtgatcttaaatatatgtaatttttatttgtcaattatacttcagtaaaaaatgggctaataatagcaactaggatggttttgtatataagtatatacaggaatatacagcctaggattataatagaacgttgcaggtgctccataatttataacccaaatgtccacagatttcctctgccatcagttacacatgttgctgactctccctcccacctgcatagcagcagtgtctccctcacacttaaagtctttcacacacagtgtgacccacattgcacaagaaaccagtaagctcctgttcttctgtcttcatgaaactaatggttacatgtctctgagggaggtgcccttctcaacagccctgttccaggtgccctctgggaggactgtgctctggcccaagtcctgggcaaaggccccagggggccagtgctctgcaatggataagggcagaaaggagaacacgactttcttcctttttctcctggaccttgaaacagccaatgtgtgaccctcctggaaacatacctatccacttcctttgcttcactgtcaggataaacttgaccttgaaattatgccaggaaataaaccatttttgttggacattcacctgtctttcacctctgtctccagtaatgtgctaatgttatctcatcctcccagggagcttgtgaggctgacatatttaacaccaatttatagatgaagagactggaacctagatagattcagaataccgtcccaaatctctctgctttctacctcctttaaatacctgaggtttcaccagcctaggatgtccatttccttttttttttttttttttttttttttttgagatggagtctcgctctgtcacccaggctggagtacagtggtgcgatctcggctcactacaacctccgtctcccgggttcaagcaattctcctgcctcagcctccagagtagctgggattttaggcacatgcctccacacctggctaatttttgtatttttggtagagatggggtttcaccatgttagccaggctggtctcaaactcctgatctcaggtaatctgcccacctctgtctcccaaagtgctgggattaccagggtgagccaacacgcctggccaggatgtccattttctattaaatgagcaccacatgttctgcaaaacattagcaattatcattattacttttctgctccaagtcaaattaggccagagtttacactcactcgagaatgatgagtctgaagaggtatctagagtaggaattgaaatgtaaaaatcagagtagtagagagagagaatggaggcaaggctttaagagattaagtaaaagaggtttggaaaaacaaaatcttgattataaaaagtaaaatagaaaggatggatatgaaagactttatgaatgagtcatcatctattttatttatcttcttttaaaaaattcttacatggcaccacctgcttctgtcacacttcacacccccaggcccaaactaccttctctgagccctttctttaaaaaaatacaaaaaagtaaagtaatcttccagataaaaactaagacttgttcttccccctctttcctttacccttcatttccgtaacttatctttctctgtgaaagtacaggtgggaaataatcaaggaactatttgtgtgtgtgtgtgtgtgtgtgtgtgtgtgtgtgtgtgtatgtgtgtgtatgagatttttatcatagtctacaagaaatctctagagattgctttcaaactaaaaccaatttcatacccaatagaaaactttagtttcattgaaggaaaagctaaatgggagcattcaaaagtgtcgttctaaaaagaagccggttctgaatacacttgcccaattactaccaagaaatcttctcctccttaaacccagaaataaaaagagaagtgcgctattgataatgcttcgtgtcatttatgcagggcaagtgaaaggtattctggttatcagtcattttctttgtcaagcataatttttcatgagttatattttagcaaaatactaaattcaatgtctattattattatcattattattattattattgcaaacgtcttccaagcaacatagaaagaacaaaggtggcattagtggaaaataaaaggcaaatgcacgttaacctcagcaatagttcacatgtgttatcaccgatgcatcttctgcatcttctacctcctttaatgcatcttaagtcataatattttagatcaaaatgtgccaaattaattcagctctagtgcgttgggttttatgaacctcccaaattacctgtctatttgctgctgatgtctgaaagacaagtggaggtgagaccaacaagagatttacatgtaccctgatagaaagggataatgttgcatcgttctgttttacttcttgtatatttatttctttttagcagcttgaaatgatccatagatccggaaactggtagacattgcaggctttcctcgttattgccactcacatattgtcttcttcaaggcccattctctcttaaccagagctcccaacagagaggacagtggaatagacatggaaacctctaaaaagtttaggcactatattactagcacatccctctcagctgcatatataaaaatctcaaatagacttaatttctttatattgatgtaatagatcaaaatctcaaattaatattttgtttctgactttttcatattcaaattctttaaagaatattaactaaatataggactgattatttggtgattatttaggtgttacaagtgaaaatgtgtatactaatgtctatggatctatctcaaatgtttcttcaagttttgtgtattctttcttcacatgctagttttgaactttactttggtgcctctatctgaaaaccaagaggaggtgagacacctaaaaatatcctcatttgcatctgtttcccttccttcagagaaggagggttggcccacccagttttgccttgacaaccaggaaatatctaatgacatggaattaattcactgttgatccctcatgctaccatgtcaggtcttccattatttggctcaaactgatgctgaattgcaagagagcaggacaggagcctgtcatttttacattccggatggttgccagtagacatgattaataaaagtcacttgatacaaatcaaagaacttggttaagtgaatcagatcctctttactttgtcttcttacagaaaacatgctataaggttcatactttttaaaagtcatgaaacaaaatataacaaatttaccccatatttattaaatagggatcacttccttcctaaaaacatttaagtgcagttctccagaatgaaagagataaacatgtgtagatgcaaatcaattctgtattggtttcttattaccacattaaaaagaaaatctgaagatataagttatgacttaattttgattttgaatgcatactgctacctaatgtacataaaataaccatcacagaatgaaactgatatatccaacagctggctgcatttaaatgattttaaaataagtgcttataaaaagtcaatttttggtgttttgctgcttaggaatgaaacgaatcacaaatgtttttatttgattttctctgacaggactgggaattcccacatttcatgggagatgttgatgtaaatctccctggtttgcacacccctcacatgcagttcaagattcctttcttccagaaaatcttcaaggaggaatatcgtattcacataacaggtgtgttatatctttgaacacaatttgattatcttcgtacattagttagggtaatgctagttgctgtaaaaagcaagccataatatttgagaggcataaatacaatgttatttctcattcacttaacagtgcaaggtggttttcagatcaacaaggggctctgtactatcattctgggacctaagttactggtggctttgacaatttcagtgttagcatccagcaggcagatggaaatacagagaatggggaaagtgattaagaaggcttgtctgttccgtaatctcttgggcttggaaaagaaatatgtcacctttcctcatgttccattgatgataactggtacatagccctacttagagtcagggagagcaaggaaatgtagtccttagctgagcagccacttctggtgtcagatctggtattctagtataggattatcaaagagggaagacaaatctttgctgtggagagtcatttctgccatactccatatgccactctaccttgatcttgttcattggatgggtttttcaccacatagaactcagtatctattttcaatgttatattctttatgctcttgttcttcatttgttgctgaaattaaaacaatggtatcctagagccccaatcagaacatatgtctttagggagttaggccacttctcatttgattttctgaaaacctacttctgtggcaaagctcaggtttgtcttaagtgattctcttgtggatcttcagattattttattttcagatattttctgcttttgaaatggctaaaatatgatttattgtaatatcctttcatgacatatcagtcattctcatctaaaaagggcttcccggagctacgttttatatctgtctttctttatgacaagaagcagacagctgaatgatcacagataaaggatggcattagttccaaagctgttcaaatgcaggtaatgagtgtgtgtctgttttaaggacaatggcctaggatcccacacctgctataataaaatctgctgaagaaatctgtgcttacactaccgtctgtgctgccaaataaaaatagtctgagcccagaaaacattaacatctgagtactgcaataaacctttgcttcccagctaggaggctgttttttgctttaagcatgaggcgaccttcctaaattggagaatgagctcatgaatagggaagatgcagcaggtttcttttcctattcaaaatgaatgaggcccatctattaaattcactgggtaaatcaatcaatttgagttcaggtcacatagtctggtttcagagtccccacttaatctctgcagcatgctaccctcttggacttctaaaacagctatcacacacatggcatcatcatatccctttggggggggcttttgcgtagaccatctgttcttgctaccagctcttgtcccaggccatcattacactaatattgtctctgactataagaatgccttgtcaaaaatatcctgcttaagtacagaacttcaggttaaaaaaggaaaaaaaaatggagagcccattggtaagaaaaaaaatgagctgctaaaaatatttaatttaggattattttgtataactttatcatttacattgtcatttatagatggtacagatttcagatttgtggtgtccagagtttacacaatgtggaatactctgtttaagaagatgaatataaaattacatctcaaaattatattcagtgcctcggaagggggctatgcatgcagagtccctaaagcttcagtgttattaactttgaggtaaagcctactgtgcatttagatagaagcagatacatgacttccatttgaactaaaaccctcttcccaccaagaattattttctgaaaacctaaaaggatgaaagactagttcaacttttatagcagagactacatattaatctggtttgcccgaaggtggtaatgtattgtaattaaggctttggtgcagtgtttgccatatgatgctgatggccaagtcatcagggaactttataaatacacagattgttgggtttcattactaatgttttgatccagtaggtctgggtgagggccagagaatcgaactttgggaaagctcccccaagtgatgttgataattggggatgtctcctttctgattgagagatgacagatgagatcagagcatctccctgaaatgtgccatgcaaacaattgggtgtctggacttgccaaaaaggcttttgaggattctggagcttaaattcaaaatattaataaaataaggggctgaacgtggtggctcacacctatagtcctggcactttgggaggccaaggcaggagggtcacttgaactcaggggtttgagacaccctgggcaacatagggaaactcatctctaaaaaaaaatagaaagaaaggaagaaagaggagggagggaagaaaggaaggagggagggaaggaaggaagaaaggaaggaaggaaggaaggaagtttggcatgatggcacacacctgtggtcctagccacttgggaggctgaggtgggaggatttcttgagcccaggaggtcaaggctgcagtgagccatgatggcaccactgcactccagcctgggcaacagagccagatcctgtctcaaaaaataagctaaaatagggtaggtgaggactttggagtgaagggttccaccataaacaaattaaatccaatttgtgataaacccagtttgttcacatgcatccacatagccatgataaaaataactgggaaaatggcacaggtttggaggttgaagcagtctgagcttttctctcttgcttttgttctgtttcttttactctctctgttttgttaattggctgaagagattgctgaggccaccccagagtagcatctagtcttctgtgaagggctttttactttacctgactacatttgtaagacaattgtttctgtggaaaactaggtaaaatttccaaaatactgtgctacatgctgcatttcaatattctcaatagttagcagcctacaaatttccatgtgaactacaaattctagcttgctgatcagctcctccgagccctggtactttttttatggagacttcagtgcttttcttgataactaaatacagtgtcaccactggggttattaagcataaaaccctctagatccgtcaggggatgacaaacgttaatgtgtattggaatcacctggagaacttatttaaaagacagctgcattagccacacctccagaatctgatgcctgaggtatgcagcagacttggaatccacccttctgtcaagcatggcaagtgatacgtctgctggctggcagaggactgctctttgagacatgctgctgctgagagacattttctatagttagaattcctcttatctcagctttaatttgttttcatatgcaactgttaaaatcaaaagccaaggggtagaatgcaaattcaatagcagtgggatgaccagggagaaaggcacatggtagaatcctcctaggagctgaaattttagagctggggccagcagaggagactatgattggggaaaggtgctggtctgagtgaccacagaggaagctggagccagggatgggaagggaacctgtagaaccccagacggctccctcttttgctttatctgctttgtttgttctgcactagaagagcctggacaaggactgtgaaaggtctcctgagtcaaaagttgactccacttggccccaatctaccatgtccctatgatttagaaaagacatccagcatacactgaagcaatggagcaaagaggttggatacatgggctctagctttgctacttactggtggtctggtcctcatcgagttccttagcccttcagagactcagtttctcgtctatttaatgggcacagtaataatacttatcccatagggttgttgtgagaattaaattaatatatgtaaggcacttatgacgctgcctgccatgtagtaagcattcagtaagctttcactgtttttttacttaaagcttttcctttcatctggccagagattgtctttcctatttaattcagaaatgttgggtagcttgagagggtgccctcttgccacttacccactattctgagttttctactgttatctgctgtcctgagtccttaaaaaggagaaagctaagaatgcaaaattctctctcccaatgaaatattctgtatgtagagggttatgacactgatgagttcccactgacattttaaaagcatataggatttgagtatttttttaatcctgattccaagctagttttatttatgcatgtcagaaataacttgaattgttgcatctgtttagctcatctggatcccccttgacagatggcttgctgcagtatgtatgagctttcattttataagctgggctacagcttataaaaataaatcatttctatccaagagtgttttaaaatatattttttcttagaatatgggcttcagtaacaaagggaataaatggttagtgattaagtcacactggtacttttagcccaagttcattgttctcctcctaaaagtaaaccctaaaagcaactgtataatgatcttctctgccctcttcccctttacctgtaaggtaagtgcatagatggattgaaaatgcgatgtactaaatctctggaggtgagagaggaatggcctctcaattcagtctcggaagctcctctgagtcctattaatgccaatcccggtggaagctctgccatctgtcatcgcagccaaaggaagtgtcccattggtggccatcatctgagtaaattaggagggggttgggcaaaaggccagaaggaaggcctgtgcagccttgagaaaagaattcacactgttggcacgatgatgcccacgggaacccttttggcaaaaatggaacatgtagaagtaaacaagcctgtatagtgtctgttctatttcagtttcctgtgttgtgtgagggtacaggtgttttacaatggtgagaatgtggaaaataatgagtaaaaatgaaggattttattttcataggtgcatgatttctagcaaatgagttcccagagactgtttttttttaaagagctctcctgtatgaatcaggccatgagaaggctggggaggggacagccagtggttcctccagcagaatgttctgtctggcaaaattagcaagggactcgttataaggaaatgtgttgcatcctgtatacaaagaaagtccccgaagatcatgaatttatccaaagtacacaaagacctcttgctcctctctcagttgtgaatttttccaaacctttcctcaagcaattttcattttcagctcttaagagttaactatgtttacttctatataaagcagcaattccttttatttgtccaaaactcatcttcttcagggccatcattttgcccatggcctgtcagttcttgctggccctgagtttctgccctgcccaccctgaggtatcctgtcttcatttgtacatacatgagcacctttgtaataaaacttacatgccctttaggaattgacttcagagccagaggaaggactcgaaatatataattattcataatccttgaaacatgaacattttgcttttcacagtttttcagattatgtccaattttagctatgtcgtggaattcatcagataattatgatacatgcattttatttgaaatgctaaaacttctcttttcgtatttttctgggcacattgtctcagagtttacaagttggttaacagatatttttctgagttaatatgtgtcaaaaactagttggtatctggagaacacagaaatgaacacgacacagttcccaatctcaagaaagtcatagtttaatggtcatctaattcagtataaccacttttcttctttctatgcttatgatcacatgttcctacctgtactcgtcacattggattgcttcctaagaaatagtctcccacttaggaagtaacaatgacaagagaggcactttgagaagttgtatcagtttgtttttaagtcttaagaaggtactttgataactcaaataattatgactacttcataaattaataagtaaatattttcagtttacgaaatggcctcctcatgacccaagcacttaatgtggtttctagatatccctaaattgcctagggagagacatgaagagatgctaactcgtgagccctgtttttactgctcacatctggaatgaggggagattaggatggatggccaagaagactgatacagcaaattgcatatttcttttacttatccaaaattcatcttcttcaaggccatggttttgtgctgtcccatgatggttgctgaatgactttggggagcgtaaccacatccatacacctgcactagatgtcaaagtctggccaagtaatcgcacccatgtggtagagaggggcccacagcacagctcatccacagtgctaactggcacctctgcagagtaaaagattaaaaatattatatttgcatatttcagtcatgaaaagttcattatatggtggaattatcagtaccttatagtctttttccttagttgaaaaaaataacactttccctcaaattgttgtcatttgctatttgagggtgatatttaatgaagaatccttttaaaatgatctatcctcagattctgtaaactcccacaaagtaaaaagataaaattttcattataatatcatctctgacaaccagtaggattcattaaaagcccaaaaaccaaaaaagaggtaatcccaccaacaccacgcagtgatttctcattagaggagatagtgaagtatttcaacaaggagattaatagaaagaatgtatggattcttaccctacctccttgctgatttacattgtgctaggtagttgaaacaacaggggaaaatgcaaaagctctcatatgattaatgctgaaataccaaccctctggttactgtcgattgtatattcacaacaacacacttgggaaaatggctatagaagcactttctattctgttcttttttgtcttaaatcctttctatctgggtcatttcagggactcaaatttattttttatggtaaacactgtttctcagaagatacaattttttttcagaaaacctttctccttctaaaattgtatattccatcttctttgctctaatgttgagattttctggcccagcataaaacactaagatttaggcaatgtttatttcacagactcatcaaagaaacttttagggctgggaagaaatcttaaggattatctagctcaactccctcactttatagacaagaacacaggggttgggttgccctgcctgacttcaccttctgctttgccacatctgatagggcaaaaggaattttttaaggaggagaaagcattaccaaggtaacgacacagtgtgtgggaaaaatggaaagatggatgacagagaaagatgaacatccttcctctgtaaacagataaatgaactagaggtcatgtcagatgggcagaaacaaacaaacaaaaataataaaaagggccattttttctaccattttagcagcttcaagtttcagctgagtgagagaaggacactgctgcatgcgcaggagggagaagaagggaaatgtgatatgaataggcagcctggctcactgcatcccttcccctctgcacttccccacccccacatggcctctcttctgtgggggagaggtagggacacgatcccctgttttttagtctcaaaattcatagatataaaaggtctttcctcagggccaatactactgcaagcagtagacaaactactaattgctaaggatttttaacatgttaaatatgctgatttagaaagcatatttacatagagccacacactgagtcctcttggataactggtcccatgtcatcttcctattattgttggtatttagtaatgcatactgttttattccaacagaaaaattagataatgtaatcacttttaggatatatctttgttacaatccttatgtgtccttctctccctctattccgtcaccaagatcctatattgtctggattgaagaagtagagaaataaattggagaaataataccaccctacatttttggcaaacaatatatttcagagaatgttctaacacaacatctcattttatcctcacaaataatcctttgaggtagttacactggtattattctccatttcacagaataaaaaattggattctatacacgaccaataagtagacagatttggggtagaagggcagaattatggaactggaaggcatctagttcagttttctcaatttgaaaatagaataaccgtggtctagagaggttaaacaggttacccaaggtcatatgctttaagttcagtgttgggatgagatgcccatctgctcatttccagcctgcagctttgttgccatggtgctcccttttacaaaccagtaaagatgtgttggagtaggtgatgatatccgttaactgatgttaggccatacagttttaatttgctccttctccaccccatctaaatgttcagacatcaggacacatgagaaataataaaaagtgatccttgggtgtgcaagtttagtggtcaaactgacccagcactattcacttggtagaaaaataattaaatagtgctggaaaagttctttgggagaaagaaacctttgggagtcaagaaagtagtgggagccaggtatggtgacttgagcttgtagttctagctacttgggaggctgaggcaggaggattgttttgtctaggagttcaaggctgcagtgagctataattgcaccactgtgctccagccttgcaacagagtgagacactgtctcaaaaggaaaataaaaattttataaggagacggtgatcagtcatacaagcacaaggacctcttcccccaccatctggtctggctttgtaacatgtacagtttacagcaagagaataaatataaagctccgacaacagaggagaacccaaagcccctccttcaacttgctttctgtcatggaatctacagattagtgtctccttaatactggataagaatctctgaactttttcatttctcctgtttctcatccctttcctgcctttttctacaataatctccattcttttccttttctctcccctcagcctctttcttccatgttatctcatcttttatatatgctgttctatctacaacatactgaaagcataaacgaaaataaacacaaaattttccaaactattttctgtcctgcttgttcttcaaggaccacatgaattgttccgtcctcaaaatctttcctgcagaaagtatccttcagtttttttccatttcctcaatatttacagcatttatggtttgtatcactcatttggcacctccagatgtagcctctcactatttatctgttgatctctgtcctgttcccctaacaagatgatgaaatcctttctgaaaggcagagacatatgttttcagcatctaccagtgtgttctacacggagtctgttatggttgatctttaatatgaacctggtttagttttgaagatctcatgagtggtttgaacttaacagcaccagacgctatagatattttatcatatctgagacaacattcccaatgttcaaaattactttccagttgggtatgcccaaaaaaatcattcaggcaagagttttcatttcaaatattataaactctatatagctgaacaatgtcaggacaagcagttactattccccttcatatagtttaggtaagctctcttcatagaggagcaagttgcaccttctcatgcaaataaaaaaattatcatggtttaggcaaggctttcgtgatgataattatagcaattactgggcccctattatgtaccaggcactgtccttagcatctagtaatcgcatgaaattctgacaactttaataaatactattattttctgcatgtaaagaaactgggctttggagtgtttaacaactggctcaagatcacacagctagtaattttggagccaggattaaaagtatttagccttacatataataggagctttaataaaatatgtaattatgatgataaaatattttcctaaactcctcgcagttatgtcttttatatttttatgtagctagatattttgttagactgtatattgccaaatacataatcatatgaagcagtaacaataacgttaaataatgttacttcaaatacaaaagaaaaaagttttggcataatacataaaattattataactaaagcttctggaacctggtacatacgtcccctaacttgctacagcaaacctatgaggtaggtattactgtattattataatatacatgatacttgcaataatttataataaaaaattataatagaatctagtatcactcgaaagttttttcaccttttgtccatttgtagaaatcataataaaaattataatggactctagtatacctgaaaagttttctagtatacctgaaaagtttttccacattctttccatttgcaaatgtaaaaatatcatttgataaaagatcattaaatattgtatttatataagattttaaatattaaaaaaagaaataatagttgcaatctcttcaaatatatcttttcaagcagttcataaggtatggttacatttatgtctgataaatgcattttgttcaatgagaatttgatgtaattatttttaaagtcttgaatgctcaaggattattgatctgaatcacatcaactaatggtttaatcaacaggtcacctacaaacagcaatatgaattaatttgatatactgctgtgcttgcattgcaaaatgatttatttcttgcccagacataattataaaactgtaagagatgttcaatcatacattgaacttttctaagaatttcattagactttgttttttcacattaattgaaatgttctagaggataacctacatggaaccaaatttgagtatagctgtggtgcctataaaacaaggagacttaatcttgttagtataaatgccataaattactggctcagggacctacagttgtgttttcatatgcccagaatccatttagtaaattccctttgccaattcacttaatggcagcacagcactctcaaaatattaattgttaaccagtctgaaacattaacaattgatgttattataccattatcctcattttattgtagaaaaccttattgcaattttatggccctttgattaatgcagtatttcttttttaatgcaggcaaatggtttaactatggaattatcttcctcgtcttgattttggatcttaatatgtggaagaaccaaatattttataaacctcatgaatatgggcaatatatcggcccggggcagaagatatatacagtgaaagactcagaaagtttaaaagatttgaacagaaccaagctatcctgggaatggaggtccaatcacactaaccctcggactaataaaacatatgttgagggagacatgttcttacacagcaggttcataggagccagtcttgatgtcaagtgtctggcctttgttccaagcctgatagcctttgtgtggtttggattctttatttggttctttggacgatttttgaaaaatgagccacgcatggagaatcaagacaaaacttacactcgcatgaaaagaaaatctccatcagaacatagcaaagacatgggaatcactcgagaaaacacccaggcttcagtagaagaccccttgaatgacccttctttggtttgcatcaggtctgacttcaatgagatcgtctacaagtcttcccacctaacctcggaaaacttgagctcacagttgaacgaatctactagtgcaacagaagctgatcaagacccaacgacttctaaaagtacacctacgaactagactcggagatagacttggagataacacaaaaagcaaccttgagtgtaactttaaaaatttagtctttccttttgtatatgtaaggtttacgtagtgttaggtaaaaatatgaacaatgccacaacggtgctcaacatgctttttctaggattcattgttttctatttgtattataatacacgtgcctactgtatactcaacagtcctctagagattgcttttcacaattgcacaagctattactgactttacagcatagtggaagattagctgatgacccatgtatctgatgttcaaccatagtggtgccttgagacattaaactgtttttaactgtaccagaaatgaagtgtggaacagttacctaacctatttcacatgggcgttttgtatacaactattttgatctacacttgatgtctgagcagaaaacagaaatagctaaatgtgactcaggaagtatctcttggtttcttattcagcagcagagttggtgactttgacaactggactgcagagaaacatggtgatcaccttttaatttttattggctgtctgccaaatataaatacagatgcaaaattcagtaataggagatccataacccaacatgggtcactactcgtgaaatgtgactttctcccaccagtaattgaaatgaggtgatgatacctaattatgttttcctaattaaagataaattgctacttgattaaaaatcctgcccttcacctttgggaacaaaggttaagagacacagttgggcgaactctcaaatttattggcatttacacaaagtcccagacaaccaaggaactgaagttttcatcatatgagagcagcacatcccaccatttacaatattcgtatatctttctgcaaatatggctctggatagtgaaaattgaaaaacatatgccaaccctgagcaagggaactcctcaaaaaatcatgcagcggaaccttgtcaggtagagaagccgtgcatgaaagaatttgtttaatgtcttgttttgcgtatgtgttttttgtttttgttttttaagaactaaatattgcacattaataaataagaattatacagca

SEQ ID NO: 841 - DNA, 580797 bp, Homo sapiens
gatggcttcactgagaagagtcaaagtgctgttggtgttgaacttgatcgcggtagccggcttcgtgctcttcctggccaagtgccggcccatcgcggtgcgcagcggagacgccttccacgagatccggccgcgcgccgaggtggccaacctcagcgcgcacagcgccagccccatccaggatgcggtcctgaagcgcctgtcgctgctggaggacatcgtgtaccggcagctgaatggtaaggacgcacgccggcgcctccggggctcgacgcgggcgggccgggcacagggtgagccccagggtccttgcgcgctgcgccctgtgcctgggagccggcacaccctggctcccgcgcgctccttcttacccttcctgccccgtttcgggcagatggccggggctgctggaaagaacaacttgcctgattcttttctgtgccccacctgcaaatttggttttatcctggaaacatgtcagtacagttggctcccggtccccgcgtgcggactggaaatcattccctggcgactccagcccgagcgcagaaactagtggaggggccacatgggactggaggcgcgcgggcagacgtgtaggaggaaatagtcttagagcccagcgtttggtggggtaccagtagggaacctgggagattggagggcttggatgtctgcagacaaagtcaaggccccaggtcgcggagctaatgcgcttaggtagtatatgggaggaatatgtcatctgtctatgaggcgagctgctcagctaagaatgaggactcctcccttcctgccgcctgtgtttctccttgggggctgcggaggggcgattgttaaagctcagggtgggcctgcgaagtttccagaatgtagcacagagagatgtggcatcccattagtgacagttgtctgaatctgtcccatctaaaatgttgtgctcagtacttcaggagaagagggagactttttatgtgctcttgtcacacctgggccaggtcattggacactagctgtccccaacgtcagagtgagtgttacctacctgagtacaggcaggtttccaggatgcgtggggttatccaaggcagatacgtacttaggtacagactacctcctccctttctgagcttgtaactcatgttctcaaacgaactgcagataatcacgaagatcgtgataataataactgatggaattcttgctctgtgccagatgcgtgcaaagacattacaagtacattatctcactgtatgttcacatctgtccagcgaggctccacccatccacagaggggaaatgagaagactaagcgaggggaggttaactaagttgccctgtgttaaataagatataactgcgccccaaacctctgtaatcggaataataatagagtctggagtcagaaccctgtgtctggttgaccacagagcctgtgcgcttgacctcttaggctcaaacttctatccatggttttcccctaagtgaaaggagtattaggtttgttgaaaacagaaatatgtggaattgcaaatacagacatataccttctcacattggaggatctcaactgtcttcactgtggtggcaaggggcagggagaaggaggatggcaaatggttcttttcaggctcaccaaaggtccctgctgggtactgggggagggatgggatggagggagaggggtggtcagatctctgagcaggtgaaaggacgctgcggtcttctcgaagccatttgacagatatccaggggatgccttgaacttgcagggtatatggcctgactgtcagggtagcccacggaagttatgcagaagctcttctctcaggtgtcagaaatatggcacagaatgcgacaaaaacccatagttcatttctggaggaatcagaaacttacggggtggccttataatttgggatagattcctgctgtagacatacccataggaacttcaaaggttaacctggtttccctcatcaggcttttctcagggacacaggttagtttagtatcagtttctttgttttatggtttttttttttttttttttttttttttttttgagacagggtcttctcgctctgtccccctggctggagtgcagtggtgcaatcatagctcactgaagcttcaaactcctgggctcaagtcattctctggccttagcctcccaagtagctgggtctacaagtgtgcatcaccatgcccttctaattttttaattttttgtagacacagggtcttgctaggttgtccaggctggtctcgaattcctggcttcaagcaatcctcctgcctgggcctcccaaagtgttgggatgacaggcgtgagccaccatgcctggccccagtattagtttcaattaggagcattaaatattatatagctgtaccctaacttccctcataggaataataaaattctataataataactgatggaattcttgctgtgtgccagatgtgtgcagagacattacaagtgcattatctcactgtatgttcacatctgtccagagaggctccacccatccccagttgagaaatgagaaaactaggtgaagggaggttaggaggctactttctacttgccacagacatacatgaacccactgaatctttacaatgacttgcgagatgggtgctctgacacccgcctgaacaacttgctcacagtcacccagctagtgagtgtcagagctgggaatcgaacctggaatgtcaggctccagaatggaggttcttagctcctgcaccagtgtcttgatcttcagcatgtgcatcagaatcactgaagagccctttaagacagatttctgggcctcccgcccaggtctcaggtgaagcctgagaatttgcctctctaacaaacttgggacagggccctcgacccactgcccaacagtctgctgcctacatcaagcagagtaaaggtagaaaacccatccaacctccaaagccagctcattttggggacttaagctgagagcttgcttcagatcaactggcgtctggcttccttctctgtggccttctgccctgtaaacagttcccggactggtggagtcaggtgctgtggggtgggaaggctgagttttcctgacttgcaagttggcagcaaggccaagttgagagcttttcctgggcaagctaagaatgcaagctgcgactaggcagatgttaccatcctgactgcctagtgtcatttgcagtgacatgaagcctgcagaaaaagagcagggaaaaattgtgaaatatagggggctcttcctctctctccacctggcccctcaagcaccttcatcctctgccggtgcttgttttgggtaatgcgtgtcccatctgttgatgccctccgcctgctgcagtgggaggctgctccgagaaggcaaagggctcctagtgcctggggagacacgtgctctcttgctctgcagccggtcttcattcattgctcccgagggtggagaaggaaaccttgaccttaatgttctttattcccttggaattaatggagaggctgctagagccagtgcactgtgcatgtaagagggccaaagccacttggtacagagtgggagccaggcattttaaaggttgctcaagtttcttaaatctttcccgtggactcctgtgaagtccaagcaggtgggatttatggagggctctacctcctcctggcttcctcttctttttttttgagatggagtctcgctgtgtcgccaggctggagtgcagtggtgcgatctccgctcgctgcagtctccgcttcctgggttcaagtgactttcctgcctcagctcccgagtagctgggactacaggcacccgccaccatgcccggctaatttttgtgtttttagtagagacgggttttcgccatgttggtcaggctggtgttgagttcctgacctcaagtgatcctcctgtttcggcctcccaaagtgctgggattacaggtgtaagccactgtgccctgcctgtaggcttcttttttttttgagtcagagtctcactctgtcactcaggctggagtgcagtgatgcaattatagctcattgcaacctctacttccccggctcaagtgatcctcccacctcagcctccctagtagcagggactacaagtacatgctaccatgcccagctagtttttgtattttttgtagagatggggttctgccatgttgccagggctggtttcaagtgatccccacccccacccccttttcaccccacaccccacctcaggccttggcctcccaaagtgctgggattagaggtgtgagccacagcgccttgataggccttttaagggctggaatcatatttttgacttttttttttttttttttgagacagagtcttgctctgtcacccaggctggagcgcagtggcgcgatctcggctcactgcaagctccgcctcccgggttcacgccattctcctgcctcagcctcccgagtagctgggactacaggcgtccgccaccacgcccggctaattttttgtatttttagtagagacggggtttcaccgtgttcgccaggatggtctcgatctcctgacctcgtgatccacccgcctcggcctcccaaggtgctgggattacaggcgtgagccaccgcgcccggccattttggacttttaataccacccccatccctcagcacaccacagccccttgcacttaatggggcacttaaggtttattggttgatcaagttgttgggagctagtttgaggaggtaaatgatggccagataggaaataacctcaaggctgtaaagtctgggttgtgttggatggatgtggagaggggtgggggctgggaggactcagctagagagacagtgtgaggaagccatcttgcctccgccatcttgaggctcgtctagtcttcaccttcctgactgaagggaacgagatccttcgaggccctcggaagtgagccaggttaggaataggcaagtttcagcgtgttttcgttaaatgtatgatttcataacatgaatatggctttatagttaagccttgaaacaatgcagagattagggatgccaacacttgcacagtcaaaaatccaagtataatttttgactcccccaaaacttaactgttaatagcctgctcttgaccagaaggcttactggtaacataagcagttgattaacacttattttctatcttgtgtgtattatacactatattcttataaaaagtaagctaaagaaaaggaaatgttattaagaaaattgtatgggctgggcacattggctcatgcctgtaatccctgtactatgggaagctgaggtgagaagatcagttgaggccaggaattttagaccaacctgggcaacacagcaagacctcatctttacaaaaatcagctgggcatggtggtgcacacctgtggtcccagctcttcaggaggctgaggtgggaggatgttttgagcctaggagttcgaggctacagtgagctatggttgtgccactgctccccagccttctggctcaaaagaaaaaaaaatcatgtggaagagaaaatatatttactattaattgagtagaagtggattgttgtaaaggtcttcatcctggtcatcttcacattgagtaggtgaggaggaggaggaagggttggtcttgctgtctcaggggtggcagaggaagaaaaaaatctatgtacaggtggacccacgcagttcagacccttgttgttcaaggggtcaacagcatattctttttttgtatataaaattaattcatctttattgtagaaaatatggaaaatctaaaacaattatacaggatacaataccatgttaaaaaaatttaacatgattgcgtgtaggctttgtacaagcattaggaaagtggacctagtggtcgggcacagtggctcacgcctgtaatcccagcattttgggaggccgaggtgggtggatcacttgggcccaggagttccagaccagtctggccaacatggcgaaaccctgtctctacaaaaaaatacaaaaagtagcagggcgtggtggctggtgcctgtaatcccagctactctggaggctgagtcaggagaatcacttgaacctgggaggcggaggttgcagtgagctgagattgcaccactgcactccagtctgggcgacggaacaagatttggtctcaaataaataaataaaataaaaaagaaagtggacctagagacagacggatttcttgttagaattcttctttatgtgatttttggctttctatcatgtttctgtcactttctgaggaagttacttatttctctcattttagaggtgagaaaggtgagaaacagagatactatgtgacttttccagggtgacacagctagggaagggcagagccaggttcaggaataccagggtacttcctcccaggagtccagcactttcctaataagtaaggggaaagagatggaggggtctggagcttcacttgcccctcgcaggctcaaagccttagagacaccctctcctctcctcagagtccacacgcaggacgcacagcagagctgtatccctgtgagcccagggcagctctgtcataagaagaaatgcaatcgattcaacttagttaccaaatttagatttcagaaggatagtgaatagaagtggagttgcttaaagaaattgaaaatctttgtagaaatggagagaagtcaaaattacctcttccagtcctgcccccaagccactcaggcacttgaagttggagtctgagtgataggaaaccaagacgctcctatatagccccagcacaccacaacccacccaacagaactccctaggcaaggagagtgatttggcacagagagaggaagagatttgctctcacaggtctccaaggtggagtcagaaagagaggaatggtggccgggcacggtggctcaagcctgtaatcccagcactttgggaggccgtggtgggcagatcacttgaggtcaggagttccagaccagcctggccaacatggtgaaaccccgtctctactaaaaatacaaaaataagccaggcgtggtgacgggcatctgtaatcccagctactcaagaggttgaggcaagataatttgcttgaacctggaaggcagaggctgcagtgagcagagatcgcgcccctgcactccagccagggagacagagcgagactctgtcttaaaaataaacaaacaaacacacaccaaaaccaaaaacaaaaagagagggatggcatttggaaagcatctccgttcattaatgccagaggtggtctggtgttatatttcttctttcttgcagcccacagatgctggacggtaccaccatttcctgcaggaaggagcgaagggagagggcacatgtgcatattaaaatcagttgctgcagggaacatcagaaggaaaccagggcagttcaagccttcatttgctgcacgcagacattccacagggattgaggacaggcgcgggccctgggttatggaaggcttggtcctaggaccagggccagggtgctggaggacacccactccctttacctccaaggactcatggtgtctggttgcagttggcccctcctgaagaaatagggagtcctgttcttggacagccctcagatgcaggcacatctgtgttggcaggtgagtgtggtgggcaccctgccagtgggggcagctgccacctgcccagcccagaggtagcaggagaggcagccagtgtcattcttgctgaagaaacccaacccccctgacctttgctagttgccaaatctggagcgtcctttgtggaaaggaagaaagctcggtaattacttagagctaagagtgaccacaggaagttggaacatgagcacacccaagcccaaggccagcgaagaaacaacctacgattagatgacctgcgagtctttaagaatatataagaagaaccaggcacagtggctcacgcctgtaatcccagcactttgggaggctgaggtggaaggatggcttgagaccaggagtttgagactagcttgggcaacatagcaagaccttctctctacaaaaaataaaaaattagccagacattgtggtgcatgcccatggtcccagctactcgagaggctgaggtgggaggaacgcttgagcctaagagttcgaggcttcagtgagccatgattgcatcactgcactccatccatcctgggtgacagagcaagacccaaactctaaaaaaaaacccccaaaccagtgtattaaaaggacactcagggccaggcatggtgactcagggccaggcgtggtgactcacgcctgtaatcccagcactttgggaggccggggcaggtggatcatgagatcaggagttcaagaccagcctggccaacatggcgaaaccccatctctactaaaaatacaaaaaatagccaggcatggtggcaagcgcctgtaatcccagctactcggggggctgaggcaggagaatcacttgaacctgagaggcggaggttgcagtgaaccgagattgtgccattgcaccgtagcctgggagtctgggcgacagagcaagactgtctcaaaaaaaaaaagaaaagaaaaaaaaaagacagactgggtttgatttccactgtcacttattacctctgtgaccttgggcaagtcccttcactttttaagtgtaaaatgggactgtcatatgtcaggatgacttgaaattcaaaatgtatagcataagcatgaaacccaacacacggcagttgtaagaatacaaactacttatgggaagggccatgagtgctgtttcccatcatattcccgagacacttagagcagccctgggccatggtaggtactcaggagatgtttctttttctttctttctttctttttttttttttttgaaacagagtctcgctctgttacccaggctggagtacagtggcatgatctcggctcactgcaaactctgcctcatgggttcaagtgatcctcctgcctcagcctgcttggtagctgggattacaggtatgcgccaccacgtctggctgtgtgtgtgtgtgtgtgtgtgtgtgtgtgtgtgtgtgtatgtgtgtatttttagtagagacagggtttcaccatattgaccagcctggtcttgaactcctgacctcaagtgatcctcctgcctcagtctcccaaagtgctgggatttcaggcatgagccaccacatttggctgtgtgtgtgtgtgtgtgtgtgtgtgtgtgtgtgtttagtagagatggggtttcaccatgttggccagccctgtcttgaactcctgacctcaagtgatcctcttgcctcagcctcccagagtgctgggattataggaatgagccactatgcggggccctcaggagatatttcttgaatggatgcatggacagctagcaatgcttcatagtagagtatggtcattgttatttgctttgtgaatgtcagacgaggtgagagggggtccttttccttataactttcttggactcttcagactacttttggatccttctctcttccatgtgtttatctgagccagactccatttccttcttccttctcctgccatcccctgctcctcctcttacttataatgatggtgcctttggctgatggcttttaatgcctaggagaagaaatggcagcctgtctgacaaacccaattacagaacacaatggtcattcatatccgttagtgagcacttccttgccgcgaggcgtagactagatgctaagagtacaatgaggtgcagagatcatgcttacttaggcattgtggaatagtgggaagatatctttgtggctttaccagggatgtgccaggtccctaaagaatattagactggctgggtgcggtggctcacgcctgtaatcccagcactttgggaggcctaagcgggtggatcacttgaggtcaggagttcaagactagcctggccaacatggtgaaattttttctctactaaaaatacaaaaattagctgggcttggtggcacatacctgtaatcccagctacttgggaggctgaggcaggagaatcacttgaacttgggagacggaggttgccatgggccgagattgtgccactgcattgtagcctgggcgacagggcgagactcttgtctcaaaaaaaaaaaaaaaaaggaatgttacactgagcctggaagtagggaggcttgaactggtgcacggtaggtgcttagccggtgagtgctgaatttaaacaagaacacttagaaattttcatgcatgcacgataggtgcgaggtagtgagatcaccttgtggaaggtgtgaaagcaagtcagaagaaatggatgctcttggccgagtgcagtggctcacgcctgtaatcccagcactttgggaggccgaggtgggtggatcctttgaggtcaggagttcaagaccagcctggccaacacagcgaaaccctgtctctactaaaagtacaaaaattagccgggtgtggtggcgggcacccgtcatcccagttacttgggaggctgaggcaggagaatcacttgaactcaggaggtggaggttgcagtgagatgagatcccaccactgcactccagagcgagactgtctcaaaaaaaaaaaaaaaaaagaaagaaaagaaatggatgcccttgagaggtggtcagagccagaactacgaatctgcgggattcctggcaagggaatggcatgagcagaagagtgtgtggggacatgtaagtgaggaggtgtgggagctccttggtgaaggggagtttgttaggaggactgggtggaggctggactgggccaggttttggatcctaggttggtttggacttaattgcataggcttggggagccattatgtgaccaggtcactatgttgacttaatgtgatgtcatgttgcggcttattgcatctggggatgattgggagagtgggttggaatgcagcagtagggcagggcacggtggctcacgcctgtaatcccaacacttcgtgaggctaaggtgggaggatcacttgagcctgggagttcgagaccagcctgggcaacatagtgagaccccatctctatttaaaaaaaaaaaaagagtgcagcagtgggtatagagagctggtgttgctggcgtggctggccctgccattcctctgagttcaggactcagcccaccctctgaacctcagagtgattttagttgcatgtcatttgctccctctgtgactccacgatcacatccagaactaagagtcaacatctggaattgctgcatttggaaaatctggtacagctttggggatctctgacctgagccctctctcaggctcccacttctcttacaccttgttgaggtccagcccccaaccctaccactgtttctagctccctgtgctcctgtccttccatatctggcctggggagtccgtcagaaatccccttgtcagctcctcgagtatccttacctcctcgtcatctgtggcatccaccagcaacccccgagggtggatgagcttattcctggggaacgtcccaccttggcaggcgttggtgccataggatgcaagctcaggtcttagctgggccctcagcatgtccagaacctgataatcatcattattattggctgttcacatccattagtgagctcttccttgctgcaagaggcagcttagatgctaagagtacaagaggtcacacctatctagacattgtcatctaattggaaggatacatttgtaatgttaccaggtatacatcaagtcccaaaagtgttacaggaccaataggttcatatgcccactgctcagtaactgaccagttacaccgagacagtaggttttgtggcagagaaagagtttaatgattgcagggcacagagtgaggagatgggaggagaccctcaaatccgtctcctgaaggagttctgggctggggttttgttttgtttttgatggagtctctctctctttcacaggctggagtgcagtggcacatttcatttcactgcaacctctgcctcctggactcaagcaattctcctgcctcagcctcccaagtagctgggactacaggtgcatgccaccatgccaggctaattttttgtatttttagtagagatggggtttcaccatgttagccaggatggtcttgatctcctgacttcgtgatttgcccaccttggcctcccaaaatgctgggaatacaggtgtgagccactgtgcccatcttgggctggggtttttaaggggatcatggaggacaaggggctggagaattggggtcatggattggtcagcataagagggatgaaattgtcaggatgtggaaactgcattctttggtgagtcagcttcttgggttcttcaggccagccgatgtcagcagtttcgctggtgtgcaggacctgaaagagtgtctcaaagggaaaactgaacgcttcatgtttaccttgttatccatggagcagttaaggggaattataatcttgtaataggatcgcagcctggcaacaaagcgagactccattgctacaacataactaaaaacctagctgggcatggtggtgcacacctggagtcccagctactcaggaggctgaggtgggaggatctcttttgagcccgggagtttgagactacagtgagctatgattgtgccactgctttccagcctgggtgacagagtgagaccctgtttctaaaatttataatcatcacaataaatagataaaaaatagggtctacatgattctaggacaattggtagcaaacaaccatgagcaagcaggtcagagaacaagctgacctagtgatgaacgcagaatgtgctgcaagcttggtttattttcatttctcccctctcttcttccctgattaattttataaagttcatacgggtttcttaatttttttatttttattttttgagaaggagtctcactcgttgcccaggccggagtgcagtggcacaatctcggctcactataaccttcacctcctgggttcaaatgattctcctgcctcagcctgctgagtagctgggattacaggcggccgccaccacaccccgctaatttttgtatttttagtagacactggttttcaccatcttggccagggtggtctcaaactcctgacctcaagtgctccgtcagtcttggcctcccaaagtgctgggattacaggcgcgagccaccgtacggggcccgtatgggtttttttttaaaggaatatttctatccctttccattttctatacctccctgagccaaagaggaggtgggctgtgctgggctggagggatccttcgggaggcggtggagacgggtggatggagtggcctgactccagattcagtctcctctcagctccccacgccctgagtgactgctgatctcaaatgacacagagatttgttcctccccgggtgccaccaccgcagcccacttcttactgggattgtcacagctgtgactgctgcaacaactgagtccgctgggatatgctgaggccagtgccagtctcgggtcctctcactccttctggattcagagatcatgttgcaggggcaagacctgacttcctagcagctccttaagggacaagagatggaatccagaattacagggaagccaactctccatgggtggcttttggcctgaaggatgaagggggaggggaccacaaagaagcagataaattatctcccgcttagcagtgcagtctggagatatggtgcccatgtggcccctgggaagaagtccagggagagggagtgctcactgccttccctcccttctccctccctccctcgccgccatcctcccttccacagcacttagaataaatgcaggactcacaggggctgaaagatcttcctctcccctagtgattgctgctcaccggtctttagactgctctgacatgtggatgacaatcggctgagccactgatagagaagttttcccttttaatcatgtccctgtcattgctaactgcagagtctcagctttgccatgcatgagtaataaactgctgccgtaatcacaggcgaccacgttcagacaccaacacacgagcgtgctgacagttaatggggaacagggttccagaaggacttcttccatcctagcctcggacacaagggaggctaattgtgtgattagtgtttactgaggaatgtcctgtagttacatacagcttgttaggtgctgtacttccctggtgaaagagcatgaatttgggttcaggagaccagggttctaggtttactttatttctagggaccaaagtttatgcatgtgtaaaatgagaccggtatgattgtagggtcctttaactctcagattatgaataacatctctttccctcattgtatttagtcagggttctttagagggacagatatatatgagtttgttaagtattaacttacacaatcacaaggtcccacagtaggcttttctgcaagtttcaggagcaaggagagcctgtccaagtccccaaactgaagaacttggagtccgatgtttgagggcaggaagcatccagcacgggagaaagaagtaggctgggaagctaggccagtctaacttttcatgtttttctgcctgctttatattcagctggcagctgattagatggtgcccatccaaattaagggtggatctgccttccccagcccactgactcgaatgttaatctcttttgacaacaccctcacagacacacccaggattaatattttgcatccttcaatccaatcagattgacactcagtattaaccatcacattcatcctattaaaatctcatgcattctccaaggaccatttcttttttcttttttttttagacggagtctcactctgtcgtccaggctggagtgcagtggcatgatctcagctcaccacaacctccacctcccaggttccatcgattctcctgcctcagcctcccgggtagctgggactacaagagtgcaccaccacacccggctaattttttgtatttttagtagagatgaggtttcactatgttggccaggctggtctcaaactcctgacttcatgatccactgccttggcctcccaaagtgctgagattacatgcatgagccactgcaccaggcctctccaaggaccatttcaaaagcccttcattctctgtaacctcccctgaccaccttgtcagaattaaatgtcctttcttctcacctcttatggtactttcagtggatcttcttttagcccttgttcatctctgtctttcctcaaaatgatttgttgtcatggccagcccagtagtttccaagagaatgggtttcattcattttttaaaaacccctctctgtgtcatttaggaattaatttgtcagcaagtaatttgttctcacttcacaagtccagaagtagtggtagctagcactgttttggcatcatagtgtcatagctcatgtcactatatttcttttggtcttttcctcatgattacaagatggctgccacagttccagccattgcatctttgtaccaggtagggattcctgtagcagtggccacatctgctcttattgtttactcaggaaagaaaatgttttccagaagtctacctggtaggctcctacatgtgagccaggacatagtctgatgaccaactttgcttcaagagaatagttgctttccagagaaaataagtacagtggtagcaaaagagaaggagaacgggaacagcatttgcattgtgaatccgcagtgtctaccatgccctctctacccctaatacattccattgaatattaaaatttagcaagattcttggccaactagaaattcaattaactagaatactgaaggctgtgggcattcaaacatacatacataattgtattttgtctgttaagacatttttacatctctgaaattgggagttatcttatgatcagtgacatgtcatcatttaattggtagcgtactttttccccctcagggtacataaaaatggagtatcttatagttgaaggcatcttagatttgatgaaatacagtagtattatggtatttttatatatatatatatatatatatatatatatatgtataccatagttaaccatacacaactatttgattttgttgttttgttgttgttttgagacacagtcttgctctgtcgcctaggctggagtgcagtggcaccatcatagctcactgcagcctcgaactcctgggctcaagcctcccaagtggctggaactccaggtacgtgccaacatgccctgctaattttataaactatctttttctggagacggagtcttgctgtgttgcccgggacgctctcaaactcagagctcaagcagtcctcctgcctcagcctcctgagtagctgggacaacaagcatgcaccaccacgcctggctaatacacagctatttctattgaacatcaaccacatatcaagtattttgtgttaacttaattcgacatcacacctatttatactattatatctgttttacatgtgaggaagatgaaactaagggaaataaacaaattgtccagaggcacctaccagctgctccattctgagtctcctttgcgaagttggtactcactgcctcctgggtgtgggattgagtcttgctcggttggtggctgggtccaggactgtagggggggcgaaacgtgtgctggggtgagcacaaggatgctgtcaactaggatcaggatggttgcagggaaccctccttcacccaggttagtagtcactcgtgtgaaaagttgtaaagctgttaattccaggactctaaattatgctgtgcgagctgtaaatccagcccataattagaacaaaatgtgagaaaagtgaaattgatattaagttaattaaaaggctttgcttatatttgcaaggaaattagcacaacaaaacaggaatgctgacaagtgcacgttgtcaatttcttcttcatttgggcgactgtcagcaagcctcaggcaagttttgttccttgacttctgccccgtgtccttcctatgattgcacatccattgtgtttgtatcatggtggctttaattgggcaagatctagtgtaatcttgggacagtcatttttgaatggatgctaagccttgcatgggagcttcaccttccagctgaggtcccaggccctgaaagtgtgtcgggggctggaggaggggccctcagaggttgtgtgtcattgcttaggcacacgcttctcggaagctgatacaaatggctgatgcagttctcttgcgtcgagaaggtaactcctttgattccagggcacccttctcattcctgttcaccatcctgatctgtgccacagacctaggtttgagtgtgcagtgtagaattttagtttggagttcctggaagggaaagaacatgtttttttcttatggtacctattatactagggtctggatgagacaggtcaatatcaagcggcatagaactaccgtggtctctagttagggtggcagaggcaatgctgtgttcaccagggaattttttttttcctcttgggcacagagctaatcttcaggctcccctgcagttagatagggccatgtgattgagttcagggcaatgagaggtagacggaagtgatgtttgctatgaccaggcttggcccaccaaaactcctacggggtccttcatgccttctctctcttttttttcgttttctttttcttttttttttttttgagatggagtcttgctgtgtcccaggctggagtgcagtggtgcgacctcggctcactgcaagctccgcctcccaggtgcatgccattctcctgcctcagcctcccgagcagctgggactacaggtgcctgccaccatgcccggctaattttttgtatttttagtagagacggggtttcaccatgttagccaggatggtctcgatctcctgacctcgtgatccgcccacctcggcctcccaaagtgctgggattacagccttctctctttacctttcaatgatggccttggagttcacctcttggtggcatataagatggtaggatcctagccaggcccggtagtgtgtgcctgtagtcccagctacgtgggaggttgaagtgggagcagtgtgccatgatcacaccactgcactccagcctggggaacacagtgagaccctgacttcaaaaaaaaaaaaaaaaaaaagaagcatcctggtccctgagtgactaagtggagcagagtactgtgctgtccagccatctcctgctatctcctgtgtgggaccattgtgttcagccattgagattttggagcttatctgttatagcagctagtgttatttatggactaattcagttaggtaactacctaagtgacaggccaggctgtctactctccttttctgcccttgattcatgtgatcagcaaatattgattgatcttaaacaataagtggggggatggtgagatggttggattggatgccacctatttctaggtcagcttctgtgcttgacctgctattggatttaagaaaatagccttggctgggcgtggtggctcacgcctgtagtcccagcactttgggaggccgaggcgggcagatcacgaggtcaggagatcgagaccatcctggctaacatggtgaaaccctgtctctactaaaaatacaaaaaattagtcaggcgtggtggcaggtgcctgtagtcccagctactcgggaggctgaggcaggagaatggcgtgaacccaggaggcagagcttgcagtgagccgagatcgcgccactcactccagcctgggcgacacagcaagactccatctcaaaaaaaagaaaagaaaaaaaaaaaaaagaaaatagccttgtttctcagtgttactagtactctatttacaggatgatggaatgattataatcatcccctacttaacgctgcttcttggagctgagggataagtattgaaatatggctaagttgtttgtaattataaacaactaaataatatatgcattgtctttgttacagtttctgctgaaaggaactggcatttttcaagatgagacaaactgaaaaggttagtttaagcattagcaattaaaaaaatcatgatttttgctgccaccgaattttaaatcatgcaaacatttatatttgtgccaaagttccacaatttcctttagagcaattactgaaatgcattcacaagataaaaatggagttcggggaagaatatttaagagctctttaatgatgttaaaaactttgctaatttgccgtgtcgttctaaaatccactttaattttttttttctgcgtgcctacccgtcttcctgcaattgaactgattccaggagacttgaataaaggggataaaatgactaataaaatacacaaatctcacgaaatatcttttcaagagctttttcttttttttcattagctgtaggtgaacactcgggaagataaaagcatccttgggctgcgtttacttgcagaaagcagtttggaaggaaaacaaaagccaaaaagtagttacaaatgggtggcttgaattaaacgctttttcttttacagtaaaagaaagggtcttgtatatgcagacccaaggggcggagtagactggtctaatgtcttcatcctcatcctctttacaagatctcagcttagcaaaactgcagttagtcactgatctgtagtccctctcccctagttagcatcattgcttggtgctccagccctttcttcagggccttctgaaaatccgcagccccgggggatcctgatccacttttcttcttccccatgagataggctctaatgttaatggttcacattttctttcttttttttttctgagatagagtttcgctcttgttgcccaggctggggtgcagtggtgcaatctctgctcagggcaacctctgcctcccaggttcaagtgattctcctgcctcagcctcctgagtagctaggattacaggtgcctgccaccatgcccagctaatttttgtatttttagtagagacggggtctcaccatgttggtcaggctggtctcgaactcctgacctcaggtgatccacctgcctcagcctcccaaagtgctaggattacaggtgtgagccacgccccagttcacgttttcattagagagtaagttcacaggtatttctcagggataattctgttggaaagctaaccttccatagagaaagtttgacagcattgacttccagacgagccagagatacagccctggccctgccagcaaccttcctagtcagctgatctccaggggtttcagacaatggacgaagcaagggctttggagttagacagaaggaatctcaaacttcctttggctactttacaaagccaagccaaagctggggctttggaaaaaatcacctaacatcaatgagcctcagtttactcatctggaaaacagtagctactcctataaatatgataaggacggtgtaaggtgatatttgtagcatacctggaagaacgcctgtaataggagaatgttgatgaatgatgttattgacatcgccgtggtggcagttactaccaatactgctctttggaacaagacatttggcctttccgggcctcagttttctgccctgtaaaatctagacaagataggaagggtgttcaggttctgtaattttatggatcagaaaggtagagtcgatgatggaaagtctgttttcatgtaaacagtggctggtgaggactggtcagagttgcattttgggaagccatgaaaaattcaatctagaggaataggaaacaattgtcctaggtgtggtggtttaaaaatgtatctacaggccaggagtcgtaatccctggcacggtaattccagcactgtgggaggccgaggccggtggatcatttgaggtcaggagtttgagaccagcctggccaacatggtgaaacccagtctctactaaaaatacaaaaattagccagtcgtggtggcgggcgcctgtagtcccagctactcaggaggctgaggcaggagaacccaggaggcggaacttgcagtaaaccaagatggtgccactgcattccagcctgggtgacaaagggagactctgtctcaaaaaataatagtaataaaataaaataaaaataaaaaataaaaaaataaaaatgtatctgcaaatttgacactttccccatcaaacggtagagtttaattcccctcttgttgatgatgcgctggcctccgtgacttgcttctagtgatcgaattcagtggaaataatgttccatgacttcagaggctggatcaaaaagggtgagggagcctctgcctgagggtgctcttcagggacatggatctttgaagccgtgtgccaccataccggcttcgctgaagcccccatactggagggaccatgtggagagagagagagaaagagagagagatgcccagggacccctggctgttccggcttccagctgtttgtgtctgttcagcgcaggagccagacacatgagtgagcaagcctcactccatctttccagcctccccagctgataccaagttgggcagagacgggctgttcccaccccaagcctcgctcaaatcgcagatccatgaggaaaataagtacagtcattgttttaagccactttttgggtggtttgttgtacagcaataaccagttggaacatgaggtcagtatccttgtgcttgataagctgtttttgatgatgatagtcatgctaaccgtaataaatgtaacaatagccaacatttatttatttatttatgtatttttggagacggagtctcactctgtcgcccaggctggagtgcggtggcacgatctcggctcactgcaagctccgcctccctggttcacgccattctcctgcctcagcctcctgagtagctgggactacaggcgcccgccaccatgcccggctaattttttgtatttttagtagagatggggtttcactgtcttagccaggatggtctcaatctcctgacctcatgatccacccgccttggcctcccaaagtgctgggattacaggcgtgagccaccgcgcccggccacaatagctaacatttattaagctctttcttaaagtatccagcaccgtaatgaagattttatatataaaagtgggtaatgaattttttcgggaaagtcttggatttatatgccatgggtagactgtgataacagcctgactattgcagtgggggttaggttggctaagaatttcagttgtctttcattcaagtttctgacagttgtcctaaaccaccgagcgttgagtttatttggaaatgcaagagtggctgttgtgtaatggctccctccccgtggacgacggttatctgacattgctcatcatacccagtctctgaaccctagcaccacagttccttatattgtgctgttccaggtcttttagcagcagagacaagaacacatttaatagagcctgttcttatttttcttttggagacagggtctcactccgttgcccaggctggagtgcagtggcatgatctcggctcactgcacccccaacctcccgggctcaagcaattcttgtgccttagccgccacagtagctgggaccacggatgtgcaccaccatgcctggctaatttttgtatttttattagagagagggtttcgccatgttgcccgggctggtctccaactcctgggctcaagcagttagcccgcctcagcctcccaaagtgctggattacaggtgtgagccactgcgcccagcttcttctttttttaaaattcttttttcttctatttatttatttttttccttttttgttgcctactattgctacctctgaagacagcctgtttccataagagactactgattttctactttttgtagaacctggagaatttggtgtttctataaataacacatcctggaaacctatagagtacatcattctctggagatttaaataagtactgcagacttcttttattctaattaagtagagtaggaagtaggtggcttgtctgaattatggccttataacagaggacacaattcaatattcctcacttttcctggagtgagaacttttaaaaatttcattcttggctgggctcagtggctcatgcctgtaatcccagcactttgggaggctgaggcaggcagatcacctgaagttgggagttcaagaccagcttgtccaacatggagaaaccctgtgtctactaaaaatacaaaattagccaggcgtggtggtgtatgcctgtaatcccagctactggggaggctgaggcagcagaatcccttgaacctgggaggcagaggttgcggtgagctgagatcgtgccattgcactccagcctgggcaccgagagtgaaactccgtctcaaaaaaaaaaaaaaattcattcttaacttggacacacatcgtgcctgtagcttgaacacctaccaaagataagggcatagagcaggctagggcttcccatgcctgatggagctacatatttacttggggaactttggaaaaagtactaatttccagattcctcaagctggaggttcacattttgtagatatgaggtgggatgtgacttgggaatatacacatttttcttttcaaaagctgaatgggtgagtctaatgagccattgagatggttgatgccctgccctgcctttcctttcccttccttcaagcaatacatctgtaaaaatgttgagttgtcataaggctgttgtgacaattaaattcatttattcacatgagatgtccttccttccttccttccttccttccttccttccttcctccattctttgccttccttcccttcccctccctgcctcccttccttcttccctccctccctcccttccttcctctctgtctctctgtctctctctctctcttttccttcttttctttcctcttgctctgttgcccaggctcactgcccaggagtgcagtggtgcaatcatagctcactgcagactccaatccctgggctcaagtgatcctcctgcctcagcctcccaaagcgctgggattacaggtgtaaaccactgttcccagactccttttcattttcttaatgatatattttcattttaattttcttaatatattttatttatgtatttattttgtttatttatttatttatagagatgaggtcttgttctgttgcccaggctggagtgccctggcacagtcatagctcagtgtagctttggactcttaggctcaagtgatcctcccacctcagcctcccaaatagctgggactacaggtgtgagccactgtgcatggttcaacacccttgttttgaagtacttttctagtcattttctcatgacaaaagctttaaagtcttcatatctgtgaaccatttcttggagatcttggcagatatcacccctagttcccatatctgcatctgtaaaaatgttgagttgtcataaggctgttgtgacgattaaattagtttattcaatgagatgtctgataaattcctggcctctagtagatttctttaaaaactttaaaaaaattgaggtaatgcattggctgggcgcggtggctcatgcctgtaatcccagcacttcgggaggctgaggcgggtggatcacctgaggtcgggagttcgagaccagcctggccaacatggtgaaaccctgtctcttcagagaatacaaaaattagcagggcatggtggcacgtccctataatcccagctactcaagagactgaggcaagagaattgcttgaactggggaggcagaggttgcagcgagccgagattgcgccactgctttccggcctgggtgacggagtgagactccatctcagaaagaaaaaaatattgaggtaatgaatacatatataatttactgtctttaccattttaagtgtacagctcggtagtaacaaatacatttatattctttttttctccaccattcctccctccctttttcccttcctggcacctggtaatcactagtctactctctgtcttcatgaggttcacgtttttaactcccaaatatgagtgagaccaggcagtatttgcctttttgtgcttggttgatttcacttaaaataatgtatgtcagttccatccgtgttgctgcaaatgacacgatttcatcatttttcagggctgaataatattccactgtatgtatatgacatattttcattatccattcatccattaatgagtacttaggttgattccataccttggcaattgtgaatagtgctgcaataaacaagggagtgcaaatatctctttgatatattgattccccctttttttttttggatccatactcagtggaattgctatatcctatggtagttagttctatttttatttttccgagggacctccatatggttctccatagtggctgggctcatttctcaatcaatgggtgctgctgtgttctgtggtttcgtggccaaggtagttggcactccctttgggggttgactgccttctttgagattgtagtgtcactggctgtgccgcctgccccaagccttcatctttctccatctgagatgtttcttttctttcttttttttttgttttttgagatagtgtctcaatttgttgcccaggctggagtgcagtggcgtgatcttggctcactgcatcctcctcctcctggattcaagtgattctcctgtctcagcttcccgagtagctgggattacaggtgcctgccaccacgcctggctaatttttctgtttttatttatttatttttttgtttgagatggaatctcgctctgttgcccaggctggagtgcagtggcacaatcttggctaactgcaagctccacctcccgggttcacaccattctcctacctcagactcccgagtagctccgactacaggcgcctgccaccacacctggctaatttttgtatttttagtagagatggggtttcaccgtgttagccaggatggtctcaatctcctgacctcgtggtccacccacctcggcctcccaaagtgctgggattacaggcgtgagccaccacgcccggcaatttttgtatttttagtagagacgtgaaatgtttctttggtaaactggattctagatgaatatgtttcattctgtttgctggtagtacaatttttatatttcttaaagtgtaaaatctgctcctcgtctggtgtttcctatatcagcttattataatattgatctcatgcttttacaagctaataccctctgtcttttttctcacatccaatagctgtccgtagctgactcccataaacccccatctcctacagaagtttcttctgtcccttctaagcatagcccctcatgtctggcctagcactttggaatagactctgaaattatttccatctcatctcttacaatacttgtcattttttaactcaaatgtgccttttcttaggaaagtgatgtgtcgtttcgcagttcctaaaaacgttgagaggttccttggacattgtatcctagacttggagaaggcaaagttgtggtatgataagccgaagctttctatattttatgaattttgccagatcttttcttttcccaaatcttgcccacatctgtctaccttcctttttttctagcattttaagtctttacaaaacattcaacttggtttttactgaaacattagtaactggctttcttttctcactcacaatgtcatcaatttatgtaatttaatataattatgcaattatataacaagcacagctggcatgaagaggtttgggaacaaaacaataactgttgacaggtatacaattcaactggcgggagcagaaacgggcagacctactagataaagggtgcttaccacttgtgagcccccaacatgcctggggcatctgctgtcactgtgtgttacagagatggagactgtcagtcgctggtgtcagttaagagagcctctgttttattattattttgggttttttttgagatggagtctcactctgtcacccagtctggggtgcagtggtgcgatcttggctcactgcaacctccactttctgggttcaagcaattcttctgcctcagcctcctgagtagctgggattacaggtgtgcaccaccactcagatctaatttttaaaatatttttagtagagatgggtcttcatcatgttggccaggctgatctcgaactcctgacctcaggtgatctgcccaccttggcctcccaaagtgttgtgattacaggtgtgagccaccgtacccaaccacctctgttgtatgtaattagcatgttaattgtgataaattggggaaacagggaaaaatggaaatgagaaaataaatttatcgtaattctaaagcatgaggataacattttgcttctttttatcctgtcaacatttttatatctttaagatcatactcatgtataaacacttgtgtcctatatgttcccttaacattttaataggaacattttcccatattattaaacaccttataaacaattttagttgttgtatattcattcagtgattcgttgagttccttcaatgattttgccataagtcacattctcatgttgctataggcagatacatagtaggctgctttcaaatttttattataaacaatggtgtgatgaacattttttttttgagactgagtttcgctcttgttgcctaggctggagtgcaatggcacgatctcagctcacagcaaactctgcctcctgggttcaagagattgtcctgcctcagcctcccaagtagctgggattacaggtgcctgctaccatgcctggctaatttttgtatttttagtagtgacggggtttttccatgttggtcaggctggtctcaaactcccaacctcaggtgatctgcctgcctcggccccccaaagtgttgggattacaggcgtgagccaccgcgcacggccacgaacatctttatatatcagacaaaaatagtcctatgtggaacttttaggccaaaaggtacggccttttcaaggactttttattttgttgttttttacagataagtctcactccgttgcccaggctgtgatgcagtggtgtgatgactcgtagctcattgtaaccttgaactcaagcggcccttctgcctcagcttcctgagtagctgggactacaggtgcatgccactatgcctggctaattaaaacaattttttttttccgtagagatagggtcttgctatgttgcccaggttgttctcgaactcctgggctcaagtgctccccaagcattgggattacaggtgtgagccactacacttggccttaaaggacttttgatatattttgtcaaactgctttccattaagtttatactttcaccagcaatgtataaaatctttgtgtcaccttatcctctcccacagtgaatagatattataatttaaaaaccttgttaatttgatagattacaatcacaccctgttttagtttttattttcttgattggtaatgagatcgaatatttttccaaatatcatttatttgcatttgcatttttgtaaaatttgaggtcctgtttatctgttaaaaaccatttatcagttgattaattcaattgttgatttgcatacatttttaatgtcgcgaaggaattatctttgtctttaatatttattacgaatatgctttccacagactcatttcttacctttcagtgttgatcaattttttggatgggatgggcagggcaggttttacatttttttatggagtatttaaacttacaaagttttctgtcattcagtgtctgaaaaaatattcagatttttttctggttttatttaaaaattaatttcaatttttttgcatgtaactttttttatacttgggaattgagtttctaacttgatcatttccacttgctttagatagttcaccaccattggttggataatgctgcctttccacctgatttgtaatcgtcttttattgggccctcaactgttacatgcacaaagaaggataattcttctgaggtgtctattctgtttcaacgttgtatctgtaccgaatcattgccgctttatgttaattataagatgatattggtccccccatttatcgtcttcccttctcttcccctcccctccccttttctttttctgtcttcccttctgcccttcctcttctttccttcttcccttcttcctccttccttccttctttctctttccctccctccctcccttcctccctttccttccttccttccttccttctttccttcctccctccctcccttccttcctccctccctccctcccttccttccttccttccttccttccttccttccttccttccttcctgttgctatgcctctttttggtcacaccttccatttattggaattcttactttcgttattctttcaaagatcagtaacattcctaaaggaaaggtaaataaataatgtattttcagagatcttgttttatatttttcctttgcctttatatatttggctaactatggaaggcctttgttagaatctttcccctgaatgctatgggcatttgatattgctgtgtatgaattgagttcatccatccatccatccatccatccatccattcatccatccatccagaatgagctacacaatatgtcgggtccaaagaaaaatgagaatgtgagctccttgctcaacaattattaataatttcaatatgataaacgaggttcattaaactaaaggcaggactcttctgaatatagggctccatgtgactgcatgaagtcacccgtgaagtcagccttgcatccatccatccattcatccatggatacccatcctgtggatgcttactgaacacccagtatgtgttgtgtgctttgagggaaagaaacctcagtctagtggaggacacagttagtgatgatgcaagtgtgcacaggatgcacagaggagagagaactccaccagacccagctgccagagacagctttctggaggaggtgatatttacactgatgtgtccaaagcttttgctctgattgatgtggagaggcttaggagggttttgaactcaaaaggagtgacatgctccaattcaagtgctttgtaaggatgactctactgcatggaagacgcactgtggaggacaagtgtagaagcagttaggaagctattgcaatgatccaggcaagggaagatggaaatggcaacttggatatgtttggaggtagtgagaagtggtcagatcctgaatatattttgaagaaagcactgttaagatgtgttgatgaaatggatatgaggtataagagaaagagagtagttaagaatgacttccagattttccaatctgatcaattagaaaaatgatgccattcactgagacagggaagacttgcaggggaacagtttgggagagatgaaacattcaattttggatgcactgtttctgatgcttattaaacaaccaagtggagatgttgtccagagagttggatgtactattctagatctaggtttggtttacatgggggaagagtagggagggaagaggctttgcctatgaggttgctacagaagagtagagaggaaagacctttttgataaaatgttcttggtgactgattggatgtgaagaataaggaagcagattcagaaaatgaaactgaccagtctttaaggccccttttccctaatcacgagccaaacagggggattggattttggagtcatagttacttcttttggaaagagcttgtcttggaaccgtttcttctagtttagattcctgtggcagatggtgaaagtaatttcttgatatttgtttgcgatgaagagagaatgtgctgtcaccgaaatgttgaattattaatgattgaggaggaaatgacttctttcagaaacaccaattctgaaggcctcttagatagaggccagatagtaaattacctctttcagtgacagaactaaagagttgatgcagatcgaaaagggatgtagtgattgccatctgtgggtccggaatcaatgtaatatttatgggattcagcacattttagaatctcatctttgctcatagtatccattactgctattaccttttagtagctgttttacaagaatcagaaagtactgtagagactgtctgccatttatggaagaaggctgggtactctagaaccaatggatttagagtggaaacagagcatttctgttatcgaggaaagagctaaacgggtcccaggtcactctgatccaaccttgggagacagtgctgcctgtgtctggctatcttgtcctaggagtgttggtgaattatgcatggaaaaagtcatgtagttgtctggattagtcaattttcacactgctataaagatactacccgagactgcattatttataaagaaaggaggtttaattgactcacagttctgcatggctgggaggcctcaggaaacttacattcatggtggaagctgaaggggaagcaaggcacgtcttacatggaagcaggagacagagagaagcagggaagtgcctgacatttatcagacaaccagatcttgtgagaactcactcactatcatgagaacagcaagggagaagtccacccccatgatcgaatcacctcccactaggatcctccctcgactcgtggggatcacaatttgagatgagatttgggtggggacacagagccaaactatatcattgtcccctttcaaaattaagagaaatttttgcagagaagggaaatagtgaggaagtgcacttaagtgggacttgcaacatgtggttctgtcttcaacacgaaattcaataagggggaagcgaccacagaaccaacacattttcaaacagtgtggtaacctggtgagtgtgtgtgtgtgcatgtgacaaggtacttattttatcctgctgtcagtcattcattcacttttaaagatgaggttatctaaagacgattgctgagctctgaaatgaattaaaacccgtcttatttccagccagtgatttaaatattgtatagctcatttataattgaataaaattgtggtggctctttgtggatttttgaagtcatcttctctaagaagcctgttttgttttctctttttgaaataaacatgaatttgcataagaagcaaggagtctctgaaagaaatcaataaaattaactggaatttgatttcacattttgaatgcattacatctttctattaggggagatataagagaagctgaggctcataaaaaagtgacctacttgaagaagatgaatatttaaaataagagctttaaaaataatttgcttcgcattggtggaccatagctcaaaataacagaaagcctaacagaaagacaggtttttcagggattgggaagggcagctggcactgtcttgagggcaatacttgaagtacccagggtggtttggagtctgaaaatccgagttcaagttctggcactgctacttagtttatttgagatatgtattagtctgttttcacactgccgataaagtcatacctgggactgggtaatttacaaaagaaagaagtttaatggactcatagttccacgtggctagggaggcctcacaaacatggcagaaggtgaaaggcacgtttcacatggcgacagacaagagaagagagagaagagagtttgtgcagggagactcccctttataaaatcaccagatcttgtgagatttactcactgtcacgacaatagcaccggaaagatctgcccccatgattcagttatctcccaccgggtccctcatgggacacatgggaattatggaagctacaattcaagatgagttttgggtggggacacagccaaaccatgtcaagatacatgttttcgttttgacccttaaaacgattttcctttgtattgcaaatgaaatttgctttacttgacgttaatgttgaaattaaacctgtttaatttctataggtgcagaattgaaccgagactttaggagttcaggtcaagctagttccttaggtttgaagggctgagtaggtggagtatgtgactatgtaaataaacctccctgactgggtgaggcagcgccctctctggagtcagtgtgcaaggatgttagtgaaagctgctcttttttttttcctccttaaactctcttcacctcttgtttgcaagggccctctgtaaatgggtcatgtaccacgcaatgcataagtattcagaaaggtgcttcctgcatgtccttctgaagagctgtgctttgcagagtttttgtgacttcatcgttcaaatgcaatgtgcacatctgttgatttttctttgcaaatggacgttggcgctcaatgtagagcagccttgtagcgctaaaggaaagttctctgttcagctaaatactgcgtgtgcttgggcaagtagttctgaatttcctcatgaataacatggagaaaatgcctatcagatttgttcagaaatccacctctctttattatttacttgggctttaagttttattttaaaagagttttattgaggtataattgacatactaaaaactgcacgtttaaagggtacaatttgataagctttgacatatgcatgcaccagtgaaatcatccgcatgatcaagatagtgacgcatccatcacccccaaaagactgtgcctcgactcatccgtcgtgtcttcctgtccctgccatccctctttactgaggcaaccactgatctgcctcctgcctctacagataagtttgcctctttctagagtttaacatacatggaataatatagcacatattcttttttgtctgacttctttcactctgcataattgcagtgtatccatcgtttatttacttttattactaactatattccattatatggctataccacagtttgtttacccattctcttgttgagggccatgtgtattgtctccagattgtagctatttccagtgaaactgtcatgtactaaataatctttgcatagatatatgctttttttttcccctaggtaaacacctagatacctaggagtggaatggctagatcttttagtaagtgtgtatttaactgttttttttaaaagacaaagttttgttatgtcactcaggctggagtacagtggcgtgaccatagctcactgcagctcaagtgatccttccacctcagcctccccagtagctgggactacagttacacacaaccatgcctggctaagtacttttttttttttttttttttttggagagacagggtctctctgtgttgcccaggctgttctcaaactcctggcctcaagtgattacctctccttggcttcccaaagtgctgggattacagacatgaaccactgtgcctggccttttcttacttttgaagaactgttttttccgttttatattcccaccagccatataggcaagttccagttcctccgaatccttgtctagacttttacattttagcattttaatgtgtgtagtgatagcactttgttcaaatttcatgtcccaggtgactaatgatgttgatcgtatttttatgtgtttatttgtcatttgtatagcttcttcaggaaatttccgttcaaatcattgcccattttctttttctagtttttctttttttgttactgagttttgagagttctttatgtattctaggaggaagtaccttatcagatagatgactcacaaatattttctcctaatgtgtgccttgtcttcttattctcttaatagtgcccttcagagagctcaagtgttaaatttttctattcattcttttatggatcatacttttggtatcatatctaaaaatctgtctaaaacgccttgtcatggaggtgttattttatgttttgttttattattttttttgagatggagtctcactcactgtgtcgctcaggctggagtgccgtggcgtgatcttggctcactgcaacctccacctcctgggttcaagcgattcttgtgcctcagcctccaaggaagttgggattacaggcgtgcgccacgatgctcagctaatttttgtttttccgtgttggccaggctggtcttgagctactgacctcaggggattcaccctttccggcctcctaaagtgatgggatttcaggcgtgagtcacctcacccggcttccttttataagtgttatagttttaggttttacatttataactgtgatctattttcgtatatgatgcaagctatggctcgaaatgtatttttaagtttttacatatagatatccagttgttccagcacaaatttcttgtgcctttgtcaaaaatttattgtccatgtatgtctaggtagggttttggactctgtattctgtccattgctgtgtttgtctgtatttgcagtgataccacactgccttgattagttttataagaagtcttgtaatcaggtaatgctggtcctccaactttgtattttaacattttctatatttgggccgggcgcggtggctcatgcctgtaatcccaccactttgggaggccgagatgggtggatcacgaggtcaggatttcaagaccaggctggccaacatggtgaagccccgtctctactaaaaatacaaaaattagctgggtgtggtggcgggcggctgtaaccccagctactcaggaggctgaggcaggagaatcttttgaaccccggaggcggatgttgcagtgaaccgagatcgcaccattgcactccagcctgggcaacagggtgagactctatatcaaaaaaaaaagaaaattctatatttaaggtgtaccgtaacatgacgtttttatatactcatatatagtgaattaaatatttaatactatagtcaagcaaattaacacatccatcagctcacatagttacgtgtatgtgtgtgtgtgtgtgtgtgtgtgtgtgtggtaagagcacctaaaatctactctcttagcaagtttcaaatatacagtattaataacttttttaaaaagttgttttgattgctttaggtcctttgcatttctgtgtgaattttgggaccagttaatttctgcaggtggggataaactctacctgtccatcttttaaatgtattgttgaatttgattgctgacattttgtttagaatgactgtgtctgtgtgtcctctggctggtagcgacagaggctgtccctggccctgtgagagtccaggcactgtcacctctaatcctttggggtgggtcctttctcccagcctggggtcttgtttttcgttctgatgatgtgatcagtatccagctcactgactgaatgggaaccactacagatctctggagttctccctctgtgcagctttctcctccaaactccttagtcctacagattctattaggttgttgcaaaagtaattacgatttttgcacccacctaatagctgcctcgatctccttgcaatcctcatctctatctgctcagctcagggagtccgccagcatcccccctaggctctcttttcctaccgtgcatcctgggaaccctctcaaggtagtggcctcacatcatttctttctgtctcttggggataactgtgctttgtggcctaatagccagtgtcttcagaagtgttcttttgagtattttgtctgttacttcagtggtttcagcgggaaaagccagtgtggtctctgtttctccgtcttggttcgatgtggaagtcactgaattgaatttttacataatgggtttttatatagtttgctgcactatatttatttatttgagacagggtctcacactgttgctcaggctagagtacagtggcgtgatcatggctcactgcagccttgacatcttgggctcaagtgatcctcccacctcagcctccagagtagctggaactacaggtgcatgccatcacgcctggctaattttgctattatttgtagagacggggtttcaccatgttgtccaggctggtctcaaactcctgggctcaagtgataagcccaccttggccttctgaagtgctgagattacaggcatgagccattgcccccagccttggtgtacttttagattggattgttgccctacactttttgtatgtgagtgcaagttgtgtcctaccagagtccctttcttagtattaaattgataacactttatcttaccttcatcatttttttttttttagatggggtcttgctatgctgtcaaggctggtctcaaactcctgggatcaagtgatcctttcacctcatcctccacatagctgggactacagatgccagccactgtgtctggatctattgtttgtctctgtcatttgactgtcttgtccttgaggattgtggctgagtcttatttacatcttgccttgatagtgaatgttgtgtaatgaatgaatgaatgaaagtgaatgaatattttcacttccataagaatatccaggatgctgtttttttcctcccccttcaaagatgtagatcgagaagggatatgttcagtttaaaagttgaagctttattttttattatttatttatttatttatttatttgagacagagtctcactctgtcacccaggctgtagagcagtggtgccatctcggctcaccgcaacctctgcctcccgggttcgagcgattctcctgcttcagcttcctgagtagctgtgattacaggcacatgcgatcacccctggctaatttttgtatttttagtagagacggggtttcactatgttggctaggctggttttgaactcctgacctcaggagatcctcccacctcggcctcccaaagtgctgggattacaggcatgagtcactgcacctggcctgaagctttatttaaaaagtagcttattttgaattttgagtgtgtgtgtacatgtgtgtttgtcctgataagggatgcttgatattttaacactggcaaagggatggctgattgggagttaaattgccccccaaataattcaaggtgtattatacatttctcccaaggagatacagatctggggtcatatgatttcgaactttgctttttaatgaaagttgattaaacaaatgccattttactttatagctattttaaataacctgtgctgtttagttcttttttttccctgtttttcatctttattgctaggtaggtcagaggcagaatttcccaaacatgtgattagtaggacacctctctgggaatttttttttcccttaaggtgacttaaaatgagtttgaggaagaaacaggacaagggtaaaaatttaaaagaagccgtatatctctgaataattcttttagaaagataatttaagtctcgttagaaatctttgatttccaattactcaaaagtggatgtgctcaatatcagtgttgttcagttttctgtgctttgtgaagttagctattatagaatgtaaaacgtaaaatgcttgggcatgttggcccacacctgtaatcccagtgctctgggaggccaaggcgagggaattgcttgaggccaggagttcaagaccagcctgagcaacatagtgagacactcccccataaaaaaattaaaaataaaaattagccaggagtagctgttactggggacgatgaggcgggaagatggcttgagcctggcagttcagtgttgcagtcagctatgattgcaccactgcactctagcctgggcaacagagcaagaccctgtctccaaaaaccaaaacaaaacaaaagaagaatatgaaacgtaaaacaaatgtagacaaatgtgtatcccaccgtaatggaatttgttgtgtagtgccaaaggatttttatattctgaagtttctgtgctatttacttttgctttatttacagaagattctgggatgttgccaaggataactaggaattgcttgtaactatattggaaatacacacgatgaggttgaatgtggaaatgcagctgcatgtgttgtaaatcagtcctagagctgctgctgggcttggtgatagcttttctttaactaacttcggtgatcacatttgtaaagagatgggcaatatcatgaagaatggagggttacaaatttctgaacaacttgagtgaaagtttctagagtgttttccttgactatttttgactttccgtcgtttgagatttactttccagaaaggatgcaccctcccacccccagcccacctatccaatcttcaggattaattcttttcagctcttgggttacctgggggtggtaatgtgagagggattttatggaagggaattaaggaataggtggaagaaaaccacataggacagatgggaaacagaatatatgaagaatatgagaggagggcgaagaagtgagaaggagaagttaaggtgtgtgtgttcatcataactatggatgaggctgggtgcagtggctcacgcttgtaatcccagcactttgagaggccaaggtgggaggattgcttgagctcaggagttggagactagctggggcaacatagtgagaccccatctctacaaaaaatgaaccaggcatggtatgtgcacctgcggacccagctactcaggagactgagacaggaggattgcttgagcccagaagttcaaggctgcagtgagttatgatctcaccaccactgtattgcagcccgggtgacagacactctgtcttaaaaaaaaaaagaaaaaaaaaaaagaactatggatgaagctagctagacttaggaacagactctaagaaccctgaaataaaccttttctgtctctaatgtgatctgtgatgtttggttatccccagagcaatggatagaggccatcacaactgctcagtccagaagacaccgtaaggaccactcctgtggagtgggagctaccagggcaagagtttatcaccaacagtgccttggacctaatagtaacttcataaatgtttactggatagatataagtcccctagccttggaattgctctgaaacccaggatttcttaataaatgaagtaatctgataactgagataagcagttttgggtggctttgaaatgtcctcatactcctgtttgctttgaaatgggacttttgaaatgaggtgttgttctgtcccaaaggagagaagagagactgtggaagaactgatgacaggaacagcaaaactgagagaaggaaaatggggccaggagaggagcagatgctagaatggggtttgggttttcttggcactccaaagctcctgtatatttattgctatcctgattatgattgctcggttttaagaaggtagaagtcttttctggctgtaagcctacctgtctcaacacaatgtagctgctggacgctggccctggacactgacatgcctgttccaggagaacctggaggggtgttatatattgatttggttgtttctttgagtctcagatgcggaagtgcactggggaccctcagggaccgtcagggtttggcagaatggttctacatgtgcaccctggtatctccagccatgtcagtgtgaatgaagacagagattttgtactcttggggtcatagcgtgactggaggctgcatctcttgggctgtgcatattgtgataaggtgatgggtattgttgcttactgggaggagaaagtattagtttacttatgacttttaatattagtttagtggtgatttctaatattactgtctttcttattaaaagcaagccactcaatggtcgggtgtggttcatgtctgtattcccagcactttgggaggctgaggcaggcagatcatttgaagtcaggaattcgagaccagcctggccaacatggcaaaaacccatctctactaaaaatacaaaaattagctgggcatggcggtgcacacttgtaatcccagctactcaggaggctgaggcaggaggatcgcttgaacctgggaggcggaggttgcagtgagctgagattgtgccactgcactccagcttgtgcgatagggcgagactctgtctcaaaaataaataaataaataaataataaatagaagtaagccactcaagctcagggtattttttttccctattttgttcacattatgtccttaatatcagagcagtacttggcacagagtaagcattcaataaatgcagttgaatgcatgagtctgttgaatatatgagtgcactgaatgggaggtcaggagagaaaactgggaagaggaggactaaatacacttgtgtctgaaccaacttcttctgtttccactgttttcttggaggcgactcaagagattcttcagttccctggcacagtgccaggcatggagttgacaaggacgggtaaagcccttgaggggctcatagacaggagagggtttgggatacgtaacccatagcctctcagagtgctactgtgggctctgctccaggtgcccggggagtcctggcagatctccagggtcagggaggcctcagaggaagggacatctgagctgagtgttgataccttcataggttagcggagaaagaagccggggggagttcctctaagcagaggccatgaccgcacattggcactggggtgtgagatgtcaggggtctgcacatggttaggccggcctggggctctggggacctgtggggaaggtggttctgacagcagaagccaaatgaagaagaggctggtgtgtgtctcacgtgtccgtgtgaagagaccactaaacaggctttgtgtgagcaacatggctgtttatttcatctgggtgcaggccggctgagtcccaaaagagagtcagcaaagcgtggtgggttatcattaattcttataggtttcgggatgggcggtggagttaggagcaatgttttgcgggcaggggatggatctcacaaagtacattctcaagggtggggagaattacaaagaaccttcttaagggtgggggagattacaaagtgcattgatcagttagggtggggcagaaacaaatcacaatggtggaatgtcatcagttaaggctattttcacttttgtggatcttcagttgcttcaggcgatctggatgtagacgtgtaggtcacaggggatatgatggcttagcgtgggctcagaggcctgacattgtgtcttgcttaggaatttgggtttctgtctttggggagcgatggaaggtttatttccacttttgaaaactttttaaatgaaaaatttcaaacatgcatacaagtaggaaggaccatattgatatcaatgagctcaacccctagattctacaattaatgttttgccatgtttgcttatccttctttctattctatctatatctatctatctatccatcagtctgtctgtccgtccattcatccatccatcagtctatctgtccatccattcttctttctttcttcctttcttcctttccatctatccatccgtctatctatccctccatccatccatccctccatcactgtctgtccacacttccatccatctgtccatccatcagtctatctgtctatccattcatctatctattatctatctgtctcaattatctatcatctgtccctatcatttatctatttgtctgtctttgtcatctacctatatctatttatttctatcatctgtcaatctgttatctattctctatctgtatcatctatctatcttatctatctatcatctatctgtctgtctatcaaatatcttatctactatctgtaagagtttatgcaggggagtgacttgtgtcttagagggtccctctgggaggaacatggaggatgaaataaagaaggaagggaatggagtttgggaagactcactgagagtctcttgaaattgttgggatgagaggcggtggtggcctgaactaaaatttggcaactgggctggagaatggagggctcagagatatttgtgggggtattctagtgattatgtctctgtaacagattgtccaaaaacttaataacttaaaataatgacaacaggctaggcatggtggtgcacgcctgtagtcccagctactcagaaggctaaggcaggaggaatgcttgagtccaggggttcaaggctgcaatgagccatgtttgtgccactaccctccagcctggacaacagagtgagacactatctcaaaaaaagagacaatgtttatttttcttacaaatcttcaatttggacagagcttggcaagatgactctgtttctggtctactggatatcacttgtaatggctcaaatgtggaggtctgtagtcatttgaagcctgtcactcccatctggctggttaatgctggctttcagcaaggatcttatttggagcacctacgtgtggcctcgacatgtggcctgggatccttcacaacatggtgtctggattatgagggcgagtggggaggaggagagagagaatgagaacaccaagcagaacaatactgaattttaggatgtagcctctgaagtccccatataccgccgctgtcgccccgttctgttcatcaagccaggcacaagttcaggaggaggaaagattatctcctcctcttgacggggtgtggcaagatctcaaaatattgctgtggccatttttggaaaaccctgcccgtccaggggctaaagtggcaggatttaattgttggatgtgagcaatgagaaagagcaaaaaatctgacctgacactcagtttggattcgtgtctccatggcggggaggcattcacagagagggcagtgtgagtggcaggacaggaaaagggaatgaggaggatggagttagatttggggtcccattgatttgttgggaaatactgcatcaggatgggttcatgaactacaaacccacagaggtagcttcttcttggaacagacaaccatgtttcctagtttttggacaactttgagccgaatagggtttgctagcctccctgggtccctataggaggctgttgtgtactctgaacctgagtggaggtggcaggtgtttgatgtgtccccaagcctgctggggataatgtggccttcagtatttgcttccctccgtggagctggagcagctagggaggatgcaacattcgttgatttcatctagcaggcatttatttgagcacttacggtatgctggaacctaaaagaatttgaatgtgcattaaatgccatgcctgccctaaagagctttgtctctagaagcggagaggatgcttgaggttgcatgctcatgctaagctgtgaatgtagttactaaaaggacagagcttcgagcaggggcagatgtaatatgcacttgctgggctttttccttgcctctgggttctccatggagtgcgctgttgctggtgtctcttctggagcatgtaggggcctgtcggagagcggggccaagctactgtcctcatatgttcgaggacatttacagacactgatctctcttggtatccaaatcaaactcagcattaacaggctagtttccctccctaacctccccttccaccttggggaataggacagagccatatgtccttgatcaatatctctgtctccagtcactcagggtcttagaaagcctgctccccgggaaccccatcccactctatccctcactcttcgcttcccatgtctggactctgatttagtaccattttccctgggtggtcctgatactcagtttatttgaaaaccatggctgaaaatctgattccttgtagcttgtactcaaacaacaattcaagttagaaagcattgaaataccgagacagtttcagagaggctcaaggaagcccttctgcctggggagaagggggaaagtatcagggcattagagctgcactctgaatgttaggtagagttggacatacagagatgatggagatgatggaaaagacgttccagttagagggccagcatggaaaaaaagcaagggacatgacagagttgtttttttaaaattaattttaccaacgagttgctcatatgagcatgcatatagcttgtgtcacgttatttacttttatgtcttaaaattattttgttatttcagcctgcatatatgaagacatttacttttatcaagaaactggagtatagctatccaaaatcaatctagagactataatctatatatatttatgttaaaaggaaggtaggggttgcttgcctgatgatttaggtaaccttctaaatgtgtatatttttcctgtggccctgtctttaattcagagaccactgtatacattttatgtccattggtattcactccctcctgtatacctgagataccatctagagtcatttcctttctggctgaagaaattcctttagaattccttgtagtgtgggtctgcttataataaattctctaattttctttatttgaaaatgtttatgtttcattttcatttttgaagaaagttttgctatatacagaattctgggttgacagtttttaaaaattctccactttaaagatatcattctgtagtcttttggtctccatggcttctgataagttcattatcatttgtattattgttcccctgcatgtgatttgtcatttttttctggctgttttcaagattttaactttgtattttagcagttttcctagaggtagttttctttctatttatccctgcttgggttttggtgattttcttgaatctatatttttgtctttcactaaatctgtaagttgtaggcctatttcttcacgtcttttctgccttattctctctctcctttcctctgagactctaaatataagtgtattgaatggactgatattgtcccacaggtctgggaggctctgttctattttttaagtctttttttcttcactgcttttcagattggatggtttctgttgatctgtcttgaagttcccagatgcttctgctatctttgatatgctgttaatctcattccagttagtgtatattttacttctagatgattctgttttcacagtttctgatttgggggttagattccccatctgttcattcattgtgtatatatttttcatttaaaattcttggacgtatgtataatagctgccttatagttcttatctactcatttcaacatctggatcatccttgggttgattttttttaaatgaattttttccttgagttcagattatattttttcatttcatcacctgtctagtgatttttgatcaattcctggacactattaagtatatgttgtggagactctggatcctgctatattcctttcaatggatttttatctaacagagagttaacttggctgggctcagacttcaaacttgatcctttgggctagctaatgtgaaaggaaaataccctgggtccccaaaatccctaagggaaagggaaacgtcaagctgggaactgcttagagcaagcctgcctcccatttattcaaagtcacccctctgctcattgagataaatgcatatctgatcgcctcctttggaaaggtgaatcagaaactcaaaagaatgcaaccatttgtgtcttatctacctatgacctggtagcctcctccatgctttgagttgtcctgcctttccggactgaaccaatgttcatcttacatatgttgattgatgtctcatgtctccctaaaatgtataaaaccaaactgtgctctgaccaccttgggcacatgtcatcaggacctcctgaggctgtgtcacaggcatgcatcctcaactttggcagaataaactttctaaataaactgagacctgtctcaaatttttgaggttcacaccaggcagcagctgacatctccactctttctttcagcttccagctgctgctttttcaccatactcctgtggtttctcacatcctaggctcttggtgagccaaggatttgcatggatttcatacacagattttgtgggcttgcaccatctgcagaggcctgcctaccagggttccacctctgactttctggctgttcttctagcccccaagtttttttctgatacatcaagccagttacagttctggatctcaggcaaaagactgctacacactcagaaatcttaacttcctcagttgtctttcaaggatactcctgtctactttctgcctgcttttcatcactctctggacccttaaataagttcattaaagaaaatattttgttcaaatttgataattgttacttgcaggaggtttggtatatacaagctactctgacaatactggacaccagagccaaatatgagattttgttgtttaaatagctttattgaggtataattgatataaaaaactgtacttatttaaagcatacaatttgttgttttaatgtatgtttacaccttgaagcctttgctataatcaagacaacaatgagtattttttttcttactttttttttgagatggagtgtcgctctgtcgcccaggctggagtgtaatggtgtgatctcagctcagtgcaacctctgcctcccgggttcagtcgattctcctgcctcagcctccgtagtagctgggactactggtgcatgccgccacacctggctaattttttgtattttagtagagacggggtttcactcccacccaggctgttctcaaactcctgagctcaggaaatccaaggcctgactcagcctcccaaagtgctaggattacaggcgtgaaccaccgcacccagctaatgagtttttgagttttattaagaagtcacgtgcagatgaatggtgggaaagaaggctccttcacgttgacctcctgctttctatttcacagattgctctcaaatgcagtctctcattttgatcttcaagatgcccttgggaatgtggtcattcttaatatcacccttctgcagatgaaaaactgaggtggacgtattaaatggcttgcccttttcatgttaccttacaccactagacacctggggagatggatacgctgtcatccacagctttaggagttgtatttcagctgggagacaaaagttctcagagctggggcaaatcagtttggggtggagaagttcaagctcatgaaagctgagtgatggcatttggatggtgtgcatgagaagggaagggcttggggaagaacagaggccaagaactcagtttgggaagcaggtgtgacaagctaggtattatataatgtgatgaacacggtcattgtggaaatattaggttggtgcacaagtaattgcagttttgacaataaaagtcatggccaggccaggtgcggtggctcactcctgtaatcccggcactttgggaggccgaggcaggcggatcacttgaggccaggagttcgagaccagcctggccaatatggcaaaacctgtctctactaaaaacacaaaaaattaaccgagtgtggtggtggacacctatagtcccagctacttgggaggttgaggcaggagaatagcttgaacccaggaggcataggttacagtgagccgagatcacaccactacactccagcctgggcgacagagcaagactcgtcttaaaaaaaaaaaaaaagtaatggcttaaaaccgcaattatttgtgcaccaacctaatattaatagacaggaaaacagatactggagccctttcaaaagaggaactgagaggaaataggagtctggatataggacagaaaagaaaagggagggtcaagggtaacctttcttttcattcttgaccccagggcctttcactgatcctgatacatagtagtttgtaaatgttagctgaaacaaattagctggtgatgagaaggatgaaggggtgatatttgcttatggaccattaagttgacactacttgagtatgcatcagaatcaccttgatgggggctgggcacggtggctcatgcctgtaattctagcactttgggaggccaaggaaggaggatgactggaggccaggagttcaaaaccagccctaggtaacttagcaagatcccatccctataaaaaagtaaaaataaaaaaaattagccagacatggtggcacacacctatagtcccagctactcaggaggctgaggcaggaggatcgcttgaacccaggagttgaaggctacagtgatctgtgatggcaccattgcactccagcctgggtgacagaatgagaccctgactcttaaaaggaaaaaaaaaaggctggcgcggtggctcatgcctgtagtcccagcactttgggaggccaaggcgggcggatcaccggaggttgggcgttcaagaccagcctgaccaatatggagaaactccgtctctactaaaaatacaaaattagctgggcgtggtggcgcatgcctgtagtctcagctactcgggaggctgaggcagaagaatcacttgaaccccagaggaggaggttgcagtgagccaagatagcactattgcactccagcctgggcatcaagagcgaaactccatctaaaaaaaataaataaataagagagagaatcactagttggcactttgtgggtgctatctgagtttctggttcagtaagaggtggagacgtgagacatcaatcagtcatctcagacttccagtttccaggactgtgagaagaagatacatttatacatttctgttgttgcatcttgattaagagcaaacactgacatgtcctgtggacgctgctggcccagggctggacttggagatccagttgcacaaagtcatgagaacctttttgaattctgctgcttcacctttatgctccaggccgtgtaggagtatttttctcctagtcttgtctactggagctgacagttagagaggtgtccttgggatcattaatcagcatttaacatttgtaggcaatctagtttattactttgcttaaactctggagctcagagtcttgtttctgaagtctctcaggtaacattttgagaacactgcatgttctgccacaaattcttcacaagcagacgaggaggctttccaaatgttacagcagatcttgtgtcctggggagggcagagctggccggctccagcagctgacagactggggaggacttctgggattacgttatgctcatttgctaacctgcaaaattatgactgcatgtatgatggggtagggcactctggtcatcttgcccatttgtcagagtcttcccaggctgctgtttggactcaaaagaaaagaatctttctctgttcatgaaccacttaaagttttcaggctttgcaagctggccctttggatgcagagggcaattgtttcttagaacagaccgtgtacatttcatgccagagcactgcagggctgctggggcattgtggaccttgcggagttttgtgattctttgatgatttcatgacccagatgtgcagagtgaaaggggctttttcaatggagcatcagtacaaggcggaaactgtgccagagatgagagtgacccggttgcctttttttttcttaagtaatcgagcctagtgcttgggggcacattcactgtctagctgggcatttcacgatttcacccacctggtactaggcagctgatggctttgctgtcttcatacatttcttcccagtgtagctcttgaagacagaaggaatcactcctgagcagagcccactgatcttggcctggtgtgctatttggacacacaattgctgtcttcccccagttccttccactccattcaaaggctcccactctcgcatttttgaggtcaagggacttcctgggggtattgaattcctcccacgtcaaagagtgttcctgttaagatggttcccccaggtaagagttgattccagatattgctcgccaagaccctgaggtcagacgccttggagaattccccatggagatcccccgagccagaaatccagtgtctgttccctttctgtaaaaaccaacacacattgcgcctgtaatcccagcactttggtaggccaagatgggtggatcacctgaggtcaggagttcaagaccagcctgggcaacatggtgaaacccccactgtacgaaaaataacaaaaattagctgggcgtgatggcgggtgcctgtaatcccagctacttgaggcaggagaatcgcgtgaacccggtaggcagaggttggagtgagccaagattgtgccattgcactccagcctgggcaacaagagcaagactccatctcaaaaaaaaaaaatcaacacacaaagcagcagcagggacaaccacatcttcactaagagctactgtgagttacagaccgaattgtctccccacaaattcatatgaagtcctaacctccagcacctccctcaaaatacaaccctattgggagatacggtcgttaacgaggtaattaaatgaaaatgaaggtgtccttataaaaagaggagattaggacacagacacacacagaagattatgaaaggcaatggaagaaggcggccatctacaaaccaagagagactgacctcaaaagaaatcaaccccgctgacaccttcatctcggacttccagtttccaggactgtgagaagatacatttctgttgttcaagccacacagctttgtggcattactccacggcagccctagtggagtaatgcacagtgtcatggtgatggagtaacctaaatactccaaccactcgatgatttgatctctgctagcttgagtgctggggccaaattacactggcctctccagctctgctctcctgacctttctagaaagcttatcatcagagcccatctgctggctgatgtcttcaccaacacacactttactgcaggtaaatcctccccatcttgagctcaggcatctaagagccttatcctcttaagataggctctgttgagttagaaactgccccgctgactgaaatcgccagctccctggcccagctcttagacttcccttcctctctcccaaggtgggaaatagcttgttacttggaatgggccgtgcactttttgcccttcttgggtttactgtatgacaggtattattaaagacccatgttacattagcccctgtgtaaccatacctgcaagtgctgtgtcagttgcattagctggaattctaaattgactgttagaacagcactaaaaataatgtggtaaatgatggagttttagggcagtgtataagacttctggatgtggaggcagcctgctgcacaagccctgtgagctgggggcattctctaacccaccctccctccctcccttcctcacttccttccttccttccttccttccttccttccttccttccttccttccttccttccttcttccttccctccctccctccttccttccttcctcttctcttcctccccctcctcctcctccttctgcttctttttctcctcctccttccttcttctcccttcttcctcccctgccctcgcctcccttcccctctcctcccctcccgtcccctccccttccttcctctctgtcccctccttcctctctctgtctctctctgtctgtctgtctctctctctttcttcagacagggtctctctctgcctcccaggctggagtacaatggtctcatcacggctcactgcagccttgacttctcgggctcaggtgatccccccacctcagcctcccaagtagctgggactacaggcacatgccaccatgccttgctaattttttttttatagagacaaggcctctgttggtcaggcaggtcttgaactcctgggtccaagaaatcctcctgccttggcctcccaaagtgctgcgattacaggcatgagcccccatacctgccccattctctaattttcgtttcttttcttttttttttttttttttgagacggagtctggctctgtcgcccaggctggagttggctcactgcaagctccgcctcctgggttcacgccattctcctgcctcagcctcccgagtagctgggactacaggtgcccaccaccacgcctagctaattttttgtatttttagtggagacggggtttcaccgtgttagccaggatggtctcaatctcctgacctcgtgatccgcccacctcggcctaccaaagtgctgggattacaggcgtgagccactgcgcccggcccccattctgtaattttctacaactccatttccctatctgcaaaatgcagctaataatcatagtcagtcgtagagtcattgtgaagtttagagagaaaatatatgaagcacaagctgtgtctcacacaacactcaggaaatgttggtaagctgttagtaaaggtcacagtaaagacctcccagatcattcaagattcctttatgccctctgaatcaacagagatgcattaaatcttggtggttaagatttgtataacagttgtaaattactccatttaggttttccaaaaatggtaatccatgtaaagaaactgtgtatgcaacccacatttttgaacaaggaggattctgctctttatgggtcttttagcccttaaattaatattttctggctaatttccttatattatttcaagccagaagctaaaattgcatccctctctactcccctttcccctttatcctctccaagaggagggggaactcttatctacttggttcagaagctaggaatcagatgaggccagtttatgggggtttggactgctgctactgaaaacttagtgtacaagagagtgtggtctctgcttcctctcacccctgccgcaggcctaagctgagcggggcctctgcctcctggggcaggcccaactgtcttactatctttgctcttctttggacacttcatggccttcaagtcctagctggagagtgtaagagcttacatttcaggcttggacttagcaggtgggagaggctcctagaagctgatcctgagtccctcctcccagatttcacttccagtttgccattgcccttcataagctgatcaactctggaggtgacagaaaggagggccaactggctcactattatgaaaactgtaaactcacttccctaacaaaggagtttatagctgttatttctgcagccagtaccaaaacgaaagcgagactttggcctgtacaaaccaactcagctatctggtcatgtacatccagactggtgctctactgggaaaatgaatattttccctaaggcgagaaaggctgggcctgctgtagcctggcaactccttctctgcagacagagcttgcgtttctctttatttttccttttacttccccaaggtaaacattcaagtagatggcttcccttactttcatctcccaggtcccttttcctgttttctctggattttgtatttaaaagcaaagcttaagtctctgacagatgcacccagctgcagtgtgagaaggcactcaaactgcaacaaagagaagacgactacaacttttagtagatacttaattttttgttgttttgtttttagagacaaggtgttgctctgtcacccaggctagagtgccgtggcaggatcataagtcactgcagcctcgaactcctgatccttctgcttcagcctcctgagtagctgggactacaggcacatgccaccatgcttggctaatttttctttctttttttttttttttgtagaggtgggcgtattgctgtgttgcccaggctggtctcaaattcctggcctcaagcgatcctccctctttaaaagtccagcctctttaaaactgtgaatgcaataagatctggcataaagactgagaaacttgagaggaaccggtggaaatttcttctgagttacgctcacttctctctgcttcgtttgttcgtatcattgttacttttgctcaccagtcatgtttttgaagtagccacaaaaataaatggtttcctaatattatttccacctcccccctcatccacttttcatcgtggaattcttttcagagtacactttgtgcttcaaaattcagaggtactgacgtgcacataggttgcagttgtcctggtctgtgtgggggaatggctgaggagggtgtttcctgttgaagacccaattactttttttagaaaaaaattttttatttccatagacttttggggaacaggtggtatttggttccatgagtaaattccttagtggtgatttgtgaaattttggcgcacctatcacccgagcagtatacactgcactcaatttgtagtcttcccaccctttccacctgagtctccaaagtccattgtatcattcttatgcctttgcagctgtagagcttagctcccacatatgcgtgagaacatacaatgtttggtttttccattcctgagttacttcacttagaataatattatagtctccaatccctttcaagttgctgcgaatgccattaattcattcatttttatgactgagtagtattccatagtatatatataccacagtctctttatccattacccatgtgatgggcatttgggctgattctgtgtttttgcagttgcgaaatgtgctgccataaacgtgtgtgcaagtatctttttcgtataatgacttcttttcctctgggtagatgcccagtagtgggattgctggatcaaatggcagttctacttttagttctttaaggaatctccacaccgttttccatggtggttgtatgattttacattttcaccagcagtgtagaagtgttaccttttcactgtaaccacgccagcatctattattttgttactttttttgattatggcgattcttgcgggagtcaggtggtatcacattgtggttttgatttgcattttcctgatcattagtgatgctgagcattttttcatatgtctgttggccatttgtatatcttcttttgagaattgcctattcatgtccttagcccactttttgatgggattgtttgcttttttcttgataatttgtttgagttcattgtagattctggatattaatcctttgtcggttgtgtagattgtgaagattttctcccagtctgagttgtctgtttactctgctgactgttacttttgctgtgcaaaagctctttagtttaattaagtcccacctatttatctttgttcttattgcatttgcttttgggttcccaagtcactttttgaaatatccccagcacagctttggatgtgtcactgggccactggacacaggcatatctcacaaaaaatagagtcggggagagtgagagaataggagagagcttttctggagaggcagcccagtttaaatgtgaaatacaccttggtatattgattgctgctctacagttcttgaagaagaaaaaatgaggtttcaaaacaagaaggaggggaagactagacaaaagagcttgttgctttttatggttaggctgtgttcccacccaagtctcatcttgaattgtagctcccataattcccatgtattgtgggatggactcagagataattgaatcatggggcagtgtcccccatactatcctcgtggtagtgaataaatctcatgagatctgatggttttataaggagtttccttttttcttggttctcattctttcttgcctgccgccatgtaagatgtgcctttcaccttctgccatgattgtgaagcctccccagccacatggaattgtgagtccattaaacctctttttctttataaattaccctgtctcgggtatgtgaaaatggaataatacattgcttcttggaagacagcttttccgggggtccttcagtcagaacttgttctgccaacagaggtggtgggggtggcatgtttgatgtgtaggcgtcagagggattgataagacctggtgactagctggtgtgcaggtctcagtctctggagagaaggggcagttggagggaggaaggcaggaatgatcttggctgggaggatgtgttgcagtggttggtgcagggaacaatcaaggctttgtgatcatggatgctgtgggtgtggttggaggaggtcctttaagggctgtcttcggtggaggtttgggagaagagttggcctggctacaactctgcttcaaccaaagcatctttagtttgagcttttaatatcttgggcctgtcctgcaggcttgtttgaacaaagactatacataaaataagcaagaaccatttcttttttttttttttttgagacagagtttcattcttgttgcccaggctggagtgcaatggcgtgatctcagctcactgcaacctctgcctcccgggttcaattgattatcctgcatcagcctcccgagtagctgggactacaggtgcctgccaccacgcctggctaatttttttgtacttttagtagaagcagggtttcactgtgttagccaggatggtctcgatcacctgaccttgtgatctgcccaccttggcctcccaaagtgctgggattacaggcatgagccatagcacctggctgcaagaaccatttcttctgaggaatccctagagacccggggcttggtctttaggaacagctgatctttaagaaaaaagttgcacaagatgggctttgatatagtttgaatatctattcttgccaaagtctgattttgaaatgtaataccaatgctggagttggggcctggagggagctgtttggatcatggtagcggatccctcatggcttggtgctgtcttcctgatagcaagtgagttcttgcaagatctggtcatttaaaagtatatggcacctcccccactgtctctcttgctcttgcttttgccatgtgaagtgcctgctcctgcttcaccttcatccatgattgaaagcttcctgaggctttaccagaagtcaggcagatgacagcactgtgcttcctgtatggcctccagaaatgtgagccaattcaatctcttttcttcataaattacccagtctcgggtatttgtttatagcagtgcaagaatggtctaatacagatttgaacttgaattttaaaattaaaaaattttttgagacggggtcttgctttgtcacccaggctggagtgcagtggtgtgatcatggttctctgcagccttaaactcctgggctcaagtgatcctcccacctcagcctaccgagtatcagggactacaggtgtgcaccaccatgcccacctgtattttgtattttttgtagagacagggttcaccgtgttgcccaggctggtctcaaactcctgggctcaaatgatctgcctgccccagcctcccaaagtgctgggattttacaggcatgagccactgtgcctggcttgaacctgaattttaaatgctaagaatgcacagattccaaagacacaagatagggggcccggttcagaggtaagatcctgcccttgtgtttcttggaatttttttcattttttgggggttttaaaattgagatgtaatttacatacagagtgaaatccacagaccttaagtgtagtttgattcgttttgagaaacacatacatttatgtaacccacagtctaccaatacataatacaatttcatcatctcagaaattctcttgtatcgcttcctagtcagtcttccacattcaccagaaacaagcactattttgatatttttagccctagattagttttgcctgctctagaactttatggaaatgaaatcatgcatatatattcttttgtctctgtgttttgttttgtttttcactcagcattttttttttttgcatttttctcaagaggtctgcagtcttttaaaaaaagaagcggaaaataaatatggtagacttgccaggcaccagatctctgtagcaactactcaactctgctgttgcagcaggaaagcagtgtagacaatatgtaaataactgcatgtggctatgtttcaataaaactttatttacagaaaacagatggctggtttgcagggataattagctgaccccaatacatgttgtttatcaggagtttcgttgctttttattgctgcgtcgtcttctatgtgtggatctgtcacagtttatttatctgttttcctgttgatggacacccagaccatttcagtttttggctattatgaaaagagcaactgtgtctgcttttatataggacttttgtgtgcctgcattttcatttcttttatataagtacctacgagtggaattactatgtcataggatatgtattactcagggttctctagagggacagaactaataggatagatgtatatatgaaagggggcttataaggagaattgactcacaggatcgcaaggtgaagtcccatgataggccatctgctagttgaggagcaaggaagccagtattggctcattcccaaaaacctcaaaagtagagaagcagctgacagtgtatccttcagtctgtggccaaaggcccaagagcccctggcaaatcactggggtaagtccaagagtccaaaagccgaagaacttggaatctgatgttcgaggtcaggaagcatccagcacgagagaaagatgaaggccggaagactcagcaagtcagcctctcccaccttcttctgcctgtttcattctagccacactggcagctgatttgttggtgcccacccccattgagggtgggtctgtctctcccagtccactgactcaaatgttaatctcctttggcaacaccctcacagacacacccagggacaatactttgcatccttcaatccaattaagttgacactcaatactaaccatcacagggcaagtgtatatttaattcttttttttttttttggaggtggagtcttactctgtaacccaggctagaatgcagtgatgcaatctcagctcactgcagcctctgcctcccaggttcaagtgatcctcccgcctcagcctcccaagtagccgggattacaagtatgtgccactatgcctggctaatttttgtatttttaatagagttggggttttgccatgttggccaggctggtcttgaactcctgacctcatgtgagccacccaccttggcctcccaaagtgctggtattacaggcatgaaccactgcacccagccctatatttaactcttaactgccaaataaatttagaaaatcattgtaacatttttcacttttgcctgcaacatatgagagttccggtggtgcctcatccttgccaacatttggtgttgtcagtctttttcctgttagccatggtagtggctgtggagtggtagcccacatgcttccttgaatacttcttgactgatgtggttccgtcacatgtgttgcctttatttctgcggtacctggagaggtgatcctctgcgatcaacctctcaggcacttaatagcctctctttacacaggctctgcatgagtaagtggcatgtgtgcacccagagtctttgagagaatgcatcttggtctttaaccatcatctaccatttatttatttatttatttatttatttatttatttatttatttatttttgagacagggtcttgctctgttgcccaggctggagtgcagtggtgccatcattgctcactgcagccttgacctcccgggctcaagctatcctcctacctgagcctcctgagcatctgggactacaggtgcacaccactatgcccagctaatttttaaattgttttgtagaggtggggtcttgctgtattgccctgtctgatctcaggctcctggcctcaagccatcttcctgccttggcctcccaaagtgctgggattacaggtgtaagccaccacacttgcccctcatctattgcaattgtccacatgcatcagattttacactgatacgcttttgtcttttttttttttttttttttggtgtaaacatctcctttcccggctttgactcggtggaggagagctgggagaaggtgtcagcagtgacatcatttctggttttacaaatgccagggtccttcctccttcagagcctggagacaaagctgggccccatttatcacaacacccggccaactccttcctgccatatggctgattctctcctggggggaagattgagaaaatagacccatatgctactgtgattctgtttgtgtttggatgtggagtttaatttgtgtcagaaaatagcagtattcttatttcattgatttcctttttgcttcttttataaaaggaaagaatgaaagctggggaattagctacagaaatagcaagtgaataataaaataatgtgttgtggtccacgtgcagttaaaaacgggaatgatgttttactctctttcggggcgtattgacaaagagctatactggtttcttgtatcgatgtgatattttagaggtatcaagcattcttgtattcactgtcttatccagttataaaagtaaccttgtgaagtaggtggtctctaaccaatcatctgctttatttatttatttatttttgagacagggtcttgttctgtcacccaggctggagtgcaatgatgcaatcagaggtcactgcagccttgacctcctgggctcaaacgatcctcccacctcagcctcctgagtagctgggactacaggtacacaccatcatgcaccaccatatcaagcagatatgatgtccatgtcataaatgaggaatttgacactcacagaggtttaggaacttgccccaggccactgagcttagactgtggtcctcatcgaatagttatttgaaattcttaatgtcttggtttgtcaccaggcatttcactgcacacatttttttccctacctgggaaaagggtatatgggatcttaagaaaagggtaggggagttagagcatcatggtcaaataatgctgttccctggcagatacagtattggaactggaggagggagaaggaataggtaggtttttgggaagataactttatatagagattcacccatgcaacgagacagagcctgacacttgtgttggtgctgatgagtgaggacatggggtcagcagggtgacagcctgggccctgagcacctgtgtgtccctggctaagccactcaatccctctgtacctcagtttctcatctgcaaaattgggttcttggatatgatcttctttctcccttccagctccaaactttatttattaccaaaagcaacttcagtttttcccctttggttactccctttaattaaagcatgctaccttggtggagttacatcagagcccttcagcatcacggtgctgtctcagatttgtacagccctgttggagcaaagtctttaaggaaatggggggactgccccggtgtctggaggcaccatctgaccacagcttctcatcattgcactcatctttaggttcttggatgtaagttgatgtagaaatacgtctgcctagcacctagctttggccaggggttgatggcataaatggggaggcaatagtagctaatatgtatatgcatgtatattctgtgtctgccacctgctgataactttacagacattaccttcttatatcctcaaaacaactctaaagagtgagtagaatgattaaccccattttatggatgaagcttcctactgaagctgttgtctaattctggagactgtgattttatttatttatttttttcagatgaagcctctctctgttgcccacgctggagtgcattggcatgatcataacttagtgccacctcgacctcctggcctcaggagatctttccgcctcagtctcctatagctgggaccacaggcacgtgccaccatgcttggctaatattttcaatttttttgtagagatggggtctcacttgttcacctaggttggagtgcagtggcatgatcataacttactgctgcctcagcctcctgggctcaggagatcctcctacctgagtctcctatagctgggaccacaggcatctgccaccatgcttggctaatattttaattttttttgtagagttgggatctcactctgtcacccagactggagttcagtgttgcaatcatggcttactgcaccctcggactcctgggctccagtgaccctctctcctcagcctcctaagtagctgggactacaggcacatgccaccatgcttggctaatttttaaatttttttgtagagatagagtcttgctgtgttgcccaggctcatctggaactcctaagctcaagcaatcctcccacctcatcctctcaaagcgctggggttacaggcacccagccgagcctatcatcttaaccattatttcatgagtagccatagattaatacaaatctataagccaatgtttcttgacacttatgaccagcccccaataaaaatcttgcatactaactccctaatgagcttctctaatgggaaactcttctcatgtgttgtcagaactccttactggagggattagcagcatcccctgtgacttcactggggtagaactcttggaagcttgcacgcagtctcctccagacctcctcccatgtgcctgttccctctcttgctgctttttatttttatttattttattatttatttatttatttttgagacagggtcttgctctgtcgcctaggctggagtgcagtggcaggatcttggctccctgcaaactccgcctccaggttcaagcaattcccctgcctcagcctctcaagtagctggggttacaggcacctgccaccatgcctgggtaatttttttgtatttttagtagagatgggacttcatcatgttgaccatggtggtcttgaactcctgacctcaggtgatccacccgcctcagcctcccaaagtgttgggattataagcgtgagccaccgcgcctggccccttcttctgcttctgttttgaatcctccactgtaataaatcagagccacgagtacaatgtgctgagtcctatgtctcctcctactgaattattgacctgggggtggtcttggggactcccagaatacctgagttgaaagcttggttatgctacttgatagtgtgtggctttgagactgttgcttaattaaaaaaaaaattattattatttatttttgagacggagtcttgctctgtcgcccaggttggagtgcagtggcgtgatcttggttcaagtgatcttggttcactgcaacctctgcttcccaggctcaagcgattctcctgcctcagcctcctgagtagctgggactacaggtgcgcgcaatgatgcctggctaatttttatatttttagtagagacggggtttcaccatgttggccaggctggtctcaaactcctgacctcaagtgatctgccttccttggcctcccaaagtgctgggattacaggtgtgagccactatgccccgccaatttttttttaaaaaatttatttttaatttttgtggatacgtagtaggtgtatatgtttatagagtacatgagatactttgattcagacatgcagtgtgtaacaatcacatcatggaaaatggggtatccatcctctcgagcatttatcctttgtgctacaaataatccagtcatactcttttagttattttaaaatgtgcaacaattacattattgattatagtcaccctgttgtgctttttttttttttttttttttttttgagacagagtgtcgctctttcgcccaagctggagtgcagtggcgcgatctccgctcactgcaaactccgcctcctggtttcacgccattcgcctgccacagcctcctgagtagctgggactacaggcacctgccaccacggccggctaatttttttttttttttgcatttttagtggagacggggtttcaccgtgttagccagggaggtctcgatctcctgaccttgtgatccgcccatctcggcctcccaaagtgctgggattacaggcatgagacaccgcgcctggccctgttgtacatttaagtagtaggtcttattcattttatctaattatatttttgtacccattaacagtccccactttcctccactcccccactccccttcccagcctctggtaaccatccttttgctctctatctccatgagttcaactgtttcaatttttagcctccacaaataagggagagtcagcaatgattatctttctgtgcctggcttatttcacttaacataatatcctccagttttatccatgttgttgcaaatgacagggtcttatttctttttagggctgaatagtactctactgtgtatatgtatcaagattttctttattcattcatctgttgatggatgattatgttgctttcaaatttctttatttattgtaatcttctgtaaaaaggggatgcaggccaggcacggtgactcatgcctgtaatcccagcactttgggaggccgaggtgggcggatcaccagaggttgggagttcgagaccagcctggccaacatggtgaaactgtctctactcaaattacaaaaaaattagctggatgtggtggcgggctcctgtaatcccagctactcgggaggctgaggcaggagaatcgcttgaacccaggaggcggaggttgcagtgagttgagattgtgacattgcactccagcctgggtgaccgagcgagactctgtctcaaaaaaaaaaaaaaaaaaaggatgcaaataccaacttcaagtgggtatggtgtgggttaaattagaaatatgcacatagtggcccccaacaaatgttggttcttttctgctctcccatccaaaagcaataactaaccgaaatgggtgtagtgagtatttgggcattgctgcagtaacagaaagaccttcagtttcttggcatcatttccttcatttattgagttatgttccatgctctttgctgacctggactctacttactaaacatggtccttcgctagagagatcgagaagaagccaaaaagtctttgagcttccaggattttctctggagacagctaacctggactaccagtaagtggccaacaccagctgacactagctgacgctagttggactgacaccaacacagacctgtaagaatgaagaacctcctaattaacgacgctatagcttgggaagataggtacttaagattgacaagccattttagtcttggtttctgcaggtggtgtggccgaacattcagaatcaaagcaattttcacttcatttcatccagaaggtctctatgttttcttataaagagactgtattttgctcctctctctccccacaaaaagaaatctggtcaaaactaagcacattcccttcgtttatgtgttggctgccgtggttcataaactttagtaggtttcagaatcacatggagagcttgttgaaacatgaaatgctggcacgatcctcagaatttctgattccttaggtcttggcggggcttgagattttgcctttctaaactgttcccagttcatgttgatactgttagtcctggataatactttgagaacctctatgtggccgcggcctctatcagagcataaccgggccgtggctgagatacatctgtcttatctgtcaagaatgactcatttaagcacttcactgcgctgcatgtcctttgattaggtggccaagggggtggctaaagctgaatttacaaggcaaggagccctgaaattcttctttgaaagatctcgcaaatgatctatttatttttcatgggatgattttccagatctttggtttgctttcctgtttggcttgtgttagaacactactgttcctaaagttgtaatttttgtaacccattggcatatgtaagtggtttacacaggttcttgtggattaggatttctaaccgtccatcatctgtctgtccactggcccactcacctactcatccattcatccatctgtttacccttaccctctctgtcccactcatccatccacacacacatccatccactaaccccatccattcatccatccatccatccatccatccatccatccatccatccatcctgcctacccttctgctcattaatccattcatctgctcacctgatccacccgcccacccactcaccccatccaccgacccacccatccatctgtccatccttccacccatccatccatccatccatccatccatccatccatccatgtatgtgtccacccacccacccatgcacttatccattagctcactccatccatccatccacccactcatctatccatatgtatattcatccatcatccatccatccatccaacataacacacttgtagactatagagatataaagaaaaataagaccatgtcgccatcctcaaggggtttatggtactgtaatagaacctcctcttttttgtcttccttacagaaaagtgtgcatttcttgctttctagtgagttgagataatagttaaatccattagattaatattgacctttcttgtaaacacacatctcctcagaaaatgttttgagaaatctgctgacttcttgaagtaaaggcacaaatgtctttaacccagtaagtaccttttgttgaaaatcaattccttccaaggaagcttttcatagcctcttggtggtgatgacaagaaggtttcctctgaataagtatggtatgttttagaaagttctgccacgttatcatgttggcttgaaagccccatgtctttatcagtaagtctggcccgtggcttcgtgcaagatgtttgtagatggtgtgtttgtattgatggagcatctgctctgggtcagcctgcactgcatgctcaaccattagagagcacccatgtaaataattctagaccaccttccttgggatcctttgaccagacacattttggcatttactactaggtgcagtaataatccaggtgactgcatgtccactggtgtaaatggttttaatggttcctagaggctggattttaagtgttaaaatcactctctgtgtcccttcatcctgcaaaagtgttcaaaaacttgagttataaacttttcttaaaatacctgaattattttcatctctccttatcctagttccatctttatttaaacacatggagctttttgcgtggttatagtcattatggatattcagtttttttctgcttttctcacattacattatttagtaaatattctttcctgctcctacatagctatgataactctataatagtgcacagtttaatgtacctttattgcttttccattttctatcacttagttattaggtcgtttctatttttttaaaaataatgaatgtttctatacctagcatctagactcagaaaacaaaacaaaactcaactcttttttccttctttaaaataattacttacgtacatttatatgatgttatttatatgtattattattctgattatatttttaaacactcttgatatagttagtcagactttcttcccaaagaattcaggcaattcagttatctctctgccaaaattgggcttaatggtttttctttgtttttctaattttaattttaaagagtgtgcccactgttttgatttgcatttctttaattactgacatcattaaatccattttcagtaattggcttattaaaggagttctgtttatgtgttcgtgtatgtgcaggaaactggtaccatattttttctttgtatgggggtgtgtgtgtttatttttatatatatatatataatttgtgtgtgcatgcgtgtatggcttaatactatacatgtgtggattttccagtcatattggctttcttttcatgtgtttttttctggcctcataatactgatgcctgctgagaactcagatatttattgagtgaatgaatgtttatctttgctctgattctcttctgttatacacattcaaaactcttacacgggaggacaatgttgtttgttttattccaggttttcttatttgatttgtgatatttagcttattttttggccacaaaatttagattggatacggatctaagtttgtttttctccattttttttggtttgatttctgtcctaatgcatgaaattatactttattttactttgccagtttttttttttttttagttttttgagatggagtctcgctctgtcaccaggctggagtgcaaatggcatgctttcggctcactgcaacctccgcctcccgggttcaagcaattcgcctccctcacccttccgagtcgctgggattacaggcacacgccaccacacccagctaatttttgttatttttagtagagacggggtttcaccatgttggccaggctggtctcaatttcttgacctcaggtgatccacccgcctctgcctcccagagtgctgggattacaggcgtgagccactgcgcctggcctactttggcagttaaattctttaaacatttgggatctatgtctgggatgcctcttctttctcagtgatctgtgacttggttttaaggtattttttactccttatgacatgtttgtttcaaacatattataatgttcaatgaagaaaatcctcttttattcattcctttcccccaaatagtatttttttctctcgtttttttctgttttaaattgcattttacataaaacaatataaataagcaatgaaaagttttccagggcaaaaggagcataaagtgcagacctttattctgtagcttcagtgaagtataattagataaattttaattaaattaaaataattcatcacacagacaatattataacaggagtagagaaaagaaagtgaaactttcacccacagtcatccataacagttttttcaagtgtacacatttctgtttaaaggtatgtgaagtctgcattgttttaattctagcttagctttagttgcatatttgcaatttttcatttaactttatgtcacaaagattttttccatattagtatttttcttttttaaaatgtagttgaatcaaacatttaattaagtaatgattgtatatctttattaggtacactgtaatgttttaatatctatatacatgatggaacaattaaatccatctaattaacatgtccatcattgcacatacttatctatggtgagaacatttaaaacctactctcttagcaattttcaaatatgtgatactttattaataactgtagtcaccgtgctgtgatatttccaaaacttatccctcccgtcaaaccgaacctttgtaacaaaaccccacggccactgccaccagcctttggtaaacaccattctattctctgcttctataagtttgacttttttagattccacatataagtgagattacgcagtatttgactttctgtacctactgttttcacttagattaatgtcctccaggttcattcacgttgttgcaaatgacaggatttccttctttataaaggctgaatagtgggtatatgtatacacacgtgcacacacacacacacatacatacacacacacaccattttctttatccatcatccattgatggacacttaggttgattctgtgtcttggctattgtgagtagggctgcaatgaacatgagagtgctgatatcttttcaacatactaagttcagttccaatggatatgtacccagacgtgggattgctggatcatatggtggttccatttttaattttttgaggagcctccatactgttttccatagtggctgtattaattttccatttccaccaacagcataccagggttcctttttctccacatccaacacttatctttcgtctttttgaaaacagccattctaatggatgtgaggtaaaatctcattgtgttttcaatttgcatttccctgatgattaatgttattggacattttttaatatacttgttggccatttgtatctcttcttttgagaaatatctattcagattctttgtccatttttaaaattaggtcatttatttctttgctcttgagctgttcaagttccttataaattttggatattaaccccttgtcaggggcatggtgtattaggctgttcacacatggctataaagaaatacctgagactgggtaatttttaataaaagagatttaattggctcatggttctgcaggctttgcaggaagtatagtgctggcatctgctcagattcgagggaggcctcaggaagctttataatcatggcagaaggcgaagggggagctggcacgtcacatggcagaaggaggagcaaatgagagagtgggtcaggaggtaccacacacttttaagtgacaaatatccagactgtgtcatatttttcaaattattttctccccgtccatgggttgtctcttcactctgttgattgtttactttgctgtacagaagccttttagtttgatgcagtctcatttgttgatttttgcttttgttgtctgtgcttttggattcatattcaaaaaagtcattgtccagaccaatgtcatgttttgttctagtagtttaaaagttccaggtattctgttcaagtgtttaatccattttgagttgattttagtatatgatgtgagaaaaggatccgacttcattctgcttgtggatatccagttttctcaacaccatttattagagactgtcccttattcattgtgtgttcttggcacctctgttgtaaatgcattgactgttaatgtgtgtgtttattactgagctctctgttctgttccactggttgatgtctgtttttatgccagtaccatgctgttttgattactatatctttgtactatattttgaaatcaggtagtgtgatgcctccagctttgttttgtttgcacgagattgtttggatatttgagtctttagtgcttctatgcaagttttaggatcaatttttcttttatttttgtaaaaatgtcattggaatttgatagggattgcattgaatctgtagattgctttgggtggtatggacactttaacaatattaattctttcaatttttgaacatggagtatcttttctcttctcttctcttttttctttttctttttttttttttgagacagagtctcaccctgttgcccagactggagtgcagtggcacaatatcagctcactgcaacctccgcctcctgggttcaagtgattctcctgcctcagccacctgagtacctgaaactaccggcatgcaccaccatacctgcctactttgttttttttgtttttgtttttgttttttgaaacagagtctcaccctgtcacccaggctggagtacagtggcacgatcttggctcactgtaacctctgcctcctgggttcaagcaattctcgtgcctcagcctctcaagtagctgggattataggtgcctgccaccatgcctggtaaatttttgtatttttagtagagacggggtttcaccatgttggccagcctggtctcgaactcctgacctcaagtaatccacctgtcttggccacccaaaatgctgggattacatcttttcatttacttgtgtcttctttaatttatcttgtcaatgttttattatcagtgtacagatcttttgttttcttggttaaatttattcctaagaattttattttattttttattttttactttttacttttttttttttttttttttgagacagagtctcgctctgttgccaggctggagtgcagtggcgtgatctttgctcattgcaacccccacctcccaggttcaagcgattctcctgcctcagcctcctgagtagctgagactacaggtgggcaccaccatacccagctaatttttgtatttttggtagagacagcattccaccatgttggccaggatgatctcaatctcttgacctcgtgatccgcctgcctcggcctcccaaagtgctgggattacagacatgagccaccgtgcccggccactttttacttttttcaagagacaggtctcagtgcagtaatgctcattgcagcctcgaactcctgggctcaagccatccttccatcacagccactctagtagctgggagtacaggcacgctccaccacacgcttgactaatttttaaattttgtgtagagatggggtcttgttatgttgcctaggctggttttgaatttttttgatgctactgtaaatgagattgttttcttgattactttttcagagaattcattgttagtgtatagaaatgctgaattcagtagagtttcaggatattattgcatcaaaacacaggatttctgcatattattatgatttaagtgattattgttttacatgactctttcattgagttaggatttaataattctcctaagcagttcctttgattaaataagtaggttatttctaacaatttgctatgatagattatacagtaacaaactttgcagtgcagatggctgctttttgttgagaatgatttctttttgatatgacactgagccactgcatgtagtcatatgggtatttatacaaattaccaaattgctttgccagctagagaatatatatatatatatatttgacatgtctctttgtcaaatatatgaggtgtgtgtgttcatgtgtgtgtatacatatgaggtgtgtgtttgtgtgtgtatatatatatgaatatatatataaaatatatatatttatatataaacacacacaccaagtggttatcttgtgctcatgaatttgtactcataaattcagctctgtgtgtgcagtctgctcagcagcacctgggcagggcacttaacccggtctagatctcccaccttccccagtccatggaccctttctgacagcagtggtgatgaattgaccatgtgagccacgagaacagaatagtgtcatgattcatgatctcccctgacttggccagaggcagcgggagaagcagcagtgctcagagctctcttgagagtggaggcctgtgttcatcattttgtaaataagtcacatgctaccccgttgtaatactactttttaagataaaaacccacttcccaaattgctttccagagatttcctcaaggtagtgatgatcctaattattaattacttgatttgcaggcttttcccaatatgattatatttctgtaaggtgtaggggaagttttattgtcagggcgaccaagacggtgggtttctagtgcagttttgatgaagacctctacttgatcagggtctcatatttctgcggctaaaggaatgcagaccatatctggattctcctgttttctctgtcttgcactgtctgcacgaggtaccccttttctagtcaagactgatcagtaggccgggcgtggtggctcaagcctgtaatcccagcactttgggaggccaagacgggcggatcacgaggtcaggagatcgagaccatcctggctaatgcagtgaaaccccgtctttactaaaaatacaaaaaaaatagctgggcgtggtggtaagtgcctgtagtcccagctacttgacaggctgaggcaggagaatggtgtgaacccgggaggtggagcttgcagtgagccaagatcgtgccactgcactccagcctgggcgacagagcgagactctgtctcaaagaaaaaaaaaaaagaccgatcagtagcagaatcaaccagcctcactttttgctttttcttctcatcagagagagagccctttcctgaattttgccattgatcaattgtgttgtgttgttaagtaagccacgtatgtttatattttaatgtgctctcaatggccttctcatctttgacttgtaagtttaaaccatgtcccttcgttgtcctaccttatctttggttttattttattttggatgttatttattattattgcattaccacccacttctctcctttctgcccccatgtccttatcttctgttatgtggagctggataatttagtttagctttgtcttttatagtgatgtgggaggaagataccgtatttcattcttcttctgctatgcagtaccagctaaaatgacttaatcagcaaagtggagggtaaggatgatagatgctggctcgggtgggttggggtagggaggtagggtacacgtcatgccacgtggactgcctgagcaagggcttctggaggcaaaacacaacattccaccatgggtaagtgtcactcgcacctggaatttgggagggcatagtgagaaatgagctgacacccactcactggtccttgggagccttgtgtgcccatttatgagtgtagacttgatcttgaagacacctggagctcaaacacgagcatctgtctgaaatggagttcgttgaaggtggttttgtgggcattatatttgttttgggatttgtcatgggtacaacatttagagccactgatgtatacaagcaatgaggtggacatgtgcctgtaattttttttcttttttcttttttttttttttgagacagggtcttgctctgttgcccaggctggagtgcagtggcacgatcatggctcactgcaacctcgacccccctgggcgcaagtgatcctcccacctcggcctcccaagtagctggggctacagtcatgccacaaccatgactggctgatttttgtattttttgaagagatgggttttcttcatgttgcctaggctggtcttgaacttctggacttaagcgatctgcctggcttggccttccaaattgctgggattacagtcatgagccagcacgcctggcccattgctataatttggaattaaatgtggtgtttctcaaaacacaacagatgcctgctcccacagggagattgataaaagggagaaggagcctcccattcacagattactgtaaccaaaagtctcagccagacctactcagtgcagacaaataccctcccagaaacatttatggcatagcctttatattgtatttgttttaatttaataaatgctttttttttttttttttttgagataggatctctctctgttgcccaggctggtgtgcagtggtgtgatcatagctcactgcagtcttgacctcctgggctcaaatgatcctcctgtctcagcctccagggtagctgggactacaggtgtgtgccatcatgcccagccaatttttcgtatttttggtagagatgagatcttactatgttgtcgaggctggtcttgatctcctggactcaggctgtcttcccatcttgacctcccaaagtgctgggactacaggcgagagccactacacctggccacgagtgcttctaaaatcatataatgtattaatattttaatttttttcttataagatgtttctgtatttttatgatatgatatgggcttccaggaatggaatctccacttacaacattacactcggaggaaacaaagaattgatttataattacttgatttgctacctttgtccagtaattgattaggttaggggttggcagacttctcctgaaacaggctggagagtaagtattttcagctctgtgggccatatggtctctgtcataactacgcaactgtgccactgcagcgtgaaagcaggcatagacacctcataaacaaatgagtgtggctgtgttccaactaaactttatttttggagagtaacatttgaattttatgtaatttccatgtgttgcaaaatatcattcttctctgaatgtttttcaatcctttacaaatgcaaaaccattcttcacttgagggcctttcaaaaacaaggcagtgggcaagatttggaccacggtttagcagtctcttcctcaggtcacagtttagggttgtagagctgtgatttacttagcaaattctatgtgctgggtactgggctttatcttttcatatataggctcacataatcttcacaaaaactcttaattatgtatttatttgtttatctacaagggggaactggggcttcttgaagttaactcacttgcccaaggttatattttagttatgtaatagtggtggcatgacactttattttttattttatttttttgagacagggttttgctgtgtcacccaggctagactgcattgtgatcatggctcactgcagcctccaactcccaggctcaagcgattctcccacctcagcctcccaagtatctgggactgcaggtgtgcatcaccatgcctggttaatttttctattttttgtagagtcagcgttttgccatattgcctatattagtccgttttcatgctgctgataaggacatacccgagactgggaagaaaaagaggtttaatcagacttaacagttccacatatctggagaggcctcagaatcatggcaggaggcaaaaggcacttcttacatggcagcagcaagagaaaatgaggaagaagctaaagtggaaactcctgatcaacccatcagatgttgtgatatttatttatttatttatttatttattttgggacagagtttcgctctgtcaccgaggctggagtgcagtggcacaaactgagctcactgcaacctctgcctcctgggttcaagcaattctcctgcctcagcctcctgagtagctgggattataggcacctgccaccatgcctggctaatttttgtagttttagtagagatggggtttcaccatgttagccaggctggtcttgaactcctgaccttaggtgatccacctgcttcagcctcccaaagtttgagacttattcactatcacaagaatagcatgggaaagactggcccccatgattcaattatctccccctgggtccgtttcacaacacgtgggaattctgggagatgcaattcaagttgagatttgggtggggatgcagccaaaccggatcattgcccaagttggttttggactcctgagctcaggtgattctcctgcctcggcctcccaaagtgccaggattacaggcatgagtcaccactcctggccgagtgacaatttgaactgaagtctgcctgagtttaattttaactataaaggccctgttcttgtggagtttgcagagttgtggtgaagagagtgggtaataaagcagttttgcaattgttagtagaatattataatttaactaataagtaactctcttagatacaccatattggtaaagcctagaatgaggttggcttttggattgttcatcacttttagtgacagtgcagtggacaggagaggttgtttgggtttgaatctcactccaccccatggaagttcagtgaccttcaagttatttgtcctccctatgcctcactttcctcatgtgtgaagtagaagcagaaagagcgtttgcttaggagcattgttaccaagattatatgagaagggagactgcaggtgatggacatgtagtacattgtcaacagacatgagctcttattgtcactattttttaagagtcaaataaaccccaccggctatatttaagactcacagtgctgctaaatttttttctcccctgctctgtatttccaaaaatatttttggaaaaaagattcagtcttatcaattacattgttcagatcaatgtctttgctttttactaaaccatattactaaattctagtgacctgattttatggtataccaccacaacagagattctatcaagttctctttaccttggtgatatggtttggctgtgtccccatccaaatctcaacttgaattgtagctcccagaatttccacgtgttgtgggagggacccagggggaggtagttgaatcatgggggctggtttttcccatgctgttctcatgatagtgaataagtctcacgagatctgatgggtttatcaggggtttccgcttttgcttcttcatcgtttttctcttgctgctgccatgtaagatgcggcatgtgccttttacctccccacatgattctgaggcttccccagccatgtggaactgtaagtccagttaaacctcattttcttcctagtcttgggtatgtctttatcagcagcatgaaaacagacgaatacagttaattggtactagcagagtggggtgttgctgaaaagatacccaaaaatgtggaagcagctttggaattgggtaacagggagagattggaacagtttggagggctcagaagaagataggaaaatgtgggaaagtttggaacttcctagagacttgttgaatggccttgcccaaaatgctgatagctatatggacaataaggtccaggctgaggtggtctcagatggagatgaggaacttgggaactggagtaaaggtgattcttgttatgttttagctaagagactggcaacattttgcccctgccctcaagatatgtggaactttgaacttgagaaagatgatttacagtatctggcggaagaaatttctaagcagcaaagcattcaagacatgacttgggtactgtgagttttataagggaaacagagcataaaagtttggaaaatttgcagcctatgtgatagaaaagaaaaaacccattttctggggagaaattcaaggcagctgcagaaatttgcataagaagcaaggagcctaatgttaatccccaagaccatggggaaaatgtctccaggccatgtcagagaccttcacagcagcccctcccatcacaggcccagaagcccaggaggaaaaagtggttttgtgggcctggcccagggtccctgtgctgtgtgcagcctggggacctggtgccctgcatcccagccactccagccttggctgaaaggggccaacatacagctcaggctgtggctttggaaggtggaagccccaagccttggcagcttccacatgttgttgaacctgagggtgcacagaagtcaagaattgaggtttgggaacccccacctagattttaaaagatgtatggaaaaacctggatgcccaggcaaaagtttgctgcaggggtggggccctcatggagaacctctgctaaggcagtgcagaagggaaatgtggggttggagcccccacacagagtccctactggggcactgcctagtggagctctgagaagagggccaccgtccaccagactccagaatgatagatccactgacagcttgcaccgtgcacctggaagagccacagacactcaacgctagcttgtgaaagcagccaggagggggggctataccctacaaagccacagggttggagcttcccaagaccatgggaacccacctcttggcatcagtgtgacctggatgtgagacctggagtcaaaggagagagatcatttggagctttaaaattggactgccctgctcgatttcagacttgcatgggccctgtgacccctttgttttggccaatttctcccatttggaacagctctatttacccaatacctgtacccccattgtatctaggaagtaactagcttgcttttgattttataggctcataggaggaagggacttgccttgtctcagatgagactttggactgtggacttttaggttaatgctgaaatgaattaagactttgggggactgttgggaaggcatgattggttttgaaatgtgaggacatgagatttggagggaccaggggcagaatgatatggtttggctgtgtccccaccaaaatctcaacttgagttgtatctcccagaattcccacctgttgtaggaggtacccaggaggaagtaattgaatcatgggggccagtctttcctgtgctattctcatgatagtgaatatctcacgagatcttacggttttatcaggggtttctgcttttgcttcttcctcatttttctcttgctgccaccatgtaagaagtggcttttgccttctgccatgattctgaggcctccccagccatgtggaactgtaagtccaattaaacctcttttgcttcctagtcccagtgtgtctttatcagcagcgtgaaaacagactaatacacttggcaattggtatttatttatatgtttcatagatgtttatggttttataaatacatagtgttctctggtttgcaattttcggtgtgcctttgacattttatgttaactatatatccatttcttaagtgaattttgattcatttactcagtaacccagccgtttttacttttatttctttttagaaatctgtatacatccctgagaatactttttatccatgtgtaacagatttcacttaactaatccagtcaggaactcctttttctcccacatgggatgataattaaattcttttatattgggtgttatatttggatcatcttctgtcatcctaatttttattttcattttaatcattcttttgacatctctttccaattataactgcaaaatcctggccattcctcaatgcctaatgctttcttttttgtcccccttattgattacattcttctggtaaccagcctgttcctaccatagtattactgaaccaaattgctcagcaaactctcatctctctatacatctgtttaaacttttaactacttacgtcagtccagcaatttggatcctcttcgtggaaaaacagttgttactctttccttcttaatagttctgtctttgataccaaatgttatatggccctccttgatctgtggtggtattgcttcttatttttcacaataaagtggcccttcccatgagtgcccttggtttatctcttggaattggcatttaaactcagttgctgttggaagtaattccagaagtgaaatttgtcagtgagaggtgtgcactatgaatagttccttcaggtgctggacgcacttaggtccttctgttgcaggtgctgttaaataacagcttttctggacgaagagtaccttgaagtctctctgcttttatttctggggtttgtttatgtcactaaagtctcagatgagagttctgagaaaaggcttgtttgttacgtttctttaaaggtgacctagtatctctttttccttgcattaagaaggcatttcccaagagagggattgatatcttcctctttgacagttctggaagaatgtcatgagcccctttcatctccaaactggattttaaaacaatgtggaaaaactgcttcctcccagggcacatttttctgttacttcttgatttggctttttttttttttttgacatggtgtctcactcttgttgcccaggctggagtgcagtggtgtgatcttggctcactgcaacctccgcctcctgggttcaagcaattctcctgcctcagcctcctgagtagcttggattacaggcagctgccaccacccctggctaatttttgtatttttagtggagatggggtttcaccatgttggctaggctggtcttgaactcctgacctcaggcaatccacctgcctgggcctcccaaagtgctgggattacaggcgtgagccaccgcacctggccttttgattaagcttcacagacacccttcaatatgaagattaggttccttgttgcatacatcatttgctcccctgcattcattgaattctacttgattctctgtaacaagtttcattgatttgatgttttgcagaaccaattctgttttggactgcatttctgggatgttcttaattgtcttatcattttatcctaagcttcttttaaaccccagtgtaaccttgattgattttgaaatgccacctttcatcttttcgggaatgaatgccaagtgttctctgcataacactgtttgaatcttgtagttgttccattttggttaccagagtccagttccggattcattccccttgctggctcctagggcttagagctcctgccacataatgaattttcactgatccttttttttgcaccttgttgttgtttgttttctgtttattgatattcttagtggaggagcctgttttgtcatcttaagtttttaggcagtgttgtcattatcgttgtgttttgaaacggtcttgtattttatgttttttcctgatgtaactgttactctaaaaaatgaagataatttactgaatttctttttatctttattgtattgtgacaataaaattaaaaattctgtcttaaagtagagaggattgtaaatgtacccccacagaccccatctgtcacctggtttttactaatgttcagtttttcaatctttttcgctcccaccccacagacacccttgttcgtcctggagtattttaaagcaaatcccagatactatgtcatgtcacctgtaaatgtcggatattatatcctggggctttgctgatgtttcctcatggaatttaacttgcttctgtagacccttgtatttgctataaactgctggttagaacaagggcagcgttctcaaacattttgggctcaggaacccttcacaatcttacaatttattgaagacccccaaaatgcttgtattgagataggtcatacgtattgatattttgcatattagaaatttaaacagaaaaatttaacacatcaggagagataagcacttcctcccttggccattagagagctgatgtcaggctgaggcaggaggattgcttgaccccaggagtttaacactagcctaggcaatatcatgagaccttgtctccataaataataataataataataaaaaagccaagcgtggtagtgcacacctgtagccccagctacttaggaggctgaggtggtaggattacttgagtccaggaactagagattgcagtgagccaagatcgcaccattgcacttcagcatgggcaacagagcaagaccctgtcacaaacaaacaccaaaacatgaagagagagagagagagatgatgtcgtgatatatcatgcagcttctggaaaactctgctgtacactttgtaaagaatgagagtgaaaagggcaaataagtctttgtactattaagaaagtagttttgattttgtggactttgtgaagtagctctgggggaacgccagaagcctcagaccacactttgagaacccctgatgtggtgactcagatacattcaacttcatctttgcttttggaggggagagggcaagtatacctcctagggggtaatgtgcgcttcttacaacacacacacatatacgtatattatacatatgtaacacacatatacacacacacaaatacacacacatacatatctacacacatacacacagacacacacacacacatatacatatatatacagacatacaaatacacatatatacacacagacacaaacacacacatatacacatatatacacagacacaaatacgcacacatatatacacagacacacaaatgcacatatatacacagagacacacaaatacacatatatacatacacatatatgcacacacacatgtatttttattactatagtagttatataactactttatgtctgggagtacaactttaataccttagtcatttattttctcctttattgttatataatttccatgtgtgtatttgtgtgttaattttccacttaaaaatttttaaaatttgtttttagttttattttgtttgagacagggtcttgccctgttgtttagcctgcagttcagtggtgtgatcttggctcactgcagcctcaaccttctcagctccagtgatcctcccacttcagcctcctgagtagctgggactatgggcgtatgccaccatgcacagctaattttttcgtgttttgttttttttttttttttttttgagatagagttttgccatgtggcccaggctggtcttgaactcccatatgatcgcccaccttggcctcccaaagtgctgggattacaggcatgagccattgtgcccggtgcttttttttctttcttttttttaactttgtatttttggcttcaattttcatttgcgggtatattgttgcacttgcatttgattaacccacttttgtattttagtcctagatgtgtttagttttcatgagccttcagtaatcagcatattgttgcatttgatttaccacagatggagaattttcttctcttaatcagaccaattaggttgcttttatctagggatgtgactgttagatttcaaataccttatatcattctggttttcttttttttgttgttgttcttacctctataagtcatgccctcctttttatttatttttaaagaagtacctaagtcatgtacatagtcgttgttaaaaaaattcaggctgggcatggtggctcacgcctgtaatcccagcactttgggaggctgaggtgggccgatcacaaggtcaggagatcgagaccatcctggctaacacggtgaaaccctgtctccactaaaatgtacaaaaaaaattaactgggcatggtagcaggtgcctgtagtcccagctactcgggaggctgaggcaggagaatggtgtgaactccggaggcggagcttgcaatgagccgagatcgcaccactgcactccagcctgggtgacagagctagactccgtctcaaaaaaaaaaaaattcaataatagggaaatagagtaaagcaatagcccatctccaggctttccagctccatgctaatttgcactgtgggtaatgtatcgtgcaactttcaaaacattttctacacatattggcacacgcagaaataaaataaatgtataagttttatggcttttaaaaatggtaggccgggcgtggtagctcactcctgtaatcccagcagtttgggaggccgaggcggatggatcacttgaggtcaggagttggaggccagcctggccaacatggtgaaaccccgtctctactaaaaattacaaaaattatccggcatggtggtgggtgcctgtaatcccagctacttgagaggttgaggactcttttccctatggtggggcacattagtttcatcttctgttgtgtttttgttctttccttggagttgcttattctggtgcccagggtgcagctctgctctgctctctgctggccccaggacagctgcaaaaccctcctaagaattgcttccactctgctatgtttcgtgtcctgtttccttgagcagcagcatgagttttaaatataactgtagggttttacttgattctaagttcaaagtagtgacacaggggtccccaacccctgggccacaaactggtctgtggcctgttaggaacctggcctcacagcaggaggtgagtggtggcaagcgatcgaagcttcatctgtatttacagctgctccccattgcttgcattaccacctgagctccacctcctgtcaggccagtagcagcattagattctcataggagtgtgaaacctttgtgaactgtgcatgtgagggatctaggatgagtgcttcttatgagaatctaatgtctgatcatctgtcaccgtctcccatcacccccagatgggagacagtgacatctagttgcaggaaaacaagctcaggggtcccactgattctgcataatgttgagtaagtagtaataatagcagtaaagtgcagaataaatgtaatgctcttgaatcatcctgaaaccacccctcccctctagtctgtggacaaattatcttctatgaaacttgtccctggtgccaaaaaggttggggactgctgtagtgacaataactcacatttattgaccaggtactacgtgacagtcacctcagatgtcccatctcatatgatatttgcagcaactctattaggtaaacactatttttgctttcattttacaaattaggtaagtgaagcatagagaggttaaataacttgagggtaattcttccaagggggtggagtcagattcacacccaaacaatctctcctgtctactgcattgtcattaagagtgatgaagagcccaagaaccagcctcattctagcctttaccaatatgtgtatctctttcttatttttggtttactttctcagaatctttggttctagtagatttttaaaattaaacctttgtttcctctgccatctctgttatctctttctggaatgcttctgtgtcaggtgctagatctcagttgatcacttgctttttattctctcactttttttggtcttttaatttaattttctgaaaaatttcttcaatttgatcttccaactcttctggagttttaaattttttgttatatttaatttccaagagcctttcttatttcctgacttttcctttttctaagtatcctgttcttgtttaatgaatatggtatctttccctcgattctctgaggatgataagggggtttcccttgtgttctgcaaggggtctgtctactccttgctccaagtgtattttacctatttgtaggcttttatgtctgtcctcatatttttattttcctcaaatgtctggtgatgctttgttcttttgtatttatgaggaaggcactaatatgtttggtagctttctgtgcattgtggtggtaagaggaagccaatggttctcactggtaggtgctctggcaggtggatggctgttttgctgggtgtatgaaatgaattatgtccctccaaaattcatttgttgagtcctgtgaacctaagttctctgaaaagtaatttggaggaaagagacttcattccagtgaatagtttgcaaacaagggagccacgtctttggtgtaaaacaaaggtgagttccagagaacaaatacgttcagggtttatagcaaaactccctgctgaggttcccaattaagtccatttatgcaaatgaaggatttggacttgcttagttctggttggtcacacagccgaatcatgactggttgatgtggttgaaccctgactggatggagcgggtgagctctgattggttggtttccaagccccaaaccagaagtctctgttagacctttcaaaaggccagttgggaggtgggggaattcttgcttcagtttatcttggcaccaacaacagaaactggtttggcttgattgtagaaagggaggtcctgtgatattttcataacatctttctgagaacacattgtacgtgactttcataacatctttctgagaacacagtgtatgcgactgaaccttcacccagccatgaccacctggttctgctctaactcaccctaaatagccatggggtgtagttcattttatctgtcagcagaggcatacttttatggtcctaacctcaagtatctcggaatgtgtctgtacttggagatagggctttgaaagagaaaatgggagttaaacgaggtcactggggtggcccttaatccaatatgcctggtgtcctcgtaagaaaaggagattaggacacagacacacagggggaagaccatgtgaagacacttggaagatacagccatctacaagccaaggagagacgtctcagaatgaaaccaaccctgctgacagcttggactttcagcctccagaactgtgaaaaaataaatttctggtgttcaatacacccccctctgtattagtttgtaatggcaaactaatatatgaagtgaagcccaaatacccatatctatagatctttcctctagggctattcagttttcctagagaggaaacttctagtattctgctgggagtctaggcctgctgtgtgcatgctgggcgctgagcctcatgaaggagctcaggactctccatctgggatctagactttcatggaactttcctttgctcccattaccccttgcccttttctgtgcctgggaccccagccctggagcccctagtgggaggtactcagctgtctgggtggaattggcacaggggtggactatggaggactaaggggagagcagcattctatccatgttcccacaaaagacaggatctcctttttcatggctgcatagtatttcatggtgtatgtgtaccacattttctttatccaatctgtcattgatgggcatttaggttgattccatgtaaccttatacagaattacagccatgctttttttttttttttttttttttccaaccctacaacttgttcctcacctcccggagcctcctctctggggtcctgggcatgaattaacatctccctccgtagccaattggaattccactcggctgacttctccttcatttcttctttcaaacttctgttcgtgttgcctgtctgcagtctccttttgctttcttgtccttgtaaatccatagattctccctgctatggactgaccataagggactaattgatagtgcagtggtcaggctgatgtcagcatgcttctgcagtggaggaatctgacccagaaactcatctctttgcatctctgcacgctgctgcctttgatgtaagcttcatttttaactttgtgttttgaaatagttttagacttgcaggaaagttgcaaagataatacagagagttccctaatggtaacatcttacgtaactgtggtatgatggtcaaagctcataaattagcattagtacaatactgtcaagtaaactacagaccttatttagatttttttttttttttttttttttgacgaagtctttgtttcctaggctggaatgtggtggcatgatctcagctcactgcaaacttcacttcctgggttcaagcgactctgctgcctcagcctctggatgagctgggattacgggcacccggcaccacgcccggctaattttgattttttagtagagatggggtttcaccatgttggccagactggactcaaactcttgacctcaggtgatcagccagcctcagccttccaaggtgctgggattataggtgtgagccaccactgctggcccttatttagattttaccagatttcccagtaatgtgccttattttctgttcccaaatccaatccagggtcccatattgtagttcattgttagggttccttagtcacttctaatctgagcctcacacacccaggctggagtacagtggctcgatctcggctcactgcaacctctgcctcccaggctcaaatgattctcttgccttggcctcccgagtagctgggattacaggtgtccgcaccacgccaggctaatttttgtatttttagtagagacaaggtttctccatgttgtccaggctggtcttgaactcctgatctcaagcaattaacccgcctctgcctcccaaagtgctgggattataggagttagccatcgtgcccagcacctgaccttcttacttttgaagaggactagtcaggtgttttgtggaatgtttcttcatttgagtttgactggcttttattcatgatttgatttagatttgggggaaggacatcagagaggtgatgtgtccttctaagtgcatcatatgtcttactactggtgacgttgttactgattcttagcttaagatggtttctggccgggtgcagtggctcgcacctgtaatcccaacactttgggagaccaagttgggagggtcacttgaggccaggagttcaaggccagcctggacaacatagccagacccttcctctacaaaaaaccccccaaaattagctggtcaccgtggtattcacttgtagtcccagctactctggaggctgatgggggaccatcacttgagctcagcagtttaaggttgcagtgagctttggtcacaccactgcactccagcctgggcaacagggagagaccacctgtccccctacccccaaaaaagatagtttctttcaggtttttcctgtaaagttacagtggagtgtagaggtttcttcttatgtaattaatatatactcggaggctatgcaaatatctaattttttttctcttaaacttttgccaactatttttagcattcactgatggacgttgctggcagtctaagtggtgcgtttctagctctctcattcctcccacatttattaattgaaattcttctgtaaggaagaattgtcccttctatcccagttatttgtttattcagtcatgtatttatatcagtatggacttatgaatatttattttaacctttaagctatatctaatactatgtttatttctcttcttgctcaaattgttctagctttgaccactgggaactctttcaggttggcttctgtgcccttttgacatgaccccataatcccaacttttttttttcgagcacttaactttttcttttttaaaaaaacttttattttaggttcaggggtacatgtgaaggtttgttacacaggtgaactcatgttacgggggcttgtcgtacagattattccatcacccaggtattaagcctggtacccaatagttaccttgtctgctcctctccttcctcccaccctccaccctccatgctcaagtagccccagtgtgtgttgttccctctttgtgttgatgtgttctcatcatttaacctcccacttattagtgagaacatgtggtatttggatttctcttcctgcattagtttactaaaggataatggccttcagttccatccatatttctgcaaaggacatgatctcattcttttttatggctgcataatattctgtggtatatatataccacattttctttatccaatttgtcattgataggcatttaggttgattccatgtcttgattatttcacttgtattttgatgaggtttcagaaagaagcagagaagcaggtgttcaatacatttttatttttatttttattgttttttatgtctgttgcccaggctggagagcagtggtgcgatctcagctcactgcaacctctgcctcctgggttcaagtgattctcctgccttagcttcctgagtagggtagtcatatgccaccatgcctggctaactttgtatttttagtaaacggagttttgccatgtcggccaggctggtctcaaacctctgacctcaagggatccttcgccttgtcctcccaaagtttcgggattacaggcatgaaccgagcctggcctcaatacattcttcctaaacttttttgatcatcaagattttctttgtttcttatgatgttttccattattttaaatttatattagctgtcatctaaacaaatcatctctgcagtggacatctgtttgagagagtgcttccagttctcatccttccaagaacagtaacctgaatttacttcccatccttacccatgtgtgcttgggggctgatactacatgtaggtgtaaaccacgtggtatatccgtcctggtcaaagccagcaaaccacgagaacaccttttctagggcttttggaaaggggaggtttctcttccttgcaaggaagctgccagaggaactgttctttctttggatggtgatgtgttctgaaacaacatctggagctgctgtagccactggatcactatgagctgaggctggaactgctatgagagccccaggtggagcccagcctgggaggaagaggagttccaaagaatcagcaccttggggttttgtttgagtttctgttgtaggaagcctcacctaaccttttgaatattcaacccatgaaccaaaatactctattgttgaaaccaatctatattggttttcttggcaacttcagtcctaaccagcataaactcattattttattttttttctttttgagacagagtctccctctgccacccaggctggaggggcttgatctctgctcactgcaacctccacctcctgggttcaagtgattctcttgcctcagcctcccgcgtagctgtgactacaggtgcatgccaccacactcagctaatttttgtatttttagtagagatggggtttcgccatgttggccaggctggtcttgaactcctgacctcaagtgatctgcccgcctcagcctcccaaagtgctgggattataggcatgagccaccgcacacagcccatagactcattcttacagaaattgtgcttcactaccttaaattttcaggtagagcatgcactagggattattatatctgagtcgatctgcaaatattttgaagcaaacacatcttattttctgtttccaggctggccagagctttctgctgcataatggcggcagcgattacattgcacgttgcttctttgacatctgagatgtttgaggctggaaactcactgcctcaggccttctgttagtgagaaacgccaattaagttcagtgaataaattgagctgcatgttagctttcagacacagagaagttccgtactgtatctaagaaacttcccgaaatgtcttgttccagtggatgacgtaacttgtcgtttgactaagaaattgcatcttaggaaattatctcaaggaaataagcagacaagtatttatacacaaggaaggtataagccagaggattactgccatgctgtcattccccgggaaaattgggtatagcatttaaatgagcaataatgggcaattgattaagtaaatgatgatacattcatggcctgccatgctatgcagccattaaacaatgatgttgatgtatatttttgacatgaaattatgcttatggtacactattaggttaaaaaaagagacaagttatatcacagtaagtaaagtataattgcattttgtaaaaaattgtgtgtatacatatgcatataaatgagatgtatacatatatatatgcatgtaaaagattagaggatatatcattttgaccttttgatgacttgctgtttttctagatcaaagctatatggtttatgagcaatatattaataaagaattaactatctttaatttgttgagtaaataaactaaaacaagaatgagctatctgacaccagggtccttctttaggaacttcaattttggaacaatgaatgaagtgagtagggcgcttctttaatatctaatcattttgtgaactgttaaggtcttaagtgtctgtggtttggatatgtctcctaccatctgcccttggccttcctggtggttggcctgggaaccccggggtggagacagggcttctgtttggagagcagcagagcaaagttgaacatcaaaagccatgggcctggattctaatttggaaacctcctttttctatcttcgtggtctaggccaactcagtcctctgttccactggggcatgatgaggttggctttcttttttctttttctttgagaccgagtcttgctgtttcacccaggctggagtgcagtggcatgatcaacctctgcctcccggtttcaagtgattctcccacctcagcctccaaagtagctgggattacaggtatgcaccaccatgcccagctaatttttgtatttttagtacagatacggtttcgccatgttggccaggctggtctcgaactcctgacctcaggtgatccaccctcctcggcctcccaaagtgctgggattacagacgtgagcaactacacctggctggccgtctttacttcaaagcagtggagtcacagagccttatacatgaatggaaagtattgccaaaaggctccgtggtccttttgggtctcctttggaaaagaagctgggacatttgctttgccctgcccccttcctatgacagtccgtcccccctctatgtgctgccgtccaaggaaccacacttctttggaacaaagggagctgggcaggatcatctctgtcccctccagcttttgagcccctccttgaaatctgcatttaaagcattcagaagatgctgagcatgatggctcactcctgtaatcccagcactttgggaggccgaggtgggaggatggcttgaacccaggagttcaagaagagcctgggcaagatagggagacaccgtctctacaaaaaaaaaaaaaaaaaaaaaaaaaagcaaaatgcaaaaattagctgggcatggtggtatgtgccagtagtcgcagctacttgggagactgaggcgggagaattgcttgagtgcaggagttcaaggctgcagtgggccatgattgcgcaattgtactccagcctggatgagagagcaagaccctgtctctaaaaaatggaaaaaaaaaaaatcattgagaagagagaacccagaggttgagatgtgctggtccctgggagaactcaggggagatcccagttctctggaggccagccgtccaaaagcatttctcacccattttcctgcatttcatggacacacaatttggatgcctaggggtttttcataagccatgattatgtttttttggcgagagacccctgttatccctcctaccccccttgctagatggcttaatttcgtttgctctcaccatttgatttgatttgatggcatacagcatgaggttcccaaatcatttctgcctgttaagcaaacatatatttctgggattgatgttttaatttaatgaaatacattctaatgagggtcagctgcagccatgaatttttttatgagtgatttgccaaaaaacccattgcctggtgacattctgtgcttggctgagcgagtctgagagagagtcctggttccagctcacgggttgaggaagagacacagggcaagattctgccggtcgtggcatgcctggatttccatgctaggtgctatgtcggtttctctgcttctgtgctggtggctcatcagatgccttcttccctggatatgcataggagtaattcagcccgatagaggaggagacagtggcctgagaggaccccagtttggtgtttgatccagggctcatcttcaggatacagcaaggcagataatgaggagggacttgcttggtgtgtgtgtgtgtctgtgatgtacacgtgtgtgttggaggccagggtgggaaggggcccacacacagcccagctgtctctaaacagcccctgatgtcccagccaagcaggagtacaggatggctggactctgctaaaagctcctaactcaacccagcaaacgttaagtctatgctagtggccatccctggttccatctgggacctgtgagaagtcatggaatcaaccgtccacctccactcagctcaggtgacctggggccaacacagctggtgtcctgtctagaagccattgcccttgaatttgtttcctgtagcccttgtaacaaattgccacaaacttaaggccttcaaacaacagaaatgtatcctcccaattaaggaggccagatgtccaaaatcaataccacggggctgaaatcaaggtgtcagcagggctgcactccctccagaggctctagaagagaatctcttccttgtctcttgcaggttcccgtggctcccaacattccttggcttgtggcggcatcactctataatagggccagcatcttccaatctttctatgctttgtcttcacctcaactcttttctcctgcatgtgtctattgaacttcccctgcctccttataaaaacttgtggttgcattttgggcccctttggataatccaggctaatgtccccatctcaggagccctaacttgatcacatttgcagagaccctgtttccaaataaattaccattcatgggttccagggatcaggacttgctatctttgggtggcagtcgttagccctttttttttccctcctcggcaaagtactgatttgatcctacctggccaatacttatattgcaggctgttcagttcccctatgcctggatcatccagggctggggcttggttctgacccgtgacgtgaaaggcaattcaacagtggccgcctgggatatgcttccttcaccgacagagcagtatgcggaaagagtcctcctgccttttcctctttgccccgggtgctgcattgtgacagcgtgattcttggaggagatatagccattttatgatcatgggtggatggccaagagaatcgtgaaggatgtggcccagcgctcagatggtgctgctgctgcctctgcatctttctggctcaggccactgcgacttgggagttgcagccagaaggctgtcaacggacccaggattcccctgggaggctccttctgccttagcagactggccagcattggcctgagtggctttagcggggacggtgagaccaagatggccccgtctggacccagactcatgttttggagcgtttcctggctctttcgtcagcctcagtccatttggacagctgccagctgcatggtttggtggtggttgtgagcttggctctctgatagccgatgagtctgaagagtaaggccaaagcaaggaaatctacatatgggaggcacatttagggacacttgtgatccatttctattctcactgtgaagaggaatctcccagcagtctccaaacagcccctgatgtcccagttgagcaagggtacagggtggctggactctactaaaggtgcctaactcaacccagcaaacgttaagtctatgctactggccagccctagtcccatctgagacctgtgagaagtcatggaatggaccctccgcctccacctagttcgatgtctgtgacaagctgtgccccaggcagggcacattctcacttgggtcacctccgtggccggaagggtaataatggaaaaaagccaagagcggcagcctgtgtctgtggactgagccagaggccagctgggcctgtttgcttggcttgagctgcagagtggatctcaggcattgcccagcacaggccttggagaaaacatggtgctgagcatgtgttaggcagaggctgcaaggaagagccaaggagaataggcccagtgagtataggggtgagaggatggaggggtttggcctggagaagagaaagcaaagggtgtctctggtataattattgctgctttttctctgtgtgcctcccaactccccatgagacagaatgtcaaatatcaggtaactggttaaaattaaagtggagtactagtatatcatttcagaatactttcagcctcaagaaacagaaagccaactaatagcagattgaataggggtttattttatatacaaccaagaatttgggaaggagctgccattgcatggagtgagaagctaaaggtcaaggcccccctcatgggtgcaaagaggctaccatagctccaggcatgcagcccacgttcaagaaacagggagggaagttggtaccagcatcaggagaacaacagctttctcttcttttccacgcacaccccctcccctgccaccagccgactttccctgtgttcctttggtcagaactctgtcacttggccacccttagctgcagaggaggccggcatggtgagtggttggggactgtggatgaggactggttagatagccagtagtgttggcacagtgccgcttaaggagccttggtgtctgggcacctataggaagagagcagacaaccatcttcattaggagccatggaccctgcccgggaggttaggagggcatccagacccatccctgggtgtgtttttggtttttcagatccccttcgtgagcatgctggggagtccgccttggttttccaaagatagagcacatgagacagtggttttcaaagtgtgtgccccaaaccaacgtcgtcaagatcacctgggaatgtgttagagttgtaaagtcttgggccccaccgcagactcattgaatcagaaactgtagcgtgaggaccagctctctgtgtctgaacaagccctctgggtaatactgatgcaggaacaaatttgagaaccttagacttaggatttctgaaatatgactatctctggggagggaagggaaagaaaaggaatagtaagaaattcattcacatttgtaaattattcctctttttcttaaggtgatctaagctttaaattcactttccccattagtaataatcagtgaaattcatgagggaatttcatctgtccatggttcatgttggactgaaggatatttttgctgttttttttttttttccagtagaccctgggatggttgaccttagacttgaatcttttgggagcttgtttacaatgcagatttctgagctggtatctgggttttcccccagatatttggatttagtagatataggatgggctcaggaatctgcaacatggcaggcgatttggatacaggtaatctgcaaactgcacctggagaagtgcaagtccagagcttgctatggaagagagggtggatggaaagatgggtgttttagtcggcttgggctgctgtaatgaaataccatagactgagtggcttaaacgacagacatctttttcccccatgattctgaaggctgaaaagacaaagatcagggtgccagcatggtcagatactggtgagggctctcttcctggtttgcagttggttaccttctcattgtgtcctcacatgacagatagagcaaggagagaagaaaggagagagaaaagagaagaggggagtgggggagggagagagagagggagggagagggagagagagagagagggagagggagagagagagcgctttctagtctcttctttctcttcttataagggcactaatcccattatgagggccccaccctcatgacaccatctaaacctaattacctcccaaaggccccaccttcaaataccatgacattgcagggatataggttcagcatgaaatttaggggaggcacaggcattaagtccataacattggggaagtaggttctcagtggctcctctcccttgggttatatgagggtctttagtagcttcagaattccctgagttgtattcagagtcaccatttgctttggagaattctaggattgctacatagaccagcgaacatggggagattcagggagtgtgagcaaatattgagaaagagagtttgggatgtaaggtcatgagtcataaagtgtgtggatgcgcagtccttctctctgaggggatctgccaaatccctgaggcctacacatttctgtccttagatttcttgttctttctttctgtaattactgcccaccactgcccccaccccaccatctcatttgtgcaggggtgaaagattgaacaccttttgggagccttggtggtcagggtcagtgggggtggtgcagccttgcagaacatgctctactgccactgaccattccagggttacttgtattttagccaaagcagtggggagtaggggggagtcacagatatagggcataggaaagcaggagttagggactaggggggatttaataagtgattggaagtgatgcagggcaggtgagccctaaaattggggcttaacctgggaaggtttttggctttgctcaggaaagaattcaagagtgagccagtagtagaagaaaccagctttatggaggcattagtgttacagctctgtgactgctcctgcagagcagggctgccccataggcagtgtgtggagtgcagccgctcagggtccgtgctgcagttctatttatacccacttttaattacacgcaaattaaggggtgggttatgcagaaatttctagatgaggggtggtaacttctgggtgtggccatggcagtggtgggctgtcatggtgctgatgggtgtatgttatggagaggtgcttttggtgcctcttccgtaatttagccagttaccaatctcgtccaaagtccagtcccatctcctatctcagaagtagcatacatttccacagtgagttccaagttcacacatattgtctcctttaatcctctcaacaaccctgtgaagtaggttctactccctgcattacagagggggaaactgaggtccagagagctgaagaagggcttcttcaccaacccggaagaaagccatttgaaatattcccgtgttcggctgctaaccctggtggctctctgccccacactcctgttcctccatctttctcacaccttcctttccaagtgtggagtctatgagttattgagctgacaagcctggggcagtgtcaggggtaagagccaatccctaccttgtggcttttgtcccatgttcacaggactagggtgaggtgttggagggagagaggatggcgagggagctgggcagtccctggatgagcgcatcctccatcagcatcgtgtcttctgttctgaaggctcccaagacagtacctctgtgagggactcatatcagctgaaagttaccttcaacagaagtagaccttagaaggccaatgaattaaattgcaaagagagatagaactgctccagagcctagcatattctcattggcatgatctgtgcaagagttccctgttggccatatgggaagccaggatgatcagaaggttgctctgggagcctatattcaggacaaggggagccggatgaatccagcctgtgatggcaagagtctgggatggtgggtgcatctctactgcctgatggtaggggtggccttgcctttggggctctcattctctggttctgtgctgacccacagcccttgggagcacacatgtattagtccattctcacattgctgtaaagaactacctgggactgggtaattcataaagaaaacaggtttcattgactcacagttccacaggttgtacaggaagcatgacttgggaggcctcaggaaaatcatggtggaaggcaaaggggaagcaggcacgtctcacatggccagagaaggagaaagtggtcaaagagggaggtgccacacacttttaaacaatcagatctcatgagaactcactatcatgagaacagcaagggggaaatctgcccccgtgatccagtcacctcccaccaggtccctctttcaatactggagattacaacttgacgtgagatttgggtgggacacacatccaaacccaaaccatatcaacacacttcttgctttgggtggtttagcacaaccaaccaggctacaatcggagagctatcctgtcacttttaggtagtttgcatgatcagtttctgagctatctgtaaggacattgcatttaattttataagtttatttatttatttgagtcagagtctcactctgtcgcccaggctggagtgcagtggcgcaatctcggctcactgctacctctgcctcccaggttcaagctattcttgtggctcagcctcccaagtagctagattacaggcatctgccaccacacccagctaattttttgtatttttagtagagagacagggtttcactgtgttgcccaggctggtcttgaactgctgagctcaggtgatcagcccacttcggcctcccaaagtgttaagattagagatgtgagccaccgctcccgacccattgcatttaaccttgaagtacaaaccaaggaggagggaaggggtagggtgaatggagggaaactaaactgcacccactacaaactgagctgcctgtcctggaacagagcttgctttcatccgtggtcataatgaaccatgttgacatggaactttctagcaagataaaccacagtgctgaaccagatgcgttatttccactgttcaagcaggtttccatattagggatgctgactcctgaatttggggactggagatttgttctgtgttgccaggtggcctgggtgtctaagtgcctttttgtaccttgtctcctcctgcatagtgactgttgggtctcctgcctatgcagaggacgctggaggtttgattttgatcttaaggataaaaagttcggtctgttcagcggggcgcggtggctcatgcctgtaatcctagcactttgggaggctgaggcgggcagattgcctgagctcaggagtttgagaccagcctgggcaacacagtgaaactctgtctctactaaaatacaaaaaatcagctgggtgtggcatcgtgcgcctgtagtcccagctactcgggaggctgaggcaggagaatcacttgaacccgggaggcagaggttgcagtgagccaagattgcgccattgcactccagcctgggtgacagagcaacactccatctcggaaaaaaaaaaaaaaaatttggtctgttcgttttaggtgttgcccgtggttgagaatcagaccctctgcccagggtttgtgactttattgcacagaaggctgcatcacccgcaaccgtcatcttaatactgccaccgaatttcattttgctgtttttgtttgcgaaggacctggagtgactcggatagaattactgctggaataaatgacgtatgaaatgagaaatctttgtccagtgttgcaagggggagggagagaagaaaagaaaggctttgatggaaccgctgttgtacagaattagtttccataagaccagaaaatacagaagaacaaaataaaacgtcatcagatatttttctccagatttactgaaaagtcaggcttttatcaatctcccagcaccgcattcaggctcccagtgatggaaagtaatgggtcttgcaccaaacgaaagcaaacttctatttagtctagcctgtggcctgggttcccccagctccagcaccgggaagcatgaggaagggggtgcccttctcctcaagctccactccttcttcatggggacaagctccactccttcttccttccatctggttcccagtgtccttggatttgcatctcctgtgccatttaaaagtctgctcttggtcaggcacagtggcttacgcctttaatcccagcactttggcatgctgaggcgggtggatcacctgaggtcaggagttcgagaccaggctaaccaacatggtagaaaccctgtctctgttaaaaacacaaaaattagccgggcgtggtggcaggcacctgtaatcccagctacttgggaggctaaagcaggagaattgcttgaacccaggaggtggaggttgcagtgagctgagatcgcgccactgcacttcagcctgggtagacagagtgagactctgtctcaaaaaaattaaataaaaaaaaaaataaaaatctactctcttaggaaaagagctgacaaactcacttacactgaggtgtaaggggcggctgagggcttcattgctaccctatctcagggtattttaattttcaatggtgtaaaactgagctccaaagaccaaactgaaacttgctgcaccagaaagcaaactgctttgtcaaggccactggctgtaggtttcagcaataccattgtcctcacagcctcactgttggacgggcctagtctcctgcttagggcgtttttctccagggctctgcaaactacacatcctgggtgcctgcataattggctgcctataggggtgccttgttatctttttctataagatggggaatacattgctttgccttagacttgctgtcatctgtcccacctgggagggacgggctggtgttccctctgctgccaaacactcctggatcgcaggatgcaacctccaggctgtgtgctgatgcaaccgaacaatagcaacaagaaccagaaacatggaatccaggccagccctcggcgggggcacctgcccttgacctccctcgcagcacttctgcggggtgtttacaaaaactgcacctgctctaatagctgatggtcgtgctgggagaaaataataatctaagccattagagagagagaagaaaagaaagccaggacggggaagggaatgatccatcctctgctctatttttgtctgtgctccacgctcactgagtgtccttgagggagatgcctaagttctttgtcttggtttgttactgccctggcaaaatctcatgcatcgcctgccagaacacccagggaatctcgtggctccctgacaatgcacaaacacgctgccacattcttttttgggggtccagagagtgggaggtagggtcaaaaaccacgggagtggaactgaaatacccccattcatccaatcataggcagatcgcctccttctttaaattgcctttgaaaaatagctttattgtctccgtatgtaatgcaagtaggcattcccccggcaagttcgggggagtagctgacatttgttgactgtttactgtaggtgtgaactttatatgcaccatttcacttgatccccattttcaagatgagagaattggggctcagaggggtgtagtcatttgcctgggacggaacaggaagatgtctggaataagggccagccctgggtagatgtggtggctcatgcttgtaatcccagcgctttgggaggccaaggcagatcgcttgaggccaggagtctgagaccaacttggccaacatagtaagatcccatctctgaaaaaaaaaaaaaaaaaaaaagaaaaaacagggcataattgtgtacgcctgtagtcccagctactcaggaggctgacatgggaggactgcttgagcccaggagcttgaggctactgcgagttataatcaggctatggcactccagcatgggtgacagagtgataccctttctcaaaaaccaaacaaacaaacaagtaaacggaaaatagccagccccagcacagagcttagcacacagccaggggcttaataaataattagtggctaaataagagttttggaactttttggggatgttttcccatcaccccactgcctcttaatgcctcagtttactcacttttcaaataggagtgtggactggtggactagatctttgtgtgtgatggggatgcgttagggggcacccgtttctatccttgctgagtttgaaatcacttgagaaataaacacgggaatctgaccaatggagtgaaaaatatccactttatttattgagagaagctgtgcttaagggcgtggcttagatccatggccacagtgagtctcccactaatccactccactatttaatgtattcagcaaacagagccagagctgggcagctcccctgtggcacagagcacattccataaggcagagggcagagcagccacactctctctctgagcaggcagaactgtaggagagagccccagaggaactgagccaagagcagttactttcttttgcagtatttcaggcatggaggggactctggttccagggtgggaggcagggaaggtgaggggttgggaaagaggtctctcccagaagcctttcacatttgcatctagctgcattcggaatttatttatttatttagagagacatggtctcactctgtctcccaggctggagtgcagtggtgtgaccataactcactgcacccttcaacttatgggctcaagtgatcctcctgcctcagcctcccaaagtgttggggttacaggcatgagccatcaccccactgcacctggtctgtgttcagtatttattataaatgatgggctaaatattgaaaggtggggaaatgaaggtctcgccagccctgtgaatgactgggattctgtgtgtgttctggcttccaagtgggataatgaaatggtgcctctctctgtgtgcggttaaacacccattcataccacaaggaggttgtagtcagcagcctgtctggtggccccgtgggggtctccagcatttatacccttgttaatcctctcccctggaatgtgggtgggacctattgactcattctaataactacaatgcagcagagaccatgtgtgccacttctgaaattaggttataataagactgtggcttctatcttagggtgtgccctctctccgtctctcatgtcactcacctgggagaactcagctgccacaccgtgaggtccccttgtagataagccacatggcaagggcttgaggcctgtcagcaaccgtgtgagtgaatctggaggagaattcccccttgtccccagtcaagcctagagatgagcctgcagccccagccgacagtcccattgcaatctaatgagacaccttgagtcagaggcaccaagctatgctatgcccaaatttcccacccatagaaactctgggatagtaaatattgtttgggctgggcacagtggctcatgcctataattccaatgctttgggaggctgaggtgggaggattacttagggccaggagttcaagaccagccttggcaacatggtgagaccctgtctgtacccccccccaaaaaaaaataaataaaaattagctgggcatggtggtacatgcctgtagtcccagctacctggggactgaggcaaaaggatcacttgagcccaggaattcaaggctgcagtgagctatgattgtgctactgcaccccagcctagacaacagagagacaccctgtcttgaaaaagaaataaataaatgaaataaaaaaatactgtgttcatgactcagttggggtaatttgttatgcagcaagagagatctaatgtcaaagccctttctcttttcttctgagaggttcctgcatgacagcagtatctagaagggccagtgatgctttaaccccaaggcttctgatttcacgaagcagggctggatctctgaaacggcacagctgagcagagcttgggattgtttttcactccaggccccaaagtagggacacagacaagctgggacatgtgacgaggctctggaaaacaggtttaaaaataactttactagctcacactctgaaatttaagccatccatttaggaaatgctgagtgtggctagaaaaatgagttttacattgttattcttcaagaataaagtgataagtgacttcagagtaaggggaagtggttgtttgcagagcttattaaaaataagctgtcatttctgtcctatattacatttgagtcactgggagttaaaactcagttttcttacatttgggtgttttaagagactttggacatattgaaataaaagaatgcctcacagttacacagaagtgacatttcccacgttttcccttagagggtggaacgttaaaagcttgcctaactcttttggatccttacctagtagctacttcacagcctggggagaagacagaagtagacagagatgcatgcctgtctcagccgagaccggagaattgtcaattgtatttagatgagatataatctcagatatcaaatgtattttttcgttgtttttaatttcagtttttattttggattcaaggggtacatgtgcaggtttgttacaacggtttattgcatgatgctgaggtttgggcttcaggtgaactcatcacctaggtagcacagtatccagtaggtagtttttcaacactcacttcccttcttgtctccctctatttggagtccccagtgtctgttgttctcacctgttaagtccataggtacccattgtttagatcccacttataagtgagaacatgcagtatttggttttctgtgtctgcattaattctcttaagataatggcctccagctgcatccaggttgccgcaaaggccatggttttgttcttttttatgcctgtctagtattccatggcgtatacgtaccatattttcttttttctttttttccttttttttgagatggagtctcgctgtcgcccaggctggagtgcagtggtgcgatctcggctcactgcaggctccgccccccgggttcacgccattctcctgcctcagcctcccgagttgctgggactacaggcgcccgccacctcgcctggctaattttttgtatttttagtagagacggagtttcaccgtgttagccaggatggtctcgatctcctgacctcgtgatccgcctgcctcttcctcccaaagtgctgggattacaggtgtgagccactcgtactacattttctttatccagtccactgttgatgggcacctaggttgattccatgtctttgatattgggaatggaaatggcagcattttggggatcagatagttctgttgctctggctctgagcttgctgtgtttatgatgatgttctctgtaagttctttgaaagtggcttgttttgccatcatacttggaatattctaaagttaaaaattttcaaggagacgaatgcccttggattacttgatacctttctcactctttctctcctccctggtttggcggatctggtaagggccctgatggtagagttgtttgggtaagtaagctccctggggataaacatcaacttctgttgtatccttccccctttgtgaaaaagattgctgtttgtccacttcaccctccctagagataggctttttagctggacatgtggccacccagagaagaatgatacttcccagcttctcttgcattgtggtcgcctggaggtgagtagatcctttcctctaaggagatataaaccaaagaacagggatgtgaaccaaagtgccacgttccatttccaattttgctcttaaaggcaaggagcatgctttactcttccctttcctcttagtctgtttgtgttgccataaaggaatacctgaggctgggtgcagtgtctcatgcctgtaatcccagcattttgagaggctgaggcaggaggattgcttgaagccaggagttcccaaccagcttggacaacatagggagaccttgtctgtacaaaaaatttaaaaaattagccaggtatggtgatgtgaacctgtagtcccagcagcttgggaggctgaggcaggaggattgcttgagcccaggagttctaggctgcagtgagccatgatcacgcccctgcacccctgcctaggtgacaggatgagaccttatcccaaaaaaaagaatacccgagggttggtaatttacaaagcaaagaggcttatttggctcatggttctgcagattgtacaagaagcatggtgccagcatctgcttgtggtgaggacctcaggaaacttccactcatggctgaagaggaagggcagcctgcatgtcacatgttgagagggagcaagagagagagagaaggtggtgccagacccttttaaacaaccagctttcttgtgaactagtggagcaagaacttgctcaattcaatgaggagggcaccaagccattcatgagggatctgtctccaaaacccaaacaccttccacttggcccacctctgccattagggatcacatttctttttttttttttttctttttctttttctttttttttttttttgagacagagtctcactctgtcgcccaggctggagtgcagtggcgccatctcagctcactgcaaactccgcctcctgggttcacgcattctcctgcttcagcctcccgagtagctgggactacaggcgcctaccaccacgcccggctaattttttgtatttttagtagagacagggtttcaccatgttagccaggatggtctcgatctcctgacctcgtgatccgccctcctcagcctcccaaagtgctgggattacaggtgtgagccaccgcgcctggtcagggatcacatttcaacatggagatttggaggggatgaacgtccaaactgattcacctcctatctgccacaggctggaatgcagatgtagttttgagtcaacttggactacaaggaagagggcaacatttagggatagtggggaggaacttacagcctgggcccctgaggactttgctgtgcaagactgccatcttccctggtaaagctggtgtcattttaggtctctgtcacaaacagcagaactgatatgctaactcacatccttttatgtctcccagggtgcccattactgggcctactatagaagacactcaatgttcattgcaggtgtactttacctttctgtggtttacagctagttaggccattagaatcttagagttgggaagaatattctagataacctatctggtccactgatatgatttggctctgtgtccccacccaaatctcatcttgaattgtaatctccctaatccctacatgttgagggagggtccaggtgggaggtgattggatcctgggggtggtttcctcaaggctgttcttgtgatagtgagtgatttctcacgagatctgatggttttacaaggcagttttctctgatctttcttgtcctctcttgctgccaccatgtgagacgtgcttcttccccatctgtcatgattgtaagtttcctgaggcctccccagccatgtggagctgtgagtcaattaaatctcttttctctataaattacctcttttctttataattaaacctcttttctttataaattacccagtctcagatatgtctttatggcagtgcgaaaatagactaatacatctactcttcaatgatttcagtgtctgctcatcattcttgtctaatataattccggcttgctttatgatgtataacatgttgggcgaccttaattctactaaaggtttcttttccacaagcagaaatatgcaatccttcaacttcctttgctattgtttctcttttcttttcttgtcttttcttttcttattgagatggggtcttgctaagttgcccaggctggactcaaactcctgagttcaagtgacccccccatcttggcctccagagtagctgggactacaggtgggtgctgctgcatccagccctttaacttccttcgatcttgttcttattttcctttttgagacctcataaaacagcacatttgggggcagatagtatgaggaatgagaaaaaacaacggccaaacttgtgcaaaaatgaaaaatgtctgttcataaaaggactgaaacaagtctattgaatttggccatgatgaggtcatgatgtcgttggcaggatcaagagtttgtggaagccagattgaagtggggtggggtgtgaaatgagaaaatgggaaaatggaaccgatgtggatgactatgccaagaaattggattgagaactggggaaagggagatggaggtgcagggttagaggtggcgttttctgtgcctgtgtttaggaagggagtgactagagcagtttagcagttaagaagagagtgtggatacagaactgctccagcatccgcctgctgctactgcatgcccagctctgctccgtccagatcctgcctggctgcacaggcacctcctgaactcttctagttcaatgcatccttcttggctcccacttgctcattctctctgggtctgctgtcatcagggagaatgcttgccaaggtcattaagggttgattgacactaagacatttcagtaattcctggcatttggagttctgacacctaacactgtagcgtttggtttcacggctcttttattttctgggagcattccagtaagagagaagagagcctgatggtcaggagctgagtctttggagacacacagatctgagtttgaacctcaactctgccctttattagttgtgtgaccttgagcaagtcatcccactcctttatccccatctgtaaataaaatgagataataaaaatgccaaccccttaggcttatggtgaggaatgaagagagattacgtgacaactttgtggaaatgaagattttagaatgaaggcagagactgggatccctcccattcccaatacttggattaaaagttgcccaggtgcggtggctcatgcttgcaacactgaggtggaaggatcatttaaggccaggaactggagaccagcctgggcaacatagtgagaccttatctctacaaaaaaatttaaaaattaactgggcatggtggtgcacacctgtagttctagttgcttgggaggccaagacgggaggatcacttgagcccaggggttcaaggctgcattgagctatcatggcaccactgcactccagcctgggatacagagcgagaccctatctccagaaaaaaaaaaatcaaccaaaaaaaacctctgtcttttgggaaggacccctaggaagaaatggatgtttctcaggaaaagcaattaatcgatgtcacctagccccactctaggaccttccaaatgcctcttggtatctgtgttcttttcttggctcctggataataagtggttgaaataattacgttctaagtctttggcacccatctgccctcgtcctccatccactcgcttggtggagcctttgtcattgtcgacaataatatgactgaagtctgtgggcttttctaaccccacacatgatctataccaagtgggaagattctgtgggggccgtgctaagagagtgtgctaaaaagagagactattttaaaaaaccatcctaattttgtgaggcagaatgttgttgccatttttactttgtgctgcctgtcatccacgggtgtaaagaagggcacaggtatggagtagtctatgctcatggtgacattccaggcacatttgttgtccttgggatgtttggaaaagggggaggcaggtggaaaatttggccatgtctggccaaatctaggtgaaaaaataatgctttgctgtgaaagagtggagacttgggagcaatctctgggcgtatgtgcaacctctagttctgggtctctgaaggttaacgccctgtggacactggggactgaactggtttagatttttctgtctctttaatgggcaaaggctagagataatgaaggtgagttctgtgtgtaaattagtatttcaaattagcttctggaggtggaaaattcttttaaagaggagcacagagatcactcagtaaaaacaggagaaatcaataggggaagactggtgtgaattgggaaaggtctgcagagagcaagagagcaggttttttttttttttttgcaaaggtatctttgcactcctaccctgtataagtgagattttgcctggaccccatagctggtggccttgtaaaatcagaatcacacctttggaaagccatttggaagtacatactccgagccataaaaatatttcatacctctgaactagtaatcttccttctgggaatttatgctagggaaatcaatcataaagggggaaaagtgccacatgcatgaaaatgctgatggcctcatagcttttttcgttgttttttttttttttttttttttttgagacagaggcttgctctgtcacttaggctggagtgcaatggcgcgatctctgctcactgcaacctccacctcctggactcaagcagttctcctgcatcagcctcctaagtagctgggattacaggcacccacccaccactcctggctaatttttgtattcttagtagagatgggatttcaccatgttggccaggctggtttcaaactcctgacctcaaatgatctgcctgccttggtcttccaaaatgctgggattacaggtgtgagccaccacgcctggcccctcattgcttttaatattaagaatttggaagccacctaaaagactaataggaatggaatggtcatttaaattatggtatatttaatcaatagactgctatacattcattaagattatacttatgaggccaggcgtggtggctcacgcctctaatcccagcactttgggaggccgaggagggcggatcacgaggtcaggagatcgagaccatcctggctaacacggtgaaaccccatctctactaaaaatacaaaaaattagccgggcatgtggcgggcgcctgtagtcccagctacttgggaggctgaggcaggagaatggggtgaactcaggaggcagagcttgcagtgagctgagaacgcgccactgcattccagcctgggcgacagagcgagactccgtctcaaaaaaaaaaagagattataattatgaataccctttagaagcttgcatctgtctgaaataagtactttttatgatataagcataatgtaaatacttgtctgtacaattgactttttggggggaggggggaggggcaaggttttgccatgttgcccaggctggtcttgaactcctgggctcaagtgatctacttgcctcagcctcccaaagtgctaggattagaggcatgagccaccacgcccagcctattactgcttttcctctgctgggtttgtgtttggtttgttcttatttctctagttccttgaagtgtgagcttagattgtgtatttgtgctctttcagacttttttaaatgtttatgtttttatttgtgttagtatttatcttgaagaagagtgaaaacataattaaagaagtactggagaatgttttaaaatagtaccatcatagacaaaaatactaacctcgttatagctttggggatagatggggaaaacatgagaaaaattttttgatggctacaattgtctcttgaacgatgcaggggttagaggtgcttacctccttggcagttgaaagtccacaaataacttcaggctcctagaaacttcactactaatagtctactttttttttcttttttgagatggagtctttttctgtcgctcccactgacagtgcagtggcgcaatctcggctcactgcaacctctgcctcctgggttcaagctattttcctgcctcagcctcccgagcagctgggattacaggcatgcgccatcgtgtctgggtgatttttgtatttttagtagagatggggttttgccacattggccaggttggtctcgaactcctgacctcaggtgatccacccacctcagcctcccaaagtgctgcgattacaggcatgagccactgcacctggccaaagagtctactgttgaccagaagtctaaccagtaacataaagtccatcaacacatactatgtatgtcatatgtattgtatatcatattcttacaataaaggcgagctagagaaaagaaaatgtttttaagaaaatcgtaaggaagaagaaaatctatttactgttcgttaagtggaagtggattgtcataaagttttcatcttcatcgccttcacattgagtaggctgaggaggagaaagaagagaggttggtgtattagtctgttctcacactgctataaaggaagacccaagactgggtaatttataaaggaaagaggtttaattgactcacagctccgcatgtctggggaggcctcaggaaacttacaatcatggtggaaggtgaaggagaagcaagtatcttcttcacaaggtggcagaaaagacagagagagagagagcacaggaaactacacttataaaaccatgagatctcgtgagaactcactgtcgtgagaacagcatagaggaaactcccatgatccagtcgctttccactaggtccccccctcaacacgtgggtattacaatttgagatgagatttgggtggggacacagagccaaaccgtatcagttggtcttgccgtctcaggggtggtcaaggcagaagaaaatccatgtataagtggacccatgtaattcaaacctgtgttattaagggtcaactgtactgcgacttatatataaaataaagacagaaacatacagataggacctgaaaggaacatacagaaaatgagaacagttgatgtgttcatgtggtgaaaataggaatgatcattttccttgttttttttcagatcacttcattacaattgcagtgttcctttaagtcagatcctagctttgtcaatgaatggcttcagctttgtcatctgtgaaatgggtgtaataataatagtttgtaatactagcaactcatttccccccatgcttctttgttcttagcctttctatacatcagctcattcggtcttccccacccacctataaggtcggtatctacagacaggcaagggaacgtggaggacttgtcatagtcactcagagcaaatctgggcttccagatccacctacttttaccgtaaaggtgacagccttaaccacctctttgtaccatcttcttgcctcttctctactgaatctttctagatatgttgtaagaaatagaggtgatgttatgctccctttgggcctggcatttaggagaaattcagtcaacagtagctggtaatcaccattgtcattataatgtttgtataataaagcaataagaagaaaataacaaaaagtagagtcagtatcttgaagttcatgtatatggtgagcaaaactcacagccaatattttcaggcacatgcattcttaaggttcatctttacataacagcatctgtttcagatttcctttcttacgtgggttaaatatacctcctgcaaggatgtttataatgtcttacctctttttagcactttgtccttctttcaaagcatattcatatttatttttttctctcgttaattttgggagacatgtcagtggtccccccattttacagatctgtgatctctcaccttttttggattgcatacccctattggtgaaaatttttgagcacatacctccaatacctgcatatatgtttaattataaattatatgtgtggattgctgacagattgtatttaaaagcatgagatgatgaagatgaaataagcaatgcttcaaatttattttccaatatggtttatttaatagcataggaaaccttttttcctctcattaaaatatcattactggctgtattttccatggcagccatcttagtagatctgtttttgttattttcaaaatcatgatttaatactttgtgatagagtaattcacaggtctggttttaattcacttatttttggtttcaatactggaaaagataccccccaaaagagatgtagatccaagtagaagaaattcatagttggtggtgcttaataaattatgatactcgcttcgcgaagccatccatgtattatgcaaaagtttttgttgaaattcagctagtaaatttccatttctcatgatgccagtcagttgctcttgcaaactaactgaaaggtgatgcatttcaatatttttaacaaatgggcccaaaacctgctgaaactcttcatatggaaggcgtttaaaagcctagaaaatctgtttccaagtttttcaagtgtgaacatatgagtttttataaattaaattatagcattttcagccacaaatcattaatcatagaaacatttccaaacatccatttcaaaatgactctctagtagtacaagtattcttttttattggaaagcattagtttctcattcatcgtttaaatgtcatctttaccttgaggtaacaaattaagtacgtttattttttctgaaaatatttatggatgccataggctcttgagggatatctgtcatccaagaataggccattatattttgaacttaaaaaataatgtataatttattattaatttacagcccttcttaagttttttgacacaagataaccagcaaacttctgggtatttccaggggatttaggtcactgcctattttactaaaggagttttttgacagtatggctatattttaaatatctgtgtttttacgattgatatcctggaggctttcgtgccctttgctgtagtaacttgctaggaatatagagtgaatgaaattagctgtgcacctgtctctgtaagctcgccccaaaacccttcttttatttcagtcaaagcatccattccatcaggaggcaccctagacgtttttcccctcgaacaaggttttcacgtaagaactcatttagttcagaatataaatttaccgtagtgacaaaaactgcaattacttttgcaccaacccgatcattgactcacaaaagtggtattttgtatgtgttgtaacagagactgaatctagcaagtatcacaggctgaaacgtgggaaaaacccttttccctgagcacagcaaacctgccttctgtgtgcgcctttcttaagtttctgtcttcaagttgtcaccagtgttttcaatacattttccaaaagtatttgctgacaaagaaatgcatttagtttattgccagattatgtttttgtgtaatagtcctgctatcttggctgtaggtgaaagcataagcatttccccaacatgacttcttatttatttattttttgttatactttaagttctagggtacatgtgcacaacgtgcaggtttgtacatatgtatacattcgccatgttggtgtgctgcacccattaactcatcatttacgttacgtatatctcctaatgctatccctcccccctcccccttttgctattgggtggagaactctgaaagagaatcacaatgcttattgtttagtttgggggaaatttggaaggtcctgggattgtgtctagtagggtgttaaatatcattgaaaatattacagatacttgccttctatttctgtatggttcattttaaaatgtcattcaaaagcatgatatattcttaaggtaagaattagtgttactggcagtgggtctgcatccatatttcaatacctttctccttttcttttgagacaaggtccatgctgttgcccaggctggagtgcagtggcactatcataattcattgcagccttgaactcctgggttcaagcagtcttcccacctgagcttcccaagtagctaggactataggtgtgcaccactgcacctagctaatttaaaaatttttttcgtagagatggggtctcactgtgttgcccaggctggtctcaaactcctggcctcaagtgatcctctcttcccggagtgctgagattacaggcatgagccaccacaactgacctcgatattcttcttgataattccttttggacctatatcggattgtcagtcttttaatctcagatagtggctccagacaagctcccaacaggcagaaaagcgtcagctctgccctgtgaggttgcagcttgtgtttaccttacgactgtcacccccagggcacatgctgtgtgcacaaatctttatgtctcttacctgttttatgaggacttgtttggttaaagctgaaccataagatctgtacagtcactacctgggcatgtgtaaactgcacattcagcctcgggctgtgatccaaccctggaagaaggtgcccctgctgcctcctccgggactcactcagggagcaaattgtccttccgacatgggacatcacccccaaaagaggatgtcaccaccagggcatgtgtttattgtggttatacccgatatcctttttttgttttcagatcaataagcattgctataacagaagttttattataggcttgcaaccttttatctgcgatcctgaaactcaaaaaaaaaaaaaaaaaagatgaggccgggtgcagtggctcatgcctgtaatcccagcactttgtgaggctgaggcaggcggatcacaaggacaggagtttgagaccagcctggccaacatgatgaaaccctgtctctactaaaaatataaaaattacctgggcacggtggcacgtgcctgtagtcccagctactcgggaggctgaggcaggagaatctcttgaacatgagaggcggaggctgcagtgagccaagattgtaccactgcaccccactgggctacagagtgagagtctgtgtcaaaaaaaggtggtaaaacctaactgtaatgggatataaggctatttatgacgtttacttgtctcatttaatgtgactgtgcacacatttcatttcaggaatattgacatgttaagttgggatgctgacccagacccattagagagtgttagatcatacatatatgtgtgaaaggaaaatacaaccttggagccctcaacttactctgccaaaggggaaagtcaagctgggaacagtcatgcaaaccggcttcccattttgttcctaaattcataactgcaaagataaaaggctgcatacctccctcacgatttattcatgaggaaattctttgtgggctccaatatcttttaccctaaagcagttctattgagtttcaccctgacaatgtaaattaacagtttatcttcacaggtatgggacaaaggacagatttgaaatcatccctccactcatctgagccatatgcctgtctgactgcatcctctatgtttattaaaaatgctctgtgtgcaagacaacttgaaattgactattcttctgccctctgctttcccatgtaaaatgcagattcagtgaccactgatcaaagcctcaaatgaatgcaaccacgtacctcttttatctacttcattagtttgttttcatgctgttgataaagacatacccaagactgggtaacttacaaagaaaaagaggtttaatggactcacagttccccgtggctggggaggccttacaatcatggcggaaggcaaaaggcacatcttacatgacaagagagaataagagccaattagaaggggaaaccccttataaaaccatcagatctcatgaggcttattcactaccatgagaacagtatggggggaactgcccccatgattcgatgatctcccacgggatccctcctacaacacatgggaattatgggagctagaattcacaatgagatttgggtggggacacagccaaaccatattacctactcttcctttttttttttttttccttcgtctcttccttactgcctactcttttctctttaaatatagacgtccccaaactctctttggaaaaaccatgaatcactgatatttcctgtggttttgtgttcctttttcctgagcacatcctaaaccttggccaaataaatctctaaaataactgagactcgagtcagtcattttctttggcttacataggtacaggtaagaatttctacagctcccaaagaactctgattctaaaaaatttctacagctccccaaattctgattctaaaacccagtgtgcccaaggttttggatacaggaccgtgaccctttccacagtaccatgaattgttctggcattccccagggcgagttgttgagggaaagagtcaaattctgtaagatatttgaagagatttgttctgagtcaaatgagaggaccatgactcttgacacagtcctgggaggtcctgagaacatgtgccccaggaggtctggttacaacttggttttatatgtttcagggagacataagacatcaatcagtgcatggaaggtgtgcattggcactgtcctgaaaggcaggaccactcaaagctgaggagagcttccaggtcataggtagattcaaacattttccaactgacaattggttgaaagagttaagttattatctggagacctagaatcaatagaaaggagcatttgggttatgatagattcttgtggaggtcaaggtttttatcatgcagatgaagcctccaggcagcaggcttcagagctcttattggacataaaagggtgccagactcttacttaattctctcctggatcaggaaaaagacctgggaagggaagaggattctctacagaatgtagattttccctacaagagatagctttgcagtgccgtttcaaaatatgtcaaggaaatatattttggggtaaaatacttggatttctttcagggcctcccatctatcatgttggtatcttactgctgcaaagaatcttttttgtcagtcttcagatctctgttttacttttaatgctggtcacctgtgccttcccaaaggaggagagtgtaagaaggcatgtctgaccacctaattcccatcatggtctcacctagtttttcaggtttctttggaatgcccttggccaagaagggggtccatcaatcagttggggggcttagatttgatttttgatttacagagtgtaccccacttttgagcatataaagggtgacatgaaagcccacaggatttgttacttgctccaagtcacccagcaagctgaaaacaggaatctgaaatgagactcggccacagtctgctactgcggctttcactgaatcacatcttgttgtctgtctgaggagaagattctgggtctagtttaaaactggagctttccaaagagaacatgtatatcagtggccttctgccaagagaagatttcattcattgccagcatcagctgtgagaggcgatgtcagggagtggggaagaatctagactcacaggatgttcaagttagaacatttccccagtggattcctatctattttcactcatccattcaacaaaatattcaatgatcctatgctaggaatggagctgatagggtttggctctgtccccacccaaatctcatcttgaattctagctcccacaattcccacatgtcttgggagggacacaatgggaggtaactgaatcatgcgggtgggtctttctcgtgctgttctcgtgatagtgaataagtctcatgagatctgatggttgtataaagaggagtatccctgcacaagctctctcttttcttgtctgccaccatgtgtgagatgtacctttcaccttccaccatgattgtgaggctttgccagccatgtggaactgagtccatcaaacctgtttcttttgtaaattgcccagtcttggatatgtctttgtcagcagtgtgaaaattgactaacacaggagctagctaagcccagtcaagacaaaagtctgttgacttctgcctcccctgaaggagtttgcagtttactgggacggtagtgcaaatttcctgcataagattcatttgtaacctggaaaatgcttgtgagttcaggggagaaggtgtcccctctggagagagtgtggtgatgtgttcatagggaaagtagctcttaaatggaaacgtacaggttgcctggggctttttcaggggagctggcttgtggaaggcattccagctgagggaacagcatgagtaaaggcatagtggctggccgagagactagatacatctgctgtaaaccaaaaataaaattctcagtcctcccccagccacatgaatggaccactgtcctctcggccaagggcaatcccaagttaacctgaaaaatgagttcaggccatgatagggaggggaagctggacatacctcattatacccttctgccttttcagaattactgacagagcagactctttaattctgaaaagaagcatttacaatctattctccctgaagcctgctacctggaggcttcatctgcatgataaaaccttggtctccacaactccttatcacaacccagacattcctttctattgataataattctttcatccatttaccaatcagaaaatctgaatctgcctgtgacccgcaagcccccgctttcagctgtcccaccttttcagatccaaccagtgcacagcttgcatgtattgattgatgcctgttgtctccctacaatgtataaaaccaagttatgggctaggcgtggtggctcacacctgtcatcccagcactttgggaggctgaggcaggtggatcatttgaggtaggagtttgagaccagcctggccaacatggtgaaaccatgtctctacaaaaaatacaaaaattagctggacatggtggcacatgtctgtagtcccagctacttgggaagctgagacaagagaattgcttgagcctgggaggtggaggttgcaggttgcagtggatggcaccactgcactccagcctgggcgacagagtgagactccgtctcaaaaaaataaaaaccaaaaaccaaaaacaaaaaaacaaaactgagttctggactgaccaccttgcgcacgtgttctcaggacttcctgaggctgtgtcacaggccactggtcactcatatttggctcagaagaaatctctctaaatattttacagattttgacttttttcaatgacaataatttggcacccaatatggggccgctctttttgccaacactgcgtatctcagtagctcggtactattgaccgttcaagtgagaatgagagaggtaggagatgacactatctaggctggcagaggtcctgccatcccagattctgtgctgagaggtatagatttccaatgcagaggtagagaacatttttgagcaggagagggaagagtttttctaaaaggactctctctctcgcactcctaccccctgcagaaatgccttctgcaacattcctgctgggtggctgagcggcctctgtgtgaccacttctggggacattatttggttaacatagaaattaatttcttttatatagctcgtagtttgtaacctccattggttttaaaacctggcattttagggctgtctgaacaacttcaatctgttctttttttgtgaaatgggtgcaggacacatcagtttaattcattctgcatcctcatttttcacacgagttgtcttattattcttaactattattaaaaggaatgataaaaagtaattaaccatctggaacagattcatgcttcctattagtcagggtgtccattatgaaatctcctgaaagttcagccttagaaataaattctccaagtaggtggattagctaatgaatttttcttctccaaagatgagtgtactttcccagcacagccagcactcccctccactgctcatttatcaaagggggaaaaagtagaagtgaaaaatagaaatggcttgtcaatataatttactgtataaaagctataggtttgatatggtttgtggaaggtttccgcactatccttctccactattatttatggttttagtgtgacgctgaacctcgccttcaggaggaaaatgctgtattcagtcactggtctcttcagggtccctaggaaatgcccccagtcccttccaggccactgtggggatgctggagatggatctgctgcagaacgaaccaacaggtgatgccagaagcctaagtttgtcttgtatggatcccgtgatgagttttaggggcacttgtaatttgacaaaggaagaattatgttgcaagtgggtaaccgttctgtgcatcctggattctacgaatcactgcctaccacagcctcctgggcattgacaggcagccttgactcctggaagaccatgtgacaccatgagccagctgtatttgacctctgcattggccctttatgcttctaaacccaaatcatcgctcccctcggccgtatccatggcctcccgccattgctaataccaatgaattgagacgggatggatcagggaacccaaaggccaccctcttccttaatggctgcccttgcactcacatgagctgagacccaaaagtcctttctcagagagaagctgcttcctgggagaattcctcctgggtatagaacatagggccaggcctcccagggccaaggggctgactcccatattatctgtgtcaacaagaagcatttgcttcttgcaaatactagaagatctgaagctgttcactgcactcagtattccctaagtgcaatgctgattcatggtcaagagtgaactcttcatgcttcatgaaatcttccacggttttgtattatcctgagaaagctcagctcaagtgcagtttctttcgtgaagccttgataatgcaggttacaagtcagttctatgcaacaaatatggcaccttttgtgtcctaagccccacactggactctgaggatctaagagtaaatgagacatgtgtccatccccaagaagttttcagtctgctgatagacacatgtatagaaaaactgcaaataaacacagtaagagaggtggcaggaatatatcacagaaacctggaagaaaacattaccatctgccctgaatgcttggggaaatctttacagagaggatgatatttatgctgggttttgatgtattcataggagtttgcaggaaaactgcaaataaacacagtaagagaggtgtcaggaatgtatcacagaaacctggaaaaaaacattaccatctgccctgaatgcttgggaaaacctttacagagaggatgatatttatgctgagttttgaggtattcataggagtttgctaagtagaaagtaagtgaaggagtggggaagacatttgacgcagaaaagacatacaaaagcatggcttgaaagcctacagggtggggcatagtgtatttctgatgctcagggtatgtgtatatgggggatgaggctggagaggggacctcttctagttgtttctaatgatattgcaatcacctaagaccccaagcctggcacaccgtacccactggagcggggagacctaggttgagttcatggggtagggctggagcagggagctcttaccttcagagggcctctttttcatcctaaatctgaatgtctagagaattccatacccagaaatgtcaaaggcttggatcaaagctgcagatctctgagtcagagggagttggaaaagaaggagcaacagaagcaagttgttccagccaggtttgaatgggggatggcactttcctgtttcatgcacgtgtgccttgtcttttcaaatcaattatattctacttgaaggcaagagaaatggtttaagaaatttgttaaagtattatgaaaacatagagaagtcgtatcaattgcccaaggtgatagagttagcaggggcagatatagggttttacgggcacttggaaacgaagcactggtccctgtcctgtgtctcagatctcatacacagtttgtgcttagtggacagtgtcacatattaagagaggggacataagccaatggaagtacacacagaagatggagaccaacagatcttggtcctgttttgttttttgtttttttgtttttttttttttgagacggagtcttgctctgtcactcaggctggagtgcagtggcgcaatctcggctcactgcaagctccgcctcccgggttcatgccattctccttcctcagcctcctgggtagctgggactacaggtgcccaccaccacgcctggctaattttttgtatttttagtagagacagggtttcacggtgttagccaggatggtctcgatctcctgacctcgtgatccacccgcctcggcctcccaaagtgctgagattacaggcgtgagccaccgcacccagcctcttggtcctgttttatggaaaaacatctattaagggagcagagaggatgacaaggtcttgggtaggggatggggagagggatcactgtcatcaaatatttgcaggaattttatatacaaaaaggagttgctttgtcccatgtggacttggaggccatcctggacttgcaatagaagttgcagtgaggctgatttctccctaactgctggtgctacctgaaagttccatgggctgtctagaaagagtaagcctcccaggacgagaggcagaaacatcatagatattgtcaaggaacttcttcctcttggttggtgaccccaccaaatgatttgcagtgtctcttccaatttggagatgctgtacatctcttgacacttctataattctgccattctccctgactcccaggagagcccaggatctgtgaagacatcagaagttgagtgctgggccgactgaaacacacagacctttgctttaattattccactgtgtgagatccatttgccaagggaaatggggaaagtatttttagccaaggcatttgcttttaggggactcattctcctagaaatattctactcctcctcttttatgctgtaccttattattccccaggagttttactccttgagacactatttggattttttaaaatctttttttaatctttttttttttgagacagtcttgctctgtcaccaagcctggagtgcagtggtatgatcccagctctctgtactcctgggctcaagtgaccctcctgcgtcagcctcccaagtagctgggaccacaggtacatgccaacacatcctgataatttttatttttatttttattttgtagagatggaagtctcactatgttgcccaggctggcctcgaactcctggactcaagcaattctcttgcctcagcctcccaaagtgctggtgttataggcatgagcctctgtgcccagcctctttttcatccttaaactggtttgattccaaaagaattataaacccaggtgttaaatttcaacatatagagatgacatcctattgatcgtcacaccggctcatcctcctgagtgggcagctgacttcgcagtgcagggattcccctatgtgtgcactttggaagcccttggacagttggagaagtccccatgctcaggctatactccgatggattatatcagaaaatctgggtggggtcaggcactagaggtctttaaagttgcctggatggttccaacgtgcggtcacgtctgagagtcgctgcttgagatgcatcctggattctgcctggcaggactcatgggcccctgttccctttcggagcttagagggattgagcaaagccactttcagtttttccacttgccaggcaggtgcttgaggaagttatttgactgctcagagccaccggagcaaaaatactttccccaatttcccttggcaaatggatctcacacagcagaataactaaagcaaaggtctgtgtttcagtcagcctagcactcagcttctgaggtcttcacagatcccgggttctcctgggagtcagggagaatggcagaattatagaagtgtcaagagatgcatagcatctccaaactggaagagacactgcaaatcatttggtggggtcaccaaccaagaggaggaagctccttcctccgtgaaatggagaccctggaaggttggcttcgtgtgccttgaatccctgaggtagtgcctggcagggggcttgccctggtgcccttggctgtgacagtggtggtgatcgtgacaaccgtaaggaacactggctgggcattcttctgtggaggtgtagcctctgtgccaagtgtgtctcagctttttgcacgtgtacttcatttattcctcttaggaatcggaggtggtagttactattattatctcacccttttcacattgccacctccatggaaaatgatggtgtttctacagcatagtggagtaaaataagacagctgccagaggtgacgagcttgggccctcttcccgggagccgtgagcactgagggggtctacatcttgggcaccccgattacctgagcgtgcacctaggaggctgtgtttctgacgcgtgatgatggtgatggtgaacaagaatgtcaggatgaattgccctgttggtttcttcttttaaatcttaattgatttttattttttttgtaggcgagatcttgctctgtcacccaggctggagtgcagtggtgcgatcatagctcactgcagcttcaaactcctgggctcaagtgatcctcccacctcagccttctgagtagctgggactacaggcatgtgccattttgcctggctgatttttaattttttttcttgtagaggcagactgtcattatgttgtccaggctggtctcaaagtcccggcctcaagcagtcctcctgcctcagcctcccaaagtgctgagattacaggtgtaagccactgtgcccaacctgtttcttatgtatatgtcacttgtcattggcaggcaaattggagttgttcacttggcacaatttcaattcttgggaactattatgggttgaattgcattttccccaaattcctatgttaaagtcctaatccccagaacctcagaatgagactgtacttgtagaaaagatcttaaagatcttaagggataattaaattaaaatgaggtctttagagtgggccttaatccaagatgactgactggtgtcctttttttttactttctttttttttttttttttttgagacagggtcttgctctgtcacccaggctggagtgcagtcgcgtgatcttggctcactgcaacctctgcctcctgggctcaagtgatcctcccacctgagctccccaagtagctgggaccacaggcacgagccaccaagcccagctaatttttgtttgttttgtagagatagggtttcactttgttgcccaggctggtctcaaactcgtaagttcaagcaatccacccacctcagcctcccaaagtactgggattacaggcatgagacaccacacccagccgactggtgtccttatgagaagaggaaatttggacacacatgtgtgcacagagaggaaagaccatatgaggttgcacaaggataagacgggccatctgcaaaccaaggagagaggcctgcagaaagaagcagtcctttgggaggctgaggcaggcggatcttgaggtcaggagattgagaccatcctggctaacatggtgaaaccctgtctctactaaaaatataaaaaattaactgggtgtggtggcgggtgcctgtagtcccagctacttgggaggctgaggcaggagaatcatttgaacccgggaggcggaggttgcagtgagctgagattgcgctactgcactccagccttggccgcagagcgagactccaaaaaacaaaacaaaacaaaaaaacaagaagcaatcttgcagcactttgatcttatgcttccagcctccagaacgatgagacagtgaatgtctgttgtttcagccacccagtctgtgcaattttgttatggcaatgctagcaaacaaatacagggaagagaactgtttgccacttgcaggaatttacctttagagcctccttgggttttccttgcctctgaaagagtgggtcacaaactttagtgggcttgcaaacacctggaggtcttgttaaaacctcagtgatctggccgggagcggtggctcatgcctgtaatcccagcactttgagaggccaaggcgggcggatcactaggtcaggagatcgagaccatcctggctaacacggtgaaaccccgtctctactaaaaaaatacaaaaagttagccggcgtggtggcaggcgcctgtagtcctagctacttgggaggctgaggcaggagaatggcgtgaacccgggaggcggagcttgcagtgagccgagatcacaccactgcactccagcctgggcgatagagcgacattccgtcccaaaaaaacaaaaaaacaacttcagcaatctgatgtttccatgtgtgggagcgagtggggcttgtaaatttgcgttttctggcatcttcctaggtgatactgctggtcttggggactatcgtttgagagctactgctctggcacttgcaagcctggaggtggctctcagcaggccctcctattagctttttgaacattttgactttgagagtgaggggagagcatgtggattagcctgctgggggcagctgatgcttccagttgtgccttcattcctcttggacctgctctctaggggttgagcatgccgcacatgctttctttatcataggccctcttagtttgacagctgaaggacacaaccctttatttagtcttcggttcattctccctgtgttttttgggttcttcttggttctagtcttatataggcagatacatttctggggttacctgggttgtacctgagggggtgaagacagtcacgttattgaacctactgtaaaaatgtaataaattctagaacttccataccctccacaatcctagtgctgagtatttatgcaaaggaaaggaaatcagtgtgtcagagggatacctgcacccctgttcattgcagcagtattcataatagcaaaggtatagaatcaaactaagtgtccagcaacagaggaatggataaagaaaatgtggtgtgtatgcacagcagagtaccatttgaccctaaaaaagaatgaaatcgtgtcatttgcagggacatggatggagctggaggtcactatgttaagtgaaataagtcgggcacagaaaagaacatattgaatgttctcactcatatgtggaagttaaaaaagtcgacctcatggggccagagagtgaagcgatagataccagaggctgggaagggtgaatggcaggggtagggttcgtagagaggttggttaatgggtgcaaaaatacagttagaaggaatacattctaatatttgatagcagagtagggtgactgtagttaacaacaatgtattgtagatttccagataactagaagaggacttgaaatgttcccaattcatagaaatgatcaacccttgaggtgatggacaccccaaaaccctgacttgatcatgacacatttgatgcatgtaacaaaataccacacgtaacccataaatattatatatatatatatatatattttttttttttttttttttttttttgagatggagtctctctctgtcactcagtctggagtgcagtggcgcgatcttggctcactgcaacctccgcctcctgggttcaagtgattcttctgcctcagcctcccaagtaactgggattataggcgcatgccaccacacccagctaatttttgtatttttagtagagacagggtttcaccatatcggccaggctgctctcgaactcctgacctcatgatctgcccgccttggcctcccaaggtgttgggattacagacgtgagccactgtgcccagccagctatataaaatattatgtatcaatattttttaatgtgagaaattcttaagaagatctttatgttgataccacataatgatagagtgtagagaggctaaatttgcacaaggagggcaaggaaggtttgacagaggtggtggtatcagagctactgtgtgactgattagcagagattttcttggcagagaggggaggcccaaagtgttctcttctaaggcagcagtatgtgcaaaggcacaaggattggaaacaaccagcctctctaggggaagatttaaggagataagtgtggctgatgcatgaggtccatgggtggaggcgtggtgggagctgagaaggaagggataggttggtgccacttgtgtctactgggagttcagtattaatcttttaaggaacaggatgtattagtttcatgctgctgctgtaacaaatggcttcatagtggcataaaacaccacacatttattcttatagttttcgaggttagaaatctgaaatgagttttacaggactaaaatcaaggtgtctgcaaggctgccttccttctggaagctccaagggtgaatgtaattcattcctttcctctcctagcttccagaggctgccagcattccttggcttatggccgcatcactccagtctctgcatctgtggctgcatcactttagtctctgcatctgtggctgcatggactttgttactttgatcctcctgtatacctcttataaggactcttgtgatatcatcaggcccacccagataaatccggcatagtcccccccatctcatgagccttaatttactcacatctgccgatatggtttggctctgtgtcccaacccaaatcttatctcaaattgtaatccctatgtgtcggaggaggggcctggtgggatgtgactgaatcatgggagcggacttcccccttactgttctcatgatagaatcctcatgagatctggttgtttgaaagcatagcacttcccactttgctttctctatctctctcctgctctgccatggtaaggcgtgcttacttccctttcatctttccccatgattttaagtttcctgagcttctgcagtcatgctttctgttaagcctgcagaactatgagtcatttaaacctttttcttcgtaaattacccaggctcaggtagagctttataggtatagagattggactaatacatctgcaaagccccatttgccatattgggtaacattcacagtttttgggggttagaatgtggatatctatagggggtcatgattgagcgtattgtaggggaattgaacaattcaactctgcaaggggagagaagtgcaacctggaaggccagctctgctgctctaccgggttgcatgagggaagaggagagcctggtcccaaatattgtcactggagatgggcaggagatggtggcttgaactaagagggaaaaaaattggtgagaatttagtaaaggaggctgaagacccaggaggcattgagactgactctgaggtttaaaatgctgtcattttttaatggtgtcattaaccaggagaaagtgtgcagagcctccagtctccagttgcctggcatacttttcttggtctttgcaacaatttcaggaatccttccctgacatgcaaaagcccatccccgaagcaacgtgctttccagttagcacatgctgcatccctgtgcttcacagtgacttgcctcactccgtttgctaggctgcaagtttctgcagcaccatgcaaggtgcctgtccaagccaggctctggttctgtcgagctccccattggtatataaagatgtaggtgtcctttgcgagctgcgcaattggctattgccaggatgcccttctcaggctccacgccttcctggaatgagccttggggttgagtagttaactttgatatctcctgttaagggattttctagttttttttttttttttcttctaggaggatatgtggtttttaacatagacataaataagtctaataggtagaaatgactttgaaataattcatcaaggaggaataattcagctagaaatagcagacaccagttttcaagccttcttgcctgtgtattttcagaaatgtgctctcctttgagatatttctctcatccatttcggtaaatatctgttgcgctcatttgctgatggatggtgaacctgctttgtctcctgtgtgtactggctcttttattcccctttatcctgcttattccttacagccatggagaacagcaggtttcttattttattttattaagttctggggtacaggtgcaggaggtacaggtttgttgtacaggtaaacgagtgccatgctggttttctgcacctgtgaacccatcacctaggtattcagcccagcatgcattagctatttgtcctaatgctctccctccccccacctgcccccacccccacttcccagcaggccccagtgtgtgtttttcccctccctgtgtccatgtggagaactgcaggtttctttacttaaaaacagggcatgggatgttgaaggagactgttcctttcacttgggaattctggtttatgtcccaaagctgagagcaataggggcgtgtttgccattttttcagagggatgctggatgcctctgtggaggacctaccaagggattcacaagattcgtcctgcagcctggatggcacttctctctaaggaaaagatgagttaatggaggagaaagttggagggaagaatgggtgtttctttttccctcccaacaggagggactcctccccaggtcaaatggggaaatttaagcaaaccccccatacagattgggatgctggctaggcatggtggctcatgcctgtaattccaacacactgggaggtcgaggtgggtggatcccttgagctcaggagcttgagaacagcctgggcaacatggtgaaaccccgtgtctacaaaaaatacaaaaaaaaaaaaaaattagccaggtgtggtggcatgttcctgagtcccatccactggggaggctgaggtgggaggatggcttgaactggggaggtggatgttgcagtgagccatggtagcaccactgcactccagcctgggcaacagaatgagatccatctcaataaataaataaataaataaataaataaataaataaataaatattaaaaaaaagagattgggctgcctgccagaggaggctggcctctccttcactggctgggtgctggctgaactgtggcactcataggtccatcttcataggcgagagcagggtttgatgagtgcattcttgggatcacctgaaatagggaagaaattgatgtgacttctctggacttggaggagcctcggtgaaggttggggttgtgcctgtctcctgtctcctgcttggggaattctgagggcaggagtttggtaggcaggaagggtgggcagcaatagagtggcctacatggcttcttctagcatgaccagcagatgtgagacttgaggcctcatggaggcaggaacagggaggaattaggctggctgcagaggggatctggcactgaggctgccaagggcaggttcaataaaagtccctagaggccagctggagagcttactgccatatcagggatccctgtagcttggaaagcctcacagcagggcctgggagaaccctcagccgggccctttaacagggctcatctttgaccactgccaagaggtaacaaaggaaaacaccaggcaagcgtttaagccttttgtggccaggcatcatggctcatgcctataatcccagtactttgggaagccaaggtggtaggatcacttgaggccaggggttcgagaccagcctgggcaacatagtgagaccctatctctacaaaaataaaagaaaaataagctgggcatggtggtgcacacctgtagtcccagctactcaggaggcttaggtgggaggatcatttgagcccaggagtttgaggctgcagtgagctatgattgcgccactgtacttcaggttgggcaacagagcaagaccatgtctattaaaaaataagcctttgcttcccttgctctgtcttctcccctcttctctcgtctgccttggtcttggaggaggcagtagaaggagtaggggctggaggaagtatggagggccatgccactgctcatctgtctgcagaggtcctcgacccacacgtggggcctagactggggaggggcaggaagccgagaactggacatgaatggaagtgttcacaggaggctgtgccacactttgtaaatcctaaaattgagttgtagtttcctaacttattttcctcttataactgaaagtgagtggagggctaagggattgtcatctggctgagaagggagagctgtgatagcatggctgggggaggtgatggaagacggatggagcccttgcctttgtcccccacagataaatttgttgtaaaacctaacaagagcacaaagcaggggatagactcaggaagagagattaatacactctctgaaacgctttgtactgatttacaggctttaggaaatattttcatgagtgtgtgtgacacctctctctctgtctagcacatagtattcatttataaacctacctccctgctgccctacacatttaataaatgtgctttaaactcatttactcacccccagcaaccttatgagtagttactatttttagccccgttttacagagaagcaactaaagcacagagagattgagaaacgtgttgaagggtgcacagcacatgtggaggaactgtgatctgcactcagaccttctagtccctggggtatctcactctccccccttgtatctcctctatctctcaattttttattatagaatgcagatcacgaggtcaggagattgagaccagcctggccaacatgatgaaaccccgtctctactaaaaaaataacaaaaattagctgggcgtggtggtgggcgcttgtaatcctagctactctggaggctgaggcaggagaatcatttgaacccgggaggcaaaggttgcagtgagccgagattgcaccattttgccccagcctgggcgacagtgcgagactacgtaccctccccaccccaccaaaaaaaaaaaaaaaaaaaaaaagaaacgaattttctaaacatatataaggtaaagagaataatataatggacttaatgtatgcatcacttggcttcagcaattctccttttataaaatgcattccaaacccttaccctcttctgcctctttcagcaaatttgtttgaggtggtggatgtttgctgagtggacggatgaaaaaaaatagttgaagagtaattgccatttgatacagaacagaagagcttagctttggtttaagctgttcatttccctcccacagtctgaagttcagctgcaggaaaaaaaaataaaaaagaaagaaaagtaatttaagtaatttaaattctgcctgctgacttagttttgtcctcatcttatctgaccttatttaatcagagaaaaaaaaaagaagaaaagaaaagaaaaaaaaagactgggaaagcgttttctaggaatttcatcatgaccctttaaacacatcttccatttacacttatataattgtttcatacgggatagtgttaataataccaaatttcattcctaaagcaagctgacaaaagcatttaaagacttgctcattccaaatgtgttagagcagctgagaatcacgatctggtgccagttcatttgctttcaatacttcctgcttttgggtgctgcatattttctttacaatagcccatagttagggccatatccatacaccccaactccagattcctgtcacgcgccttccagtgcaagaaatgatcatgctttagggtgcacggggcacagtctagcattttccttgctttccacatcagggtgatgatgctcagagatgtagaagagctcccaaaggggtggcactgaccagtggccacgtggctccctgggcctgttcatccatcccggtttgttctgagataacctcatgtccaggaaacagccttggctaacgtgcctaggagcagtttttgaaagaatctgagctcacggaaatgaagtaaaaaatctctggcactcattcaggttttttatttaagatttattaaaggataatttacaggcgataacattcaccctttttgggtgtacagtttgatgagtgttggcaatggatatgtagctgtggatttaccaccacagttaagatgcagaataatcccattttgtggtcagtctccaactcatccttagcaatcactgatctgttctctaattcttcctgtcttttttatttagtggtggggacagggtctcactctgcctcccaggctggagtgcagtggcacgatcacagttcactgcagcgtcgacctcccaggctaaagcgatcctcccgcctcagcctcccgagtaactaggaccacagatgggtgccaccatgcccagctaatcttttaatttttgtagagatggggtctccctatgttggccaggctgatctcaaactcttgggctcaagcagtcctcctgcctcggcctcccaaagtgttgggattacaggcatgagccactgtggccagttgtcccctatttctatggttttgcttctctagactgtcatacattggaaatggaatcatgcagtatgtaacctttggggcctggcttctttcacttgaatgattttgatacatgctattccatgtattgggagtttctttcttttttactgttaagtaatttccgaagtatggatggacatttgggttgtttccagtttgggggaatcatgaataaatcttctattaaacattcatatacagtcatgtgaacatatgttttcatttaccttgggtagatacgtaggaatgggattcccaggtatcatgtggtgagcgtatgtttcactttgtaaaaaaacgccagcctgttttccaaagtggctctactattttgcattctcacagctatgtatcaggcagagttcaggttgctccacatccttggtgacacttggtattgtcaggtatttttttaagccattctagtaggtgtgtagatgtcatgcaggcttttgtacatggaagggcaggaatgtcttgggggaaagtcagcctcagttactgctcccataaagctctttctcctgcagcccttcaacctgcgcttcagacaatcgacagcaggattccctgtttagattcactttgtgccaacaacctgtgaggcttggcagcctaaggcctggatgccctttggtgagaggcaggcacagtaacagggcagacagtgaccaatatgacatgaggaggcctgagatgatatttcttctctgatacttactgctcttgtaacatccccacatcatttaagctctatgtctgtctctcctgttatgtagaagatatagagttaatcatgtctgctttttcaccctaccggagagcaaagaagagccttgaaagttgaaatgttcaattcagagaagaaagaagagagcacgatcatttttattgcttttgagttgctgccagctaaaacctcaggtccaaagtaaaaacactcctgttattagcagtgaaggttgacaagactgtttttcatccatcttattgtttttttaacaattttatatgcatataattccatgataatgacataagaactgcttggagaagaaactgcatgttcttttgtgatttttaatataaaattctctttgggctaaggcaaccccttgtaatcactcacctcatttccctgataccagttctctgaaatgttattgtagaccttgctccaatttcaaacgctgtcaactcttgcacataaaaacagttgtttatatagtttgtggattactccttttccctcttgaactatttgtttcactgctcaatgctattcccagttggttctgacaggagaaatggaagataatgaaatatcggctagattattttctccctggttatagctattgtgaaagtttggctaaaatgtagtatttttgtctgtctggagatttgagttgttcttgctatctcccttttctctgttagcaaagtcagcaaatggttgaatcaaggtagacaatgaagtattcctgtttgtggtctccagtttctgtcctatagacatcacaaggttatttgcagagtttgtatgaaacaatgtttttggagcctaattctcatttgtactttagagccaacagatgtttcttttaagaacataggaaaagagagtgagataaagagactttggctaagcattcttttgatcagccatgaaaagtttgacttttaactgttggtcaaatacaatcatggcatttccaaaaatttttctctaatgagataatgtgtgtgtgtgtgtgagagagagagagagagagagagaatgagagacacacagaaagagaatgtgaatcataggtttccactgacctgttttaattttagagactcatttcagggatgtgcacccacagaaaaatgcctggcatctaagcatagcatgtgccacactgaagaatattctggttcatttcaagctgtactatgctggtaaaccagccctctgggtagggcgagggcatatgttcggtggtggtggtagggaaccttcatttgtggcttttgcctgtttccctggtgtacatatttctactctggtggatttcaagttagcagcatttggcagctagtttgcaaaagtcctaaatatttaacagtaggctctgggggagctggcttcagcacaccactcattttgagggacattctgctttttatttgatgtattaaatggatgtttttagagatagggtctctctgttgcccaggctggtgtgcagtggcatgatcatagctcactgcagccttgacctccttgtgcacaagtgatcctcctgcctcagcctcctgagtagctgggactacaggtgtgcgccaccacacctggccaattttaaaattttttgtagaggcaggatcttgctatgttgcccaggctagtcttgaagtcctggcctcaagcagtccttcttccacggcctccaaaagcgctgggttggcagatgtgagccactgtacccaatgctcattctgctttttatgtatttcacttttgcacagatcccctaagacattggtctggaacacaccatccacatcagtgcacatgaaaatagttcaaaatacattaaaagatgccccctggctgattttggcatgaccagtagtacctacaactctgtgttcttgtgtgtttgtgcaggctcaccagcctgtggatgtccaggtaccccgcagaggctgtcagcaggaagagtctgggcagacaggaaaactcagggcttccttctgatttgcatttcaaaatgaaaatgagaacttttcaaaaaaatagttatcctgccaacaacattgttatactactgatgggctggggaccatgcttggccctggggggtcgaaaggggagcagaccacagtccctgcctctggccctgggtcaccatagtgggggctgaggcaggctgtgagggtctgtattgggagttcggctcttgaacaaatctactgagtggtttcagtactgggagatcctgaaatggtttgtctttgcctacagccatcttggaaaatggcttaatctctccggcacctctcagtttcctccttggtcaagtaaatataataatccttcccttataacaaagattctcagagtcagaagttgcaggggggtccttacgttaataaatgcagcatcacctgcatacttcttagaaatgcaaattcccaagatgtagtgactcacgcctgtaatctcagcacttcgggaggctgaggtgggaggatctctggaggtcaggagttcaagaccagcctgggaaacatagtgaaatcccatctctggaaaaaagaaaaaagaaatgcaaattcccaggccccaccttcagaccctgaagatcagaagccctgtgatgggcttgtgttttaccaagccttgcaggtgatgttggtgctgaaaccagctcttgtgtgagacccactgagctgcagggctgttagggtcaccatggccttttgtgaacacagctcagcgcctgtcacatgtaaaggctctatctacggcagttccatgggggacacaaatagctagaaagcgttttgagctgtctgaaggttgaggaagtgggatgcacgtggtgctagctttattttgggataggaaggagagaaggaggcaatgttccttttgcaggatctgttgatagaactctccttcccctaaggcatcaactgcctggttctcttactgccaatgttagaagctcccttccccacaagttgtggcccagttctttgtcctgactcttggagtcctgggagatcgtgggtcttcctgaatagaagtagaaatgaactatgcgatgggctcctctgcacaatccacaaccaccagctccttagctacttatacccctggcctacttgtttcattttcttcatagcacttattattcctggcacttaattttgtgatttgttgctataatgtttacttgtccctggtcttccttgtccatcagaacagaagcactctgaaggcagagacattatctgttttgttggctgcggcctctccggcacctgagaacagcagccggcatgtgatgggtgcccctgtaaatgtctgtggaatggctgactggctagctgggtgggtagcagggcaggtggctgcaggggtgggggtggtccataagagtgagtgttctgagctgaacatacaactgccattcgatccagtaatcccactactggatattcactcaaaggaaaagaaatcattctatttaaaagatacctgcacttgtattgtgccattcacaatagcaaagtcaaggaatgatatggtttggctctttgtcccccacaaatctcaccttgaattgtaataatccccacatgtcgtgggagggacccagtgggaggtaattgaatcatgggggtgggcttttcccatgctgttctcatgatagtgaataagtcttatgagatctgatggttttacaaaggggagtttccctgcacatgtcctcttgcctaccaccatgtaagacgtggctttgcttctcctttgccttcttccatgattgtgaggcctccccagccatgtgtaactgtgaacccattagatctcttttctttataaattacccagtcggccgggtatggttgctcacacctgtaatcccagcactttgggaggccgaggcgggtagatcatttgaggtcaggagtttgagaccagcctggccaacatggtgaaaccccctatctactaaaaatataaaaattaagcaggcatcgtggtgggcacctgtaatcccagctacttgggaggctgaggcaggagaatcacttgaacctggcaggcggagattgcagtgagccgagattgtgccactgcaccccagcctgggtgacagagcaagactccatctcaaaaataaataaataaataaagaaataaattatccagtcttaggtatttcttcatagcggtatgaaaatgaacaaatacaaggaaacaacctaagtgtgcatcagtggtgggttggataaagaaagtatgttatatacaccatggaatactatgcagccataaaaaggaatgaaatcgtgtcctttgcagccacatgggtagagctggagactgttgtcctaagtgaactaactgagaaacagaaaaccaaatcctgcatgttctcacttacaagtgggagctgaacaatgggtacactcgcatagacataaagatggaaatgatagacactggggactataaaaggagggagcgaggggcatgagggtaggaaaaccacccgttggatacagcattcactatttgggtgatgagttgatgagaaacctaaacctcagcatcacacagtatacctatgtaacatgcctgcacatggaccctgaacctaaaattgaagaaaacaaaatatattttaaaaagaatattacaaaacagcaaggtaacttgttacacagtatatgacatgtcacatttttaaaatgatataaatgttacattaaataaagaaggagtgttctgagacactgccactgcgcaaacctgggcactttacagacgtgccaagagaaagggtttgcatcacagcctgcctgaaactttggtggaagcactgagaaagttagtgagtagacagctgtccagaggaggggagagagtgtttcctttggaggaataatgattattgcagtctttttcaccccagtgcccatctgtgccctcctttttcatttattgacatgccacttttgtgccatgggcggtcacccgtgaagaaaaacatttcacttacaccaaggggaagaaaacttcaaatccattatttcttttcagtttggaaagtttaatctgtgagcatagcttgtgtttggagcctaagataattgagcttctttctcctgctaacttttttatttatgatacttaagaggaggtcaagctaggcagttcagcttagcttttgatgtgtgcccaggagagggtgggatgggggatgcagcaaaaagtaataataatgatactaagaaaagaggtcactgtgtgtcagttactatgtttctgtttaatccacataactagtctatgaatgaataggtccttttgttagtagccttctttacagatgagcaaattgaggctcagaggtttattgacttgctccaggttacctgcaaccttgtattaatttgccaggactgctgtactggatggcttcaactcatctcagatttctagagcctagaagtctgaaacaaagatgttggcagaccacgctccttctgaagaatccttccttgccacttttagcttccaggttctggtgtttggagtgatacagctacaagctagacattccttggcaggtacatttggcttgtagctgcattactccaatctctgcctctgtcttcacatgacctttgtcgtaatatgttctcaggctgctacaaagaattgccagagactgggcaacttatgaaggaaagaggtttgactcacacagttctgcagggctggggaggcctcagaaaacctacaatcatggaggaaggggaagcaaacacatccttcttcacgtggtggcaggaaggagaagtgctgagcagaagggggaaaagccccttataaaaccatagatctcatgagaactcactatcatgagaacagcatgagggtaaccactctcatgattcaattacctcacaccgagtcccttgcacgacacatgggaattgtgggaactacaagttgagatttgggtggggacacagccaaaccgtatcaaccttcttccctctgtgtatctctttttcctctttttcttcttcttcttctttttttttttaattgagatggagtctcgctatgtcgccaggctagagtgtattagcgcaatcttggctcactgcaacctccacctcccgagttcaagcgattctcctgcctcagccccccgagtagctgggattacaggaacgcaccaccacgtccagctaatttttgtatttttagtagagatgggtttcaccatgttggccaggatggtctcgatctccttacctcgtgatctgcccgccttggcctcccaaccctctgtgtatctctgtatattcccctctccttataaggacaccagccactggattcatcctaatctagtatttcttcttatggcagcaggaagaagtgttgagcaaaagggggaaaacctcttataaaagcatcagatcttgtgagaactcactattataagaacatcatgagggtaactgcccccatgattcagttacctcccactgggtccctcccatgacatgtggggattatgggaattaaaattcaagatgagattttggtggggacacagcaagaccgtatcaaccttcttccctctgtgtgtgtctgggcattcccctcttcttacaaagacagcagccattggattcatcctaatctagtagacctcatcttaacttaattacatcaacaaggactacatttccaaataagatcacattctgaggttctaggtggacatgtgctttgaagggacaccatgcaaccactgcaaactctgttctgtctgacttcagagtcatgttctcttcactgccttttacagacttgagcatggagggtctttgatagaggcatgcccaggctggaggaacgaagcgaaatggggggcaaactagatctgtgagctgggagaaaattccaccaggagggtgatgtttggctttgttgatgttctttatgttatttggcatgtaaactttcttgatggtggtgtcttcattgggggttataccttttatcaaaatcaaataatcttccggcccactaaatgatttttgtttctctatcctctggatagtaacctggatagttcatattttctctttttgttttcccaatatatcttggggcatcttttaatttgtctgggttactgggttatatgcatgctttgtacaaatgtatagagtagcattttctgccccattgtgagctttttgcctttggatcagagagagagggagtattggagggagggaggtctctgaggttgtggaagagacaggggaccagagtccaggataatgagatgggcacaagggactttattcattctgggctcagtgtgaggcctttggtgtatgttctgtcctttcatcttcatggtttccctgtgcagtaagtgtgattgtccccatctgactgcgttggaaactgaggcttcaagaagtgctaaggagcttcctctgtggtcacgtggctcatttgtggcataggggattatgtcactatgccatcctacctctactttccaccttcaccaagagaggaatcaggggatgagggtaggcgtgaaaaagatcaagattaggacattgacctatgaagaccctcttggttgcaagtgacagaaaacccgtttaacctagctgaagcacagaagggaagacgcagaaatttattagcgcttataactgagaagttcagagttgcctctggctttagataaggccacactcaggagtttaagcaatgggactctgccctccagtctgtcctgtagacaggctgtctccagtgtgatagataagacagcagtagattttcacccctggagaaagagggttttccttgacagttcccttagagatgtcctaggaaagtctctggtttggtttgaggcacatgcctgtctgaacccatcccaggggatgggggcctacagttggtgactgggctggtctgcatcacatgcccacttggaggaagtagtagggtcaccctgatccccatgggttggggttcacacagagaagaggggattggtttccatgaggaggagaatgggatgctggacagatgagaaccacagatgcccagagattgtagtggtctctccaggagactagatagtttcagcacagaaatgcataaaggcaaggaaaagcaggaaccatgggaccagctattgggaatgcccaaagttgccaggtttgaggagctgtcagaggtagaagaaaccaaaagcgggcccagttgaaataaacacagtgttattcaacaatgttaagtaccaggggcaactccagacaccaactctgggcactctctagtctaagactgtgatcctgatggaaggtttctcagtcagcccaggtgaggtggtaggatcacttgaggccaggagttggagaccaacctggctaacatagtgagactgtttctataatttttttaaagaatgtcatttagctagaaggatttggcttactttaatttcaactcatgtgcagacaggaaaatagcccatttcctggaatctgcaaacatccagatgcatgagccagagaaaggaatttcaaaacggctgctgcatctttcactggatttgtttctcatgtgctatgatgtcccagagagtgcagcaggatccatgggcggcttctccatccagctctaatgagcatcatgtagaaaggcatcatcccttattatttgttatctctgacacctctcactttttcctttgtgatcatatcactgaattgagccctctctgaagtctactgcagtagcaacgtgcccctgtttccttaacgctggaaaatcgtgttggttttgaatttgggagacaatgatatatatttccagatatcagaaaaatccattttgacctaaccacctcccagtgtgggaacaatttatggttttctacttgatgttttgaaaattcatttggaaatagaaaaagtgacccatagatttcaggttagtgtcgtgggatgaagatgagctcacctgctggagacaattctcttctggaaaaaatccgattccctctcatccctactagggcccaggtcacaggttgcttctatgtgttaactctttcttcctcaatgttctccaagcctctccttgctgatcaatgacaacgccacccccttgggctcctgtgccatccctgaatcttgctttcatggggacaaatcctacaagcatccacatgcttaaggacgctgcatgaaatcccaaaacccattcagtgtgatgctttcttttgtgaacgaaaaagctcagacaaaagcatgttcatcctaatgacgactggcaggtttgtgcctcctgacgacgagagccactctgcagcccaccttatttccagtgcagtttagcaaacatctggggtttgagatgcaaccagatgggaaccttttagcctggtgggagaagaagtaatcgaatttacacagcagaatgaaggaacagcagtgaaggaagagtagcaatgcagagagagaagggaaaaggagagggccatgttattctttgcccccgcaaggctagcccagcatttagcactgtgtcaggcacatagcagatgcccattccgtatttgttgaatgagtgaatggaagggcttctgcctgtttagacaaccagtgtgtgtatgttccaaaaggaaaatcctgcataagggcagaggagggaggaatattgtgcagatgggttgagggctgaagaatgtcctcaggacatcctgagtcctatggactcaggactggggtccatctcaagggagggctgtgggtggggggatgtctgcttctatggggagggtcaggtttcaggtgaagcagatatggtagggggaggttactgagaaaaggctaaagcctcagagaagttacctgctgtgggaaggtctcagaggctacctggaaatggtttgccaggaggaaagggatggagaattcgctaggagggaaggagtgctaggcaatgtgggggtgaaggctcaagaaaggaccgaaggcaggaggggttctgagagtgagcaggacatatagagggtggtggcttagctgggggatctgctcagagccaaggtgggaccagaacacatgccccactgccactcgttttttaattttagagacagggtcttgctctgttacccatgcaggagtgccatggtgtgatcatagctcgtggtaacctcaaactcctagggtcaagtgatcctcctgcctcagccccccccaagtagctgggactgtaggtgtgggccaccatgcctggctaattaaaaaaaaaatttgtgtgtagatggagtcttgctgtacacctttcccaggttcttttcaaactcctaggctcaagggatcctcttgcttcagcgcttggattacaggcatgaaccactgtgcccagctctccctgcttttattttatttttttgtggttcaaatttttgtcttggtttaattatgttgattatattgattttattgtattacagcaacctgcaaattattctcatacctacatagaaataaataaaaataatagttaaaaaaatagtagactctccaagcttagaaagccaggctgtcttctctctctgggagtcagcatcagtggacactcaggtaagatttaaagaaaatctattccagatgatatggtttggctgtgtccccatccaaatcttatcttaaattgtagtttctatattctccacctgttgtgggagggacctggtgggaggtaattgaatcatgggggcagttactcccatgctgccgttcttgtgagtgagttctcatgagatctgatgtttttgtttgttttgagacagagtgtagctctgtcacccaggctggagtgtagtggtgaagggtgaagccagctggacttcctgggtcgagtggggacttggagaacttttctgtcttacaaagggattgtaaaatgcacccatcagtgctctgtagctgcaagaggtttgtaaaacgcaccattcagcactctgtaaaatagaccaatcaacactctgtaaaatggaccaatcagcactctgtataatggaccaatcagcaggacatgggcggggacaaataagggaataaaagctggcggcagggaagcccgcagctgcaaccggctctggttcttttcggtgctgtggaagctttgttttttcgctcttcacagtaaatcttgctgctgtatattctttgggtccacgccgcctttgagatgtaacactcataacactcaccctgaaagtccgtggcttcattcttgaagtcagcgagaccacgaacccaccggaaggaaccaactctggacacagtggcatgatctcggctctctgcagcctctgcctcttgggttcaaacgattctcctgcctcagcctcccaagtagctgggactacaggtgtgtgctagcacacccggctaagttttgtatgtttagtagaaacgggtttcaccatattggccaggctggtcttgaactccagacctcaactgatccaccggcctcagcaccccaaagtgctgggattacaggcgtgagccaccacaccaggctgagatctgacggttttataaggggcttttcccccttctgcttggcacttctccttagtgccaccatgtgaagaaggatgtgtttgcttttccctccgccatgattgtaagtttcctgaggcctcccagccctgcagaactgtgagtctcttaaaccacattcctttataaattacccagtcttgactatgtctttagtagcagcgcgagaacagaccaatacaccaaagtatttccttaagaagttctagaggcagggttctataagctttcatagctggaagattctcttctatgtaactgctgttgtttaaattcattttctttcagtccttggtggagatgctttaaaatcattgcatttgtttttgtgaaaggaagttctgagcttttttttttttcttccataagtgagttaactgatgggtataaaaaacttacaggactcaactggtggggtggcatccaaggtgttatggggcctgaagcttacacaattttggctccttctttaagaaaaataatgcaaaattcataatacacaattaggtgcaaaagtaaatatctattttggatgagaaaagaaatcataacaaattgctaagttaaagaaagccgacaaataccgcagaaattacaaaattcacaaaaataatgtaaggtttttattaactaccgaatacacctttctgatcctttttttcctaccttctttgactacatattatttgactacctctttattatgacagcaattcggaatagccttttctattaataaagagaataaaaaggtaattcattccttcttccagtatggttggctaatccttgcttttttctaagagttgtaattgagaaaattcactttagcttcataactcaatttgcgtattgtcatgtaaatttttaggattgttgtaaaatctggaccaacctctctccacttgctatgtgagctgcaagattatcaggcatttcacattttcttgtggtcacttgtattaaatgtggttatggactggatgttagtgtgttcccaaaattcatatgttgaaattgtaacctccacagtgtgatggtattagggggttgggcctttgggacatgattaggtcatagggtaaagctctcaggaatgggactggtgcttttataaaagagaccccaaaaagatctctcatccatttctgtcatgtgaggacacagcaaaaagacagtatctatgaaccaggaagtgagccctcaccaaacacagaatgtgctggtgccttggtcttcaactccccagcctccagaattgcaagaaataaatgtttgtggtttaagccacccagtctatggtatttttgttatggcaggctgaacagattaagacaaatattctttgaattgaggacattatgaagtatttgtgaagctatttctagttccgggcagctcagcaatatatggaagactggaaaccatcataaacacatcccataaagccaaactaaatgcgttcccaacctaaattccgcaaagccaaatcctgaataactgtgtgctcccccagcccctacttggggagaactataacacaaggaaaactgggcattcaactgattgcaataaaatatcttgcgtttgcaaattttacagaagcatatgattgtgtgcacacattactagggccctttcaaggccttagaaggggcccatgtaattgaaagaccctgaacttaagcctcaatagcttcacagtaaatcttgctctgcccacgttgattacttctggaagtgaatatttactaaatccccctggagtgaaggaaccctgggtgttttctctattagaccttttacatttttttaagtttcattgaaataggcattaagaatacttggcccaaatgataattacatttcccttacatctgtgtagtggtttgccgtttgcaagagttcacaatgctttattttctttcctctccactccagccctgtgagccagacagggccagtattattcccgttcgcaaataaggaaacacgctctgggcttgccagggctttttccatctgcctctcaggaggagcctttgccgcagcaggctgtaggtgtgatgaagggagcattgggcactaatctggagacccacgatcgatgctagctccaacatgaactggctgtgagtcttgtgttaggccttcctgagccttggtttcctcatttgtaaaggagggattatctcctagaggggccttgtttttgtttttttttttctttttttgtttgttatgtttttgtttgtttgtttgtttttttgagacagggtctcactctttggcccaggctggagtgcagtggtggtgcgatcatgggttgccaaaaccctgacctcctgggctcaagccatcctcccatctcagcctactgagtagctgggactacaggcgcctgccactacaactggctaacgtttttgtatattttatagagacacggaactccccatgttgcccgggctagtctcgtactcctgggcccaagtcaagtgaaagtgctgggattacaggcatgagttactgcgtccagctgcttttaagttcctttttgttttgttttttgagacaaggtctcactctgttgctcaggctggagtgccgtggtgcaatcaggcttcactgcatcctcgacctcctgagttcaagcgatcctttcaccccagcctcttgagtagctgagactacaggcattgtgccaccatgcctggctaatttttgtatttttgtagagatgaggttttgccctgttttctgggcttgtcacaaactcctgggctcaaacaattctcctgcctttacctcccaaagtgctgggattacaggtgtgagacaccacacccggctgcttttaaggtccttaaagtgcttaagaaacacttttatctactagataagaggagggttcccacctccctctcgtctcatagccaaataggagtaagaggtgccttcactctccttatttctctcgcttctgttatccatttatagttaaccctttaacaatgcaggggttagaggcactgaccttatagtcagactgcgtgcaacttctgactcctccaaaaggtaactactaatagcctactgtcaactgaaagctttaccaataacataaaccatcaattaacacatatttcgtatgttatatgtattatatgctgtgttcttataatcaagaaggctacagaaaatgaaatgttattaagaaaatcctaaggaatggctaggcatggtggctaacgcctgtaatcccagcactttgggaggctgaggcaggcagatcacctgaggtcaggagtttgagaccagcctggccaacatggtgaaaccccatctccactaaaaacacaaaaattagctgggcgtggtggtgcgcacctgtagtcccagctacttgggaggctgaggcaggagaatcgcttgaaccagggaggcagaggttgcagtgagccgagatcacaccacttcactccagactggtgacagagcgagactgtctcaaaaaaaaaaaaaaaaaattagctgggcatggtggcacacacctgtagtcccagctactcgggaggctgaggcaggagaatcacttgaacccgtggggtggaggttgcagtgagccaagattgcaccactgcactctagcctgggcgacagagtgggactccatctcaaaaaaaaaaaaaaaaaaaaaaatccaaacgaagagaaaatccatgtgctgttcattaaatagaagtgtatcgtcataaaggtcttcatcctcatcgtattcatgttgagtaggctgagcaggaaaagggagaggagagttggtgttgctcagtggtggcagaggcagaaggaaatccatgtagaagtggacctgtgcagttcaaacccacggttttcaggggttacctgtcctttctggcatcattctgacatcccatgagtctgtcttttcctgactataagccctgagcgggctggatccttgtggaaattaagtatgtatgtgctcctctgatttcggaagcaggttgcaaactttcagaggtgtttgaacatcctgagtctctccagggtggtcttgcagcatgctcaggggcccaatgtcagtgcagtgaccttgcgtttagctgggttcctgggctgtgattttgcttcctcattttctgctttgatgcgtgtgttcatctggaaatccagagggtcccagaactgggtcagggcagcacacattgctggaggaagcccagctagagagtgcaggagaggagagttggttgatgctgagaaatatttttttgctggatccatttcttctgatgaaggtagccattccctcgggattttctttaggtgatgtatttaaaagatcgctgaaacatgatttggctcatgtgcttaaaaaccatcaactacataatttaatgtgcccattttatgtatggggaaattgaggtctggtgacgacaggtccagggtcaaactggactcctgatatctttttaaatttgacccttcagcagtacaggggttgcaggtaccaactctcacagtcaaaattttgtgtgtgacttttgactcccccaaaacttatttacaaatagcttaaggttaaaactggagcatgtgtttaaggttattcctctctgtgcaggcatcatctgaccacgtctttttttttttttttttgcaatccttttttgtgccttgttatcccaatcattattgggcataattaataaggaaataattgaattaaaatattctggagattttgcttttatgtacatttactggatcatacacgtaaatacagagatatatttatatgtagtttggtttttaaatttttgtctttctttttcctttttcaagattttatgtttttctcgtgataaagttcacataacatcagattcatgccagtgctgtcacctcatgcctgtaatcccagcactttgggaggccgaggagggcggatcacttgaggtcaggagtttgagaccagcctggccaacatggtgaaaccccatctctactaaaaatataaaaattagccagatggaccgggtgcaacggctcacacctgtaatcccagcactttgggaggccgaggcaggcggttgacctgaggttgggagttcgagaccagcctgaccaagatagagaaaccccgtctctactaaaaaaacaaaattagccaggcgtggtagcgcatgcctgtaatcccagctacttgggaggctgaggcaggagtattgcttgaaagggggaggcggaggttgtggtgagccaagatcgtgccgttgcattccagcctgggcaacaagagcaaaaccccgtctcaaaagaaaaaaaaaaaaaagccagatgtggtggcacgcacctgtagtcccagctattcgggaggctgaggcaggagaattgcttgaacccgtgaggcggaggttgcagtgagctgacatagcgccactgcactccagcatgggcaacgaagcaagactgtctcaaaaaaaaccaaaaacaaaaatccatcaggttcatcattttaaccattttgaagtgtacgattctgtggattttagtatatgcatgatagcatgcaaccatcactgccatctaattccagaacattatcatcaccccaaaaagaaaccgtgtacctattagcagtcaaatatattggttttgaagatttgctaaatcatggtgccaagagtgttttatacatgtgtgtgaatgtgtgtgtcctcttgtaatgggaagacatctttcgctttatgacaagagtctttggaaaggtctttgtccaggcgggatgctcaggaatatactcatctagggagctgctctggattgcgatgccgtcttgcaggtggctgatgctataaaaatacatgcagaaggtcctttgggaggccctgaacagaggctgtaggaaccttggggagggagaatagatggcccggggaggctaccctgctttcttagtccctgttgagcccaggcctggcacagcattaaagagagctgggctgcagaaagaggctgtctgtaaaacaggcagggagccaaggtcctgggtggctggtctattaaaagctcccttgacaatttcgacaaaagcatcagtattggctggtcccatcctgatgtggatccttagcttctgtgtctgaaaatcctccctgaagttccatttgcatgtattattccattctctatgattccctgctgtgggttactgttctacagactcttatgctcagactccagagagccgtgtttgtttataaaaggcggtaattggaaacagtgtggttagagagacataatattggacacagacctcatcttggctctctgcctcgctctgtgaccctggcgacatcactcaccttctccgagccttggtttccacattgagaagtgagttggaatagtggatctagaagtagtaataccttcttcataggacttatgtcaggattaagtgagataatgcatggaaatactttggcatagtgcttggtacccagcttaagtgcccaataaatggttaccaacagaaatatacccatgattattaatatattaaccttaataaattaatgtatccatccagactgaactcccaaatagccaatttccccaacaccttttacgaaatagcagagtcgttaatttgtaacaccttctacatcatatattaatttctctttggttggccggtggactcggttttgttctgtggatctgtttttgatcattttattagaaacatttaactttaattattatgtcttttaattcttgttacattcctattcttccagaattcttaggcatgattttgttgggttgaccccacgttttactggggttgtgattagaatccaattccatgatagctaaatcttggtctgtgaaaactgtctaacaatattcagtcatttcatctagaaagagactatatttatttattggtttcagtattttacatctttctaagtatttattgccagggttattcctggacagtttttatttgttaacgttttcactggcattttatcccattatttgttctaattggtttttgctttaggagaggggttgatttttaattttaatgttatgcgtaccttatatccaatcgtatcactggatctatatactaattttctgagttattttgattatctcttgattttgaagcatgtaatcatataattgaatatgcatctaataattttatctgttatgaacttgattttctctaaatttatcttttcgattgttttaaatttcttgcatttatttatcaacctaaaattcttttctgttttctggtgcattaatttctgctttactcttattttccccttcccagttctttctttgtttctcaaactgtttcaacagagtggttggttcatttatttttcatggtttaataataaaaataattagggctgttaatttctttctgggaacatgtaactctgttatggattatttacattttagatattttcaagctagtttataactgtagatttgattttcttcttgaactaataattttcccagttccccttctgcagtgggattccgggagagagtagtcaacagctgaattaacaagtctagaaagcattcctagaaaaggtaccaggctgagaaacgaactggcttagagtaatgggttgcaccacaggtaggcaagtgacagaaaaacaagaatacataggttttgctggacagacatcaggcacaccttggttgggtgttctaagtgctgggctgcaaaagtctattaagcatgtcaagtctgtataggcaatagttgattaaaggattattttcaaatcctcatgttgtttggatttgttttgttggacatcttattatattcttattttattgtgctgtagtctgaatgtgaactgagcatttttaacagttttattgagctatcatggacatataaaaattgtatatattcaagatgtattgatatatgcatacattgcaaaatgaccacaattaaccaaattaacatattcattatctccacataggtaccatttgggagagggagagagagagagagagacagagagagagagagagtgtgtgtgtgtgtgtgtgtgtgtgtgtgtgtgtgtgtgtgtgttgggcagatttaagatctatcctcttattaaattacagtatacaatacagtattgttaactttgtcatcatgctgtacattagatcttcagaaattgtttgtctagtataaccaaaactttggaccatttgacccaaatcaccccattcttccctccccccatcctctggaaattagcatcctaccctctacttttatgaatttgatatttttcaatatgtgagatcatgcggtacttttatttctgtctcagtcacttcatttagcgtgatgttctccacctccatccatgtggtcgcaaatggcaggatttccttcttgttgaagggtgaatgctattccattgtgtatgtgtgtgtgtgtatacacaccctgttttctttatcaatacatctgcaaaaagatagtgagattatttttgtatcttggccattgtgaataatactgcagccgctcagtgtagatatttctcaacatactgatttcagttcctttggatatatatctaaaatgggattgctggatcatgtgatagttctatttttaatttttggggggaaccactatactgttttccatgatgtttatgctaatttacagttccccctgcagtgtacagggtttccctttactccaaatccttaccaacccttaccttgtctttttgataacagccattctaacaagtgtgagataatatctcatactggttttaatttccgtttccctgagagttggtgacattgtgcatttttttcatatatccattggccatttacatgtcatcttttgaaaaatgtcaattcagaccttttgcccattttaaaatcagattatttcttttttgctgttgagttccttgcatattctggatattaatcccttattagataaacatttcttgaaaggcaggtatagtagtgacaaacacagtttttgtttgtctgaggaggacttaatctccccaacattttaaaaggatagctttgcagggtatagtgttttaggttagcaattcttctttctttcagtcctttgaatatattacttcactgtccccaagcttgtaaggtttctgtgaagaaacgtcctgttagtttcatggtattttctttgaatgtgatgaggcacttttctctttctgctttgaaaattctttgtctttggccaggcatggtggctcacgcctgtaatcccagcactttgggaggccaagatgggtgggtcacgaggtcaggagatggagaccatcctggctaacacggtaaaaccccgtctctactaaaaatacaaaaagaaattagctgggcatggtggcgggtgcctgtagtcccagctacttgggaggctgaggcaggagaatggtgtgaacccgggaggtggagcttgcagtgagccgagatcacagcactgcactccagcctgggcaacagagcgagactccgtctcaaaaaaaaaaaaaattctttgtctttgactttttacaatgtagttaggtttctcagtatagtccactttatattcaatatatttgatgttttatatgatttttgagactggatgtttatttctcttcccagtttgagaacttttggttattatttctttaaataagctggttgccctttttgctctctcttctttctggaatgctcacaatatgcatattgttttgcttgatgatgtctcataagtcctttttttttttttttttttttttgagatggagtcttgctctgtcacccaggttggagtgcagtggtgtggtcttggctcactgcaacctctgcctcccaggttcaagcaattctcatgcctcagcttcccaagtagctgggactacaggtgtgcaccaccatgcctggctaatttttgtatttttagtggaaatggagtttcaccatattggccaggctggccttgaactcctgacctcaggtaatcaacccaccttggcctcccaaactgctgggattacaggtgtgagacaccacgcctggccatatctcataaatcctgtatgctttatacagacatctattagttctattttgtatattcaaatgctttatgttattatctataggttttaaacctgaccagtttaaagatgtaaaactggaaaagagttgttttgttcatttgccccccttttccaagaattttgcattatatattttgaagtaatgtcatttaatcccctctctcctgatgctgcgatagtctgcattaatgttgaagcttatcttttatcaatatataatgtctctgttttcctatgtaatgctttttctctttagtgatgctttgagtcaaatgaatatttccacctgtacacccttaactcagtgttcttaacctcccatcccctctgagtcccttacaatgggccgaggatacactttctatatggtaattcttctaagttctacgagaacgctgctggcttcatttctcttcaacctttccaatcctgattttctcctcaatatttttgtctagtggatatcctagacttgcttcctgtgtgagctcctttgcttctaggttcttcctttggacatgtctagaacattttccctgtacttcactaggcagctatctattccattgcttgcccaccttgaggaccctcagcttgcctcttacctaacagttgtctaggagggtgaggcagagtttgaagcctgcctttctcccttctcttccccttccctccttccttcctttctgtgtattttgtttctctctgtctctctttgtttcttccatcctttctctctttcttttttcctttcttcctttctctctcccttccttcctttcccttcccctctccctccttcctttttcctttccttttcctaccttccttcctaccttccttccttccttcccccacctccactttcttttctttgctccctgtctggtagagttccatagaatggtcatagctcactgcagcctcaaattcctgggcttaagcaatcctcctgcctcagcctcccgagtagctggaactacaggtgcacaccatcatgcctggccaattaaaaaaaattagagatggggtctcattatgttgcccaggctggtgtcaaacacctggcctcaagcaatcttcctgcctcagcctctcaagtagctggaattacaggtgcaagccactgtgccaagcaggagtctgcctttctttcttgggttttttttttttttcccagcctgtcatctgattcacatattttccttggtcacataatacaattttgctttttagtcctgggagctcttatcttttattaaagacatttttatatgagttgttttaagtaagtagtcctctgccatttttgtttttagccttttcctcatagttggggctattcctcttgttatctgtctttgaagttatgggcaatgttttgtttgtctttatcatcaccattagtaattatctttcacatttaaaaagcagttcttgatcctatctatctctatttatcagaggcaagaatgaagtagtttcttttgattccttattatgtaggagatattttaggatttcttacacctgccccacacagaaacatagatatactcttgattaatgtattattggcctttgcagtgactcacgcctgtaatcccagcactttgggaggctgaggcaggtggaacacttgaggtcagtagttcaagaccagcttggccaacatggggccaaccccgtctctactaaaaatacaaaaattagccgggcatggtggcaggtgcctgtaatcccagctactcgggaggttgaggcagggagaatcacttgaacccaggaggcggaggttgcagtgagccgagatcattccgctgcactccagcctgggcaacagagcgagactccatctaaaaaaaaaaacaactatatatatatatgtatatttacacacatacatgcatacatatatatgtatataaatttggccttaagaaccaagaaaaaaaaaacgtgtttttttttagacagggtatatgtatgtaaataaaatatatcctgtaagtaaagtatgatatttaatatagcatgtgtaatatatagtgttataagatggtagaaatacacacaccacacatacacttaaatttatatatataattttttcgctgctgtgtcattgatcttggcctccatcatggtgcgtgaacacgccatgccaggagctttatcctcttcaggctatagaagttgaaggataggaaactaattcctagtccagttccctcctgcatgctggcattcttccactattgctctggtgggataaggagaaggcttttcttattgcttaagccttttcttaagcacacctcattgcctgctcttccatcactttcgccagatggaataagcaagaaaacaactctccaggttcttcttttccacatgggagctctcactcttggcacatggtactgctgcagcctctattctcattcatgctctcacctagggcacagtctcaaagctgatctcatacaccaaaagacgcctggggccgggcacagtggctcatgcctgtaatcccagcactttgggaggctgaggcgggtggatcacctgaggtctaggagtttgagaccagcctgaccaacatgatgaaaccctgtctctaccaaaaatacaaaaattagccagttgtgatggtgcctgcctgtaatcccagctactcaggaggctgaggtaggagaatcacttgaacccgggaggtggaggttgcagtgagtggtggtgcatgcctgtagccccagctacttagaaggctgaaggtggaggattgcttgggcccaggaggcagaggttgcagtgagctgagagcatgggcaacacagtgagaccttgtctcaaaaaaataggacacttggattagaatgttcatagcagcctttctcataatagctccaaagtggaaacaacccagatttcaaccaacaggtgaatgaataaacaaactgacatattcattctatagagtaccattcagcagtaaaaaggaatgaactactggtatatgcagcagaatgaatgaatttgaacaagtatcttgtagaataaaataagccagacagaaggagtacctactgcatgattccacttatgtcaagttctggaacaggcaaacatcatctctggggtggggagaattgcctggaaagagtcaggaaggcacttttgttggggatgggtcttcttttggatggtagctacacaacagatgtttatggttgtcaaacctcgttgaactcaagagttgtgtattttcttttattttttgagatggagactcactctgttactcaggctggggtgcagaggcacaatcttggcttactgcaacctccgcctcccaagcttaagtgattctcctgcctcagcctcctgagtagctgggattacaggcgtgcgccaccatgcctggccaatttttgtatttttagtagagatggggttcatcatgttggccaagctggtctcgaactcctgacttcaggtgatccacctgcctgggcctcccaaagtgctgggattacaggcgtgagccaccacacctgtcctgtgtattttctttatgtaaattatatatcaataaactaatggctgtactttttgcaaaaacaatcagaacagaaaataaggatatatagtatatataaatgtatatataaacagaaataaaatatgagtatgatttttaaaacgcaggactgaagttggtcctagctcgggcatggacgcgagtcttacactgtggcatctgctcctttttctttctggttcagaaagaagccagacctgagctgacacttgcgggcagctggagccagactgtcctgccttatttccaggtggctgggcttttctatttctaagggtaaaggtgtgttcaggtcactgtaatttttcatctagtgccatcagatttgtgcacgacttttattccagtggggtgtgtgtgtgtgtgtgtgtgtgtgtgtatgtatgtgtgtgaatgtgtacacaggctagtgccttctttgggatatttacccaaattcattttggatgtgaggagatctatttcagagtttggtagcccaattcaaccctaagatataaaatatgattttaaaaagtcatagctgcccgggacattgggccagaaagtagcactggtggtgtggctgtggaatgtcatatctccattgatgggcacacgagggtttttgcactagtgactgacaggtgttaagtcaccacccttgcaactgactatcggagttccaaatgtgagaggtcggaacattttagtcactcacctgcggagagagggagactatagggccttagaccagtaaggcttttagaccacctgggcccgcccctcattctacaggtgagatctgagcctgcggggaggcagctggagaagggtatgtgtgggaccagctggtggcccgccttgacccccggtgcaatcagttttaaggccagtgctcttgcatgttaataacttttctcttggatggtgttttaatccgctgggactaaatgattctgtcataaatccttgcagacgagaggatgggaactgccgtttatgaagtcacctgcaatgtgccaagtactcaacacatgctacctcatgaattcctaggtagtggacctaggaggtggcaattatttgttccattgtacagataaggaaaccgaggctgatgcagaattggggtttgttacaccatgatttttcccaggctccacgcattccacagatttacagtctcagttttcagttttcattctggaggtatcggacaggtgtctgctgtgtgcacgtcctgagaacacagtcctggccctcgtgggatgtatagacattgccactgtagcgctggaatcaatgggatttactgcagagatgaccgtgggggcgaggttaatgccaagggtcagactgaaccctatgtccttcctgtgtgtctgcttgtagatttctggagggaatgtttctttttattattacaattttttttttaattgagatggagtcttgctctgttgcccaggctggtgtgcactggtgtgatcttgactcactgcaacctccgcctcccgggttcaagtgattctcctgcctcagcctctggagtagctggaattacaggtgcctgccaccatgcctggctaatttttgtatttttagtagagaagaggtttcaccaaattgataatcaggttggccaggctggtctcgaaatcctgacctcaggtgatccacccaccttggcctcccaaagtgctgggatcagagtcgtaagccactgcaccctgccctggagggaatgtttcaacctcataatcccggcctctcaaagcctgcctctccttcatgcctgacaccggagggggaacaatgactgccatgttcaataaaacttttgtgggagatgatttaaattgctttgatgacacccttgggagttgggactccttttagtaatttaggttgaaggaatgtgtgctttcatgaaagagaggaaatgtatctggactctgggcttgaagctcttctttctaagaggaggcttgttggatttcaaaaccaagacgacaccacctcttggtgtgctggcagacacagagagaggactgtctgtcttccctcctgtgtccctctctgccacagctgaaatggctgatcttttcagaatcactgactgggggatgttcatgagcttggacaggataacaaatggaggtgggttattttctcatcctaataagtgagaaacagctgttcttcctagcttggaaagcaagtcatttgttttctacacacacacatgcatgcgcgtgcacatacacacaaccacacacacaaacacacatggttatcaacatgctgctaggaaaaattaaaaattgcgcatcatatttctaaaagaggaagcagagaaaagggatttccagaattctaaacacgcctcccatcactgcgtctcctctcagctaggactttctgtttgcacagccgaggcctgcagggtacattccagaggtggacttggggctggccttgaacttccagaccctctctcccctctctggccggggctggggaaatgtcagctattctgagggccttggaagctggactcagttattttcggtaatgtatcatcaaccacttattccacttttacagaagctatttgtaaaatgaacagtgtttaatgtatttatatttaaagtaattattgaggtcaggcatggtggttcacatctataattccagtactttgggaggcagaggtgggaggatcccttgagccctggagttcaagagcagtctgggcaacataacaagaccttatctctacaaaaattaagaaaatcagccacacgtgatggtgccgcctgtagtcccagctactcgggaggctgaggtgggaggatcccttcagccgaggagttcgaggctgcagtgagctaagatcgctccactacactccagcctggatgacagagtgagaccctgcctgattactttttttttaaagtaataatactttttaaaaaatattttttaattattatattaaaatatatatttaatatatactaataattatatataataatatataataaaatatatatttaaatatgtatataataaaatatataacatatattttaaatattgtttaattattataaaaaataattacttttttaaaagtaattattgatagagagggatttacttttgccattgtgttgctgttagtcttgtagtccttttttctgtctttcaactgatgtataatttcagttaagtaagatgaataagttctagttacccaatatgcagcattgtacttatagttgaggcataaactcatttagtactttaatttggcccaaatacacaagtgtgcgcagtattggacacttaaaaatttgttaagaggatagatcttgtgtgaaaggttcttaccacaaaaaaaactaaacgaaaatgaaataaaaatgaataatgtaaaggataggtaaattacaaagtacacaaaggcaaaaaagaatttcactgtcttttgaatgaaccctttataggcggtttctgctttatatgcaggggtggaaggtgaagaacctgctattgacagtgactttgaaagactttgagaaaatagtgtaagtaggtacaaaatgtcatcacaaaccatgtgtcttataatacatgtagcaagaatggaatactgtgtagccataaaaaggaatgagatcatgtcctttgcagggacatggatgaagctgggagccattatcctcaccatactaatgcaggaacagaaaaccaaacaccgcgtgttgtcacttataagtaggggcttaacgatgagaatacatggacacagggaggggagcaacacacactggggcctgttgggagagggcaggggtggggagagcatcagggaaaatagctaatgcatgcggggctgaatacctaggtgatgggttgatagttgcagcaaaccaccatggcacatgtttatgtatgtaacaaacctgcacatcctgtgcgtgtatcccagaacctaaaataaaatatttttaaaaattaggtaacagagtctcagtatgctgtccaggctcaagtgcactggcatggggcttcagctgtgtcatatttcaaaatgagagttctctacatggcggccttcgaataatgtgtgctaatttcaggacctgaaagatactagcgtacatgtgcagggccatgtgcacacactctccttgttgtcccagggacctaggtctccttgtctgttgcctctgagctcaggcactgtaatctcatagaacgtcactgtaatggggagacaaagctaggctgaattgatgaaagctggaaagactactttactgggtcttattcattattttcagcagcatagcataaccgtgctctttaaaaaatggactaaattgagagtctgttgaacttccccctttcaacatggggtattcatttgttattaggaacggcaatttttatgcatgtaattaacatactatgatagcttcagtggattaggcgagtcatatatgtatatatttacttttttgagacagagtctcgttctgtcgcccaggctggagtggtgtgttggctcaatcttgactcactgcagcctccacctcctgggttcaagcaattctcctgcctcagcctcccaagtagctgggactataggcacgtgctgccatgcccggctaatttttgtatttttagtagagacagggtttcaccacgttggccagggtggtcttgatctcctgacctcatgatccacccacctcagcctcccaaattgctgagattacaggcatgagccactgcacccagccttttttttttttgagacaggttctcgctgtgttgcccaggctggagcgcagtggtgaaatcatggctcactgtagccttgacctgggctcaagagattttcccacctcactctcctgaggagcagagactataggtgaacaccactacacccagctaatttatatttttttttgtagagatgggatctcgccatgttgtccaggctggtatttatatcttatatataccacttaattgctttattttcatttccttcgtaaatgatatctaggtgaaattaaccagccttttttgaatgaatgatccctaagtttgaattggtggggtctgtgtaaatggatgagggccatttgaatagacattgggacacttgaagatgaaaaattcatggtcaaatacaacatttttctgacttgtgctagaaagatgtcagattctcttttttgtttaatacagtgattactaatactcagcacgtcgacctgttgcttggaagtgatttacgcattctctggtctgggagaattactgcctttttttttcttcatgactcagagtgggctggactcccctctaaagaagccattaaatttgatgaagagccacattccttgcaaggcttgacctcaaacatttgagattagccctttgaatttctctttctggaagtctgacagcaaaacttggtgcatttttctctgcaggatccaaataatagctaaacgcctccggggcagctgtaaggcaagtattttaaaaacaaccatgttaaaatgatctggagactgcaaacaatcggcttttctttcgccccaggagtctcaaggtgcacacttgcatatttgagccaattaaaatactaaataagcttgtccctcaagaatgtagacagagcttttcactctaatttctgctcaatacccttgagcacaccttgttggttgaataaagccacacctagtttctgcaattaggggaaccacgtagttgatttttgcaagctttccttcatcagagaatgagcagtcttcattcattcaatgcagtgatgcatttgttcttttacccaacagatactttttgaacatttacaacgtgccagcatagtttaatctgtatatattcgacagacgctaagttaactgaaacggcgttcagaggtggattaagtattcatcagtgcgtatatagaaactgaaggcatggagtgggtgacaaagtgggtacagatgttgtctcttcccctttgcccctttgggtaaattaccgtatgatcttaaatacattgtcaaggaataagccactgaaaacggagaaggttttgatgacagcgctgcatgcatgtttttgttaagaaacactccaagggcatcattcttgggctatgtcaaggtctatcaactgggaaccactcaatttaccaggctcccaagatgcaagtggcctgtgtttgcttatttgtgtcaaggggatccctacagttcagataagttagttttgcacttcccactacagtgtttttgttggaaagtggtctgctaagtgagaacccattgccagttttacctacaagtcctgtatttcttttttcttttttttttttgagatggagttttgctcttgttgcccaggctggagtgcaatggcacgatctcggttcacctccgcctcttgggttcaagggattctcctgcctcagcctcccaagtagctgggattacaggtgcccgccaccatgcctgactaattttttgtatttttagtagacatagggtttcaccatgttggccatggctggcctccgtgattcacctgccttggcctcccaaagtgctgggattacaggcgtgagccacacaagtccaatattttacctagaagcctagcaattctttctgtgtaaggagatgcatagaacacgtttggggtagaggtagatgtagctatagatacaattacagatatagttatggatatataaaattaaataccttaatccttgactttattatttttcttctatcacatataatcctatttggagcaaaaatactttgagcacatgttaattttgctagttttttgggatagtttttcccgccagtactcccatttgcagaactagtggtaaatgctaatggaaaacttcttcagttagcagatttttattttactttattcctggggcaattctccttaaattgtagatcaaatccagctgcaggctaaagcaccaaaattttcttgttttcaactaacccacggcaaggataaatttttctaccccctgggatggcagattcagtcccggaaattcagagtagtgaaattgttagcagttgttcttaaaatctgggctctcatttcatggcgatgtctttggtctttgtgttgaaagcaggacctctgtaagccccttctcctccccagactgtgagtttggtgggtgttatgacaacggtgaggggacgggggagggcccctccaggaagttgtcatctcagtccagtgcggggtcagcagtaaaggacttactaggttggcgacctgatgtcacccagagccagagaagtttccatatctcaatgaaccttttggattcgaagagagataattactaactccacggactggccttagaagactcttcctctgacatcatccaattcattctgccacttaaaaaaagaaaaaaaatccaggtaccgtggaaagccactggaagctttaagcaagagagtgtcctgatttacaattaaaaaatttctaattaggccgggcatggtggcccacgcctgtaatcccagcactttgggaggctgaggcaggcggatcacttgaggtcaggggctcgagaccagcctggccaacatggctaaactccatctttacttaaaaatactaaaattaggcgggtgtggtggtgcgtggctgtaatcccagctacttgggaggctgaggcaggagaatcacttgaacctaggcggcagaaatagcagtgagccaagatcgcatcattgcactccagcatgggtgacagagtgagatttgtctcaaaataaaataaaataaattctaattttggtaaaacatacataacatgaaatttaccatcttaacaatttatatgtgcatatatcagtagcgttaagtatatacacatttttgggcaacagaactgttttcatcatgcagatctgaagctctgtacccattaaacaataactccccctacctgctgtcaacgccccccactattcttctttctctgtctctagaatttgactactctacatacctcatttaagtgaaatcatacagtaattgtccttttgtgactggtttatttcacttagaatatcgtcctcaaagttcattcaagttgtagcatgtgttaggatttccttccttttgaaggctgaataataatccattgtatgtttacatcttaggctggtgcaaaaataattgctgtttttgccattgaaagtaatggcaaaaaacagaaattacttttgcaccaacttaatgtatcctcttttgtttattcatctgttgatgggtacttgggttgcttctacctactgactattgcaaatagtgctactatgagcatgagtgtgcaaatatctgttcaagtccctgttttcatttctgttttgttttgttttgttttttgagacagagtctcgctctgttgcccaggctggagtgcagtggcacagtctcagctcactgcagcctctgcctcctgggttcatgccattctcctgcctcagcctcccgagtacctgggattacaggtgcccaccaccacacctggctaatttttgtatttttagtggagatggggtttcactatgttgggcaggctggtcttgaactcctgacctcaagtgatctgcccaccttggcctcccaaagtgctgggatgacaagcgtgagccaccacccctggtccctgctttcatttctttggggtttatgcccagaagtaaaattcctggatcctgtggtaattctatgtttaactttttgcagaaccgccatactgttttccataggggttgcagcattttgcattcccatcagccgtgcacaaggtaccactttctccacatcctcgccaacacttgttattttgttttcttgacagtagccattttaatgggtgtgaggtggtatctcattgtggtttatgtcacatttttgagtatacgttttaccctgctgggtatatgttattacactaggtgctggcttacagaggcaataagacccactttctgccatgagagaggaaactcacaatctgttggaggagacgggcatctaaacggaaaattataatacagcttatcaagtgctatgatagagacaggtcttaagagagcagagagtggatgcaatcgaggaagacttcctggtcttcatagccccacctctaggaagtcttccttggttgcacccactctgtgctccgttaagacctgtctctggagtagcagtagagttcctactcaacttctcattttctggttccttctaccaagttaagcatactcattagaaggaaccagaaaatgagaagttaaatctgaagtccaagtggttggtgagtattggttagagcactatttttagaatagaacaatgcttatgagtgaagcattttttttttcttttcatttgtgcatttctctggctctgggagattgtaaaggttacttcattgggatgcttagatcacagtttctggttattagaaagaggccacactgagacctttgggagaaaaggggcacagcaggtgggtaggtgggacgtgcctcattgagcctgattcaggggtcttgtgtgttttccatttcatccaattctgggaagtctgaaggctccgggtcagaggggagtttgttgcatgggggcagttgtctggaaagcttagtgacaaagtagcaaataggagcaaggaaacaaagtatataaagacctgctatttaggaatggcactattcttgtcgtggtgactcacatttgtcaagccttgaaggatatttgcagaggaagaaagaagcattggattgcagctcggtgggagcagatcctggctgccagtgccgggaccaaggcagggtgtgatctcacccgtgttgccaagggtcatcccacacccagactgttcggtttccattctcattccttggcattgccttttatagaactgctttcaaaagaggcattggggctgatgtcacaggatcactatgtgtttctcaggagtagggagggaatgaataggatttttcgaacattctataccaaattcactgccctccctccatttgatttaggacttacatcttcagcatcctctctttgttaggctcctctggaattgtctgtccccctggctagatcaagagcccctctgtatccccagaaccttgcagcttcaggcactttgcacgagataaataaacatggatgcaatgagaaaagggatgtgacaggtattggggaagacaagccagcaactgctctgggctctgctttggaagtgcctttcatttctctttagtttttttttttttttttgaaacagagtcaagctctgttgcccaggctggagtgcagtggcacgatctcagctcactgcaacctctgccttttgggttcaacggatttcttatggctcagcctcccaagtagctgcattacaggcaagcaccattacgcctgggtaatttttgtatgtttagtagagacggggtttcaccatgttggccatactggtctcgaactcctgacctcaggtgatctgcccacctcggcctcccaaagtgttgggattacagatgtgagccactgcgcccagctcatttctttttactctctatccaccacttgtcctagctcaaatccttttgagtctgacttggacagctgatgtcaccctctacctagtcttttttcccttcagtgccatttttccaactcttgtcagtcatttttatgctgtcattgcatccagacctgatcatttcttttctctttcctactcaaaacctttcttggttcactgtgactcagtgaataaatccatgacccttggcagtctaattcctgtttgtctttccagccttgccatcctgcccagctacctgcctcccatctcattccctgctaaatttgcttcttccttatgtgagttgaggcacacgctttcccttctgctgggaaggagtttccacccctctgagaccacatccaaatgttatctccttgaggaagccatgcatgctccctgccgagaccaaggagagaaaaccatgccttcgtctgggttcgcataacttttgtctacacttttgtcgtgtcatttactgcaaaagttgtcccccaagctatccttttatttacatttgcttattaatttcaagaattatttgagatagtattcaagttacatactagaggaatattcctatgaatataggatattataatgataataagagttatgttaaggaattcccataataaagggtggagggagagtggggatgaatttggggtcatgtaaatacaaactgcatatgctgtgatgtttagcgcatttgccagaaatgtttagaatacttatttctaaacttggacctctactttctaccagccaacactaagagagaaatatattgatatgatttggctatgtccccacccagatctcatcttgaattcccacgtgttgtgggagggacttggtgggaggtaattgaatcatgggggcaggcctttcccatgctgttctcgtgatagcgaataagtctcacaagatctgatggttttataagggggagtttccctgcacaagctctctctttgcctgccgccatctgtgtaagacgtgacttgctcctccttgccttctgtcatgattgtgaggcctccctagccatgtggaactgtaagtccatcaaacctcttgcttttgtaaattgcccagtctcagatatgtctttatcagcagcatgaaaacagaagaatacatatatcatccatatggttcacgatgtctccaggatgaaatgaatcagaagcagaatgactctgccaggggctgagacgctaaagaaatttcccttactttgtcacaaaggattccctaaatcatatcactatgtgttcaatggcatcgtctttgtaaatgtaacttcacattccgtgtgcctatttgcatctgtttgcaaatagaagaacacgtagcactgtctgagatcatgaggacatttagtattaggtttgtgcaaaagtaattgttttttgcatttaaagtaatggcaaaaactgcagttacttttgcaccaacctaatatttacctaaggattctagtggcctggggtcccagatgccttcaagcagttcagcagtgcaacatatatgtttccctttccttcatggctaatccaaacattgtatcctaaccccagcatctcaagcagggtggatagaaaagggcagtcctttttattagcaaagatgaatccttccagaatcttttcagaagactttcctttctattggccctaccagagtcacccaggtacacctagtaacaaaagggctagagaagtggctctgtccttcattctgggctggatggaatgccacgcgatgttctgctggtgtagaagagaatgggagaagtggaggaagggatctcaggaagacagctgggagtgactaccacggtagttctctatcacgacactagtccagtaaatcctgctttgcaggaggtaacaccagtgagcagctcgccgctgatgagatttattcccaaaataactttcaaatctgaagaggaatggctgctctgtatttcatttcagcaagtctccatggatattatttttctttccactgactttatttataacctgagctgcaggaagctggaaggagaagctccttgacaatatctggagcctgggcttgctatttgaccagttaaccctacgttttctcccttggcgaggttggggatgaggaaacaccttctctcctaaagatgggcctgatgaggatgcatggttcccaaggtgtgtggtgttggtcagggaggaatagcatgctctaggtttggcaggccgactcatttggcttaggccctctggctaagccataccggaatggggctcagtggtgagtcaatcaattggggaagcatcttatgtttggagatagcttaacagtaagaagtgagctaagggtgctgttattgcaagacccccatctctacaaaaaataaaaaataaattaatggggcattgtggtgcccaaattcaggaagaattttttttaaaaaaacctaaggcctgagtcacattttttaaaaattgaaaaagctgtgggggatcccagttcatgcttctctcttctcaatccaggatgagatgagcagcgcagcatctcagtgaagagtgatgtcatggacacagttgggagagccttcccttgatttgttattcttgagataggctgaagaaggaacatgagtattcagtcattagggatgtggatgggtacaccatgcagttgctcaccagtccctgtgtgggagaggcaaaagatgctacagctaagaaggattttggtgattgctgagatgcaaggaacattagcctagcatattgctcatctttccacactagctgtccctccatctgcttctgaggtaggaggtagaacttgactctggaccggattgaagactggttgaaacagggaagaggcactgaaagcacttctccatgagacatgtccatgagtgccgtgacagtttaccattgccatagcaacaccaggcagttactgcccctggctgtggcaacaccctaaagttacctcctgttttctagaaatttctgaataatccatgccttaatttgcatggtattaaaaagtggttataagtattactgtaaaattgcctctgagctgcacttctgggcaaactgcctggggttagccctgctctgcaaggagcaggaccttcgtgctactgtgcactgatgcctcaataaaagttgcaacaccaccagctcatccttgaatttcttcctgggcaaagccaacaaccctcccaggccaagtcccaactttggggctcacctgccctgcattacttctaccagctcttatcatcctatttacctgcatcaaaaccttaatgttaactcctgccgtgatgtcatcactactgaaaactcttgaaaattgagtacaattatctgtgattgtggattagtgtattctgagtaccataacaaaagactgtctggtttaaacaacagaaatttttctcgcagatctggagactggaaatccaagatgaaggtgctggcagggttggtttctcctaaggccatgctcctgggtttgcaggtagtgaccttctcactccctcttcacacagtctttgctctgtgtgcatatctccctggtgtctcttcctcttcttagggtccacttaatgagcctcattttaacatagtcacctgtttaaagagctcatctccaatatgtttacattttgaagcacagggagttaggaattcaacataggtattttgatgggacaaaattcagcccataacagcttgtaagtgctattaagaagactcagggctagcattttgggaggttgaagcaggaggatcaattgaagccaggagttcaaggccagcctgggcagcatagcaagaccccatcactaaaatagtaagaatattagctgggcattgtggtgtgtacctgtagttccagctacttggaaggctgaggcaggaggatcacttgagcccaggagtttgaggctgtagtgagctatgattctgccactgcactccagtctggggcaacagagcgagaccccgtatctttaaaaatatatatcccatcccagagtccaccctatagagaaacccaagtatttttccacttgttgaactaggaacatctgtggatattatgaacataaatattttattctaagcctctattgacctttcaattctctgaatcattgcaaaaattattctcagcagtctttatttttaccacctcagcaaaatgattctatctcagctccctgtctagactttaaattccaggaaggcaaggctgcatcttcatacctttttcctccaggtttctgagtgttggcaatgacactctttcggtaaatggaaatttgaaagagccaatgaaaaagaataatagttgaggagcaaaggtttctcctgcagtgggccaactgtccgtagcaacaaagacacatgggcaaacaaacagtgcttgcttctctttaggaaagaataattatttaccgtgaaagaagctctgtgaaaaaaaataacttcaatgtgtgtcaggtgaatatcctgtaaaggagactttttgaccttaaaaaatggtgagccatagctcagtaaaagctcattagggaagagagggagctagtctggggacagaatgtgtattgattgactcagaggttctctgagtttctctctataaaggcaatttgcataacaatgattacatattgggtttgaggcagttactgctcactggagtccttccagagtaactatttcggtggttgcagagccccctcagaaacctggctttaaaaggaaattaaatgtgaagggttgagttgctgcagttgttagccttgggaagggattaaaggggacgtttttgtcatgtgagatgtcaggaaaattcatgaggagctcactaggttgtctacttggaaaaaaacgaacttcttcctaatggattttgaaaaagattatttaatttgggttcaccattagccattctgggcaagggatggaggcgaatgttacccttcattcttgtagagaacagtgaattgttctgtctttacaaaaccaaacgcaattgaaatatttttttatgtgtaatttattgctctgcagacaatggagtggaaaagttatagtggttaattactccccaaaaccagaatattgagtgtgtgtgtgagtgtgtgtctgtgtgtgtgtgtgtgtccgtgtccatgacacaaaactgcttctaatttattaggcaatagtcattggattaggcaatgtaagtatgacatttggagaacagtgcagccccccaaaaaagtagaatgaacttttagataaatgagagagaaagagagggtgttagaactggataatgactcaacagagcaagaggtcaaggcctttcagtgctagtcaaaggacccaaaaaggccactccaagcgtgatggtcatataacttgaagtggaaaccagaaagtctggaaagaaggacaaagagcccttccgatatttttgctccatgttctatttttgttttgtttttttcttttccattgttttgttgagattaatttacatcccatgaaattcactctactttgggaggccacaggagaaggatcacttgaagccaggagtttgcaaccagcctgggcaacatagtgagacccctatctctacaagaaattaaaaacaaatattagcgtggtgtggtggtacatgcctgtagtcccattactctggaggctgaggtgggaggatcgcttgagcccaggagttaaggactgcactgagccatgattgcacagacactgcactccagcattcattgagagcaacagagtgatgagaccctgtctgcaacaaaaacaacatcaaaattcaccttaaaaaagtctacagttcaccactgtctaattctggaatatttttatcactctgaaaacaaacattgtacccattggcagtcactcctcaatccacccctgactttggcaatcactaatctattatttgtctctggagttacctattctggacacttcatatatatggaagcatacatctatttgtttttttgtcggcctttattcacttagcaaaacgacttcacagtttatccatgttgtagcatctatcggtacttcctttctttttatagtcaaatcatattccattgtatggatacaccacattttgtttatctatccaacagctgatggacgtgtgggttgttttgactttttggctgtgatggataaggctgctgtgaatcacttgtgtacaggtttttgtgtggacatgttttcattgctgttgggtacatacctaggagcggaattgttggatcatatggtaattccatgtttcacctttggaggaagtaccagactgttttctgaaacagctgcaccattttacattcccatcaacaatgtacaagagagcacttaaaattggatcccctaccatttgccaagtaccatgctgtcctcttggtgtgccttccattatatgggcttgtgttcattattcctcctttataggataagaaatggagactctgagagtttaacatatatgggaagagagaaaaaacatgcaatcactgaggttaaggctatatgatcaagtgtgagactggaaccctgaggttcttccgcaagagttggtggggaaaatgttgagtgcggcctcaagggcaggtgcagagtgctgtgaaacatagagtctgtgttcttcatagactgtttccacagactctgaccatcaagggcactttctcagaggtggaggataactgggacatggaagggtgtgtgtccatgtccatcacccttgagtgaaatatcccaactgttttgttcacctgcacgtacctgcagcctccagattgagctgggtaggtctgtcaactacggtgagagggccatatgattctccttggaatgtgaacacagggaaaccaacttatgtaaggtaatgcaacaagcaagcattgggcagagagattgtgtccagtgcaacagctggggcctctgcagggccaccagacttccctctgtgcttgcaactggaaatggagcaggagcaaagggaggaaggcaggagcctcgcaggccgcctggggtcctgatctgtgggtctgatcaggatcctgatctgtgggtctgatcaggatcctgatctgtgggtctgatcaggatcctgatctgtggatctgtggatctgatcagagggagaatggaacagggtgggctgggtcttggctctggtcactcaagctgaacaaggtggggtgcgactgggaagtcctcaagaccatctgtacatagtatcttctcacgcctgcctcagatcattaaccagcatagtattgatccataatttggttgtgttgcttctcaattatttgttggtcttgcaatttctgattttggctttgattattgtgaggtttgcagcagagaaggatataaacaaatagatcccaaagtaaagggctcctccaggacttctaaataagcaccatgtagcttgggcagctccagctgacctgctggagggaggaaaggctgatggtaccacccatacccgcatacctagggaggcctgcttacttcacacctgaagggcttggctttggcctgggctaagaggtgcacacctgggagagtgaccctgataccagaaagaagagtgatacagggattgtttccacgtccattccctgaagctccttagagatggaaactggcatttcaatgttggggcctcttaggatgtacatgttctgtaggtcatgaaacccctaaagggttccagagcttttcccaccaaaaacaatacattcaggatgtttttcaaagactttccacaaactctggccattgaggttatttttttcagaggtggaggataactggggcatggaaggtgtgtgttcacatccatctcccttgagtgaaatatcccaactgtttgtcttgttcacctgcacacacctgcggcctccggcttgagctgggcaagtctgttaaccatgatgagagacagggccgtatgtttctttatggaatatttacccccaacgtgcctgctgtttctttttctcatctgggaactctagcaagggaaggagctgaagtcacctggaacagctagaggcagaccaggtgagtgatggaatagtgaagattgaggaatctgcctggtcagatgatgcctcgtgctctgagaatcaccgtgacactgagctcttaggaaatcagctttgttggcatgttcacaggcagaattaggaccaatatctagaaggtataagatgttgcagacgttgattctacttaaagagcaatgcctgattagaaactcaaaggctgggcgtggtggctcttgcctgtaatcccagcactttgggaggccaaggtggaaggatcgtttgaggctgggacccagatagaacagcataaagatgctagcttaggatgtgagcccaatggggcaggctgctctggggggatcatggctgagtgtggacctctgcaggtgtttattctaaagctggattctgaactggccacaacgtggagggctggagtggccttggatgatcctgacagtctgggtttctgtgtatttggtcatttcttatttattcagggagttatttttggtctgttgaatttatcaattctccaagacgttggattttaccacttgtacatctggcggatacaccctaagctagtgtctttatattactatatctgggtctgtttagataaagaagaatttggcttcttcctttcttttttctggtttctgtgatgctgtagtgctttgagtttttattattcataatttttggggtgggagagggggacaggttctcaccctgtggcccaggctggagtgcaatggtgtgattgcagctcactgaagcgttgatctcctgggctcaagtgatcctcctacctcagcctcccgaatagctgggaccacgcccgactagttttttgtattctttgttgagatggtgtctcaacatgttgccagactggtctcaaactcctggcctcaagtgatcttcccaccttggcctcccaagtactgggattataggcataagccactgttcccagcctttgagttttcaatcaggcagtgggacctcacattttttcatctgcatgggtcacagggaatcacagaacttagataatgcaggctttggaaatctgctgatgttggagacacagtcatgtcattccacattcttgcttatagcctcatctgtcaccagaaagaagagcagctgaggcattcttcctacgaccattccctgaagctcttttttttttgtgtgtgtgtggggggtgggatatagtcttgctttgtcaccaggctggagtgcagtggtgcaatctcggctcactgccaccactgcctcctgggttcaagcgactctcctgcctcagcctcccgagtagctgggactacaggcatgcaccaccacgcccagctaagtttttttttcttttgtatttttagtagagacagggtttcaccatgttggccaggatggtctcaatctcttgaccttgtgatccacccacctcagcctcccaaagtgctggaattacagatgtgagccacctcttgcggccccctgcagctctttggagatggaaactggcatttcaaccttaggacctcttaggatgcaggatgcacatgttctgtaattcatgaaacccctaaaggcttccagatcttctcctcccaagaacaataaattcagtacggagttgcagagaggagcatagaatccaagcgctccagcggtcttagaccttcttgaatccacatccccattgtacgcatgtgagtttcttgtggaagggatctgtccaaggtcattgggctgaccagggctgaccagggtgaagtaggcccagggatctaggtttctgggttccttggtgttatcctaatgtctgaaccacatcctcagcttgctgagctatttttgtttatctttctttctttctttctttctttcttttttttgttctgtcatggtaattgtttttctagcatgatcactagaatagcagtagttccacatttatctgccctcttacagcagactttttggaaaaattgcctctttctgctgccttctgttctttgcctcttgttctctcttgaatctacccaggttttggttttctgaaattggtgctgtgaacatcaccaatgcattggctttaccaaatgcaaaggtccattcttggaatctaccatttccagggtttccttctacgttcttctgttttctttgcttggcctttctttttctgattctatcagttggtgtgtccagggctcagtattcaaacccctttctctttgtgtgtttctactgcccaggtcttctcctcaaggaacttgtctttaaactccatttagactgtggtgaatcccaattttctatctccaattctgacttctttcctgaactcccatgtacttgacagcttcatttggatgtctactaggcacctccaatgttgtatgtcccaaccaaactcttgattccatgttacatcccttcataacccaagtcccttttctcccccttctccatctcaatcaataacaccaacattcaacatcctttgttgctcaagccgtacatgtataagtgagttgttcttgaatcatttcttactctcacatatctttgggtaagctgaggtttggctgatctgggttttcagctgggcttggttctaagccacagattggatcttactgtttcatgtgtctcatgcttcttggatcagtgggcatcccaaagcatgttgtcatggtgatgtcaggatgaagaggctagaagcagcaatgcaagctcatttcaagtctctgctcatgacacatccctagtattttgttggctaaagcaagtctcgtggccaagctcaaaggctgtgggtggggaagtacactcagctcagcaaatgatcaagtccaacattagtggcgtgaagatgtttttgttgagcagatacatactctctgccctcttcacatgcatactcttcccctgaattgtgtgcatgagaagagggcagtctgcatttgctgaacaaaaatgtaatgtgccacctcagataatttttttttaaattgagatagtgtcttgctccatcacccaggctagagtgcagtggcacaatcacagttcacttcaacctcgacctcttgggctcaagcaatcctcctccctcagcctcccaagtaggtgggactacaggtgcatgttgctgtgcccagctaattttgaaaaaaaaaaaaaaattttttttttagagatggagtcttgctatgttgcccaggctggtcttgaactcctaggctcaggcagtcctcctgccttgacctcccaaagcactgggattacagatgtgagccaccatgcctggcatcagataagttcttaaaggaagaaatctacatctaagtaaatgggatcttgccaagagggtctttttatgaagaattggatgtgtatttaaaattgatagtgcttctgaatacctctttagaacagatgctttattgtttcagattctataaattaattagagatgatggtggtggtggtgggatgtgtgatactgatgattttgaagaggggaggaaggtagcaacattttattagggtgatccgtttttgttctgccttactcttccttatccttctgatttcataatttaccttctatgatatgaccagaattgttgtcactcaaaatctctaatcactggggatgtacccacgtgatagcagaaatttacatgcttttgggagaattggtgaaggttcgtgtcccactctgtccctcctctttagcccctccgattaggaataaaaatgctagaaggagtgcttggagcatagtggaggagagagaattttctccaaaagttgttgagactgagaggggctgagcaaatgcagcatgtgacctggtgtacagtgtcaagcacacatttgatgctgacaaatttcttaggtcttggcagggagagtgcttattcaattcagcatatttcttacctgctcctagatcagcctttttcccccttgtgcagctttataaatgctaggaggctaagtaacacaattaacctttcatccatctgctctgagaaaattctgaaggttcccaaactcttctttatttggttagaaatattctttgcacagacactcttgggcatatcagcagccagagactgtccaagacagacatacgtgtttatcttctcctcacacagggggatatttgtggcaatgtttgttcggtgctgagagtgaggttcgggcctttgagatcctcgccatcacagtggcatgaaatctgagagagcattgccttaaggcatgcctggtggcctgaaatacagagaccctgttctagatctaacacttcagaacattcttcattgtcttcgtgcttcaattttctcccctccctccctccctccctttttttgagactgagtcttgctctgtcacgcaggctggagtgcagtggtgcaatctcagctcactgcaacctccgcctcccaggctcaagcagttctcttgcctcagcctctatattggctaggctggtcttgaactcctgacctcaagtgatctgcccaccttggccccccaaaatgctcagattacaggcacgagccaccacacccagctccctccctccttccttcctttccttccttccttcctttccttccttccttccttccttccttccttccttccttccttccttccttccttcccctccctccctccctccctcccttccttccttccttccttttttttgagacagagttttgctctgacacccaggctggagtacagtggcacaatcatggctcactgcagcctcaacctcctgagcttaagcagctctctcacatcagtcttctaagcagctgggactacaggtgtgtgccatcatgcctggctaattttctttcatttttttgtagagacaggtctcattatgttgcccaggctggtctctaacttctagcctcaagcagtcctcctgcctcagcctcccaaagtgctgggattacaggtgtgaaccatcatgcctggcctcaattttcttatctgctgactgtggataaagctattcggaggatcaaattaaataacctttgtagagcaattccaggaagtataaagttcataatacatgtaagacatgtcattttgaataaaaccgcagtttgaaaatttatggaacgtttgctccaaaggcacttcaagcgtctaacaatgattcatatctcttggaactacaaatgctacatgagcagttcagttaatgggcgaaaatgtacctccagtattcgtggctctgagggaagcacaaatctagagacctcttagtccttgttttgtcttctaggacagaatttaacagtggatcaccatgtgttataaaccaagttttgtcccccgctgaaattcatattttgaagccccaagcctcattgtgatgctatttggagatgaggcctttcggaggtaatcaggtttatttgaggtaatgaaggtgaaactcttataatgggatcagggtccttataggagaggaagagacacaagctctccctctctctgtcatgtgaggatatagcaagaatgaggccatctgcaagccaggaagagagccctcaccaagaaccaaatctgcgtttaccttaatcttggacttcccagcctctagaactatgagacataaaggtctgttgtttaagcctctccatctatggcattttgatatagcacccctagctggctgagatactgtggaaagtatgaaaacatggtcatattaagatggctgaaggagtgggtgtgtttagcctggaaaaaaaaagaagataaaaggacggttaatgatatgtcttgataatgtcttgtaatatttgaaaattacatgataatgatatgtcttgataatgtcttgtaatatttgaaaattacatgaaagtgtaatctgcatgattgatgtagaagaaaaaaataagatcattgggtagaagaaacaaaggtacccatttttgaaattttatttatttgaactataaaccaggaatgcagtgtaccacaaggtggtggactctttgtccctgggagaatacagtataagctgggtcgccatcactctggaatttctgcaccaaatggggttgtggggctagctgacctctcctttcttccaacccaagattctaagttggactgcaggtgtactaattgtcctaatacttagggaacattttactccattctcttccaccaagcagcagctgatacaattgaactcttaaaatttcattcaagatattaataacctttggacatcatgtcagggaagcactgaaaatgcaggagggaaaatgtcaaaatcatcatcataattcagttgtcaacaaatatcaagatcatcgtactgatatatgaactagggaatcaatgatgatttgacatgagttaatgaaacggcgcttacccatttctgacatgtcaccaggagatttctgtatgcacagtagaatatgatgctaaatttggccagtgcagtttataatgcactcattcattcattgactcactttggtcattcagccgtccaatcgtatctatgatatttacgaggtgtttgctatgtgcaagacacaaagatgccttcctgttcacaagagaccagtgctcacgcaagtgagcagtcaagggcacatagactatgatatcagaaatgttgtggttgagattttcaccagcctctgactttctgggttggatagtgtccagaaaggatttccggggctctgttgagtagcagggaagactggcagtggtcctgaagggcagcagctttttagaaccatcagaggaaggtttgggtaccttaaacaaaggaaacagcagaggacgaggctgggcaaggactccactaataagcagctttgcatattacgtgaaaactttgggattattttccataggcagcaggaaggcactaatgaatttcaagcaagcagtgttcagatttgcatgttggaaagctcactccgaagatggtgttaggagttgcctgcaataactcaagtaagcggtggcttgagcttgcatctgggtggtggcagaagagatggagaggtgagaatagggtcaggagatattcagagttcacaccaagaggcccagcacagtggctcacacctgtaatcctaacactttgggaggctgaggtgggcagatcacctgagctcaggagttcaacactagcctgagcaacatgtcttaacttggtctctactaaaaacacacacacacaaaataagctgggcatggtggcatatgcctgtaatcccagctacttgggaggttgaggcaggagaatcgtttgaacccaggaggtggagattgcagtgaaccgatatcatgccactgcactgcagcctgggtgacagagtgagaccttgtctcaaaaaaaggagttagcaccaagagtcatttgagtaacaatttaaaaaatattatatttattaatttaatgtatatatgaatttaaaaatatatgcgtgcgtgtatatatatatacacatacgcatgtgaatttaaaaatatacatatagcacacatatttagcataaattttgtgtacatgtaataattgaagtgcttattatagtgctttgtgtctaatagacatttgtcatttgaactaattatcactaataattgtatccaaaatggggctatcttttcttttggcaatatttcctgacaagctcttgtgttccattgatcttgcctatcctttcctagtccattatttcaccttcttaattattggagtttttcagtgtgtgttaatagctggaaggataaactgtatttttcagatacttacctttattaccatactggattctaagaggtggctcctcaaacccccaggagtacattgaaattggccaggagtaaacctggaatgttgctcactgttaagcttatggctgcaatggctgcaatttgtgcattgtctataagttttattgacttccagatgatctagcataaggtaggatctccctgagacgcggaccggcaggagggctctggcctctctgcagaaacttccaaacaaatgcctgcccagtggaagacgggctgcatgacatgctggctctttggcttagagagagagagatttactgcatgctgggctggggctgctgagatgatgaggagctttatgagttgacaaggcaccagattgcattttgctgtggtcaccatctatcctggagtttgtgcctccatcgtgtgtaccatctctatttctaaaagaataatgctggttatctgtaaacccataagtttccgctgtaaccctggagaaaatcatgtcctcatttgtatgaaggaaggtgggaaggcagctcagagtcaatttacaaccttgactcttttgttttgccaccaccatcgagccttcatagcttgggctgaacttaaccacagacatcggcagagtgatgtgctcttgctgagcggtgatcaaccgtgtggccctcagaggatttctgggttctgtgtgagatggagctgctccatcattcacacaagatgtcgtgcaaaaatgagtcgttggcttgcctgcactagaagggaatttctaaaatttcaaaagtggaggttatttttatttatgtttcaaaaactggatgactacctgagaaaacatatattttacagcctcacctgccaacgtatatttaaaatttcctcccagtcttcataccactttagtgattattgctttattttctagcttaatatcagagaaggctaccccttttctgtcttttgtttttttaaaacaattctaaattttctaacgtctgtgttcttctaggttaattttagaacgttttattgtgttgcagaaaaaaaaatcccctttgaaattatgtgaaacctatgtattaaaaaggcagtggatgggtacagtggctcatgcctgtaatcccagtactttgggaagctgaggcggggggatcgcttgagtccaggagtttgggacctgcttgggcaacatagggagacctcatctctacaaaagttaagaaaattagccatgcaggatggtgcatgactgtattcctagcttcgcaggaggctgaaaaaaggaagatccctcgagcccagtagctcaaggctgcagtgaggtaagatcacccccactacactccagcctgggtgacagagtgagaccccaactcgaaagaaagaaagcaagaaagagagagagagaggatctcctaacaatctcccaacattccaacttccaactcaaagacgtgttcttctctgccacttatatatgtcttattttattgcatttagtaaaattttcaaatattcttcttactggttaaagttattcctaggtatactgtaatatttgttacttttagaaatagatttacttacattgtatattctagttggtttttgctgaattaaaaaacactattaatatgagatgtctacttgccccagcctgggcatccttttctagtgacagctgtatctcgtgactcatttccttatcaccctagaaacacttacttcactgacactgtctcagaggtcaccagtgcctttcattgccacaccaaagggctcttttcaggcttaattctctgtgacattcatcagtagagattctcttctttgtgaccataaatatactacaatatttaatatattcaacacctcttttcctattagatgctttccttatggatatttaatttgctttcttaaagtgaaatactcagtttgtaatagatggcctgaagctggttctccagatctaatctctattcatccatctacctaacagtttttaagaactctttgtgtgtcaggcactggaggtgaccacatgtatgccattaaggagagcacctaaacatgggaccacaggagaagtcttccagttgtgattggtagtacatcagtcccttttcacgctgctgataaagacatacccaagactgggtaatttataaagaaaaagaggtataatggactcacagtttcacatggttggggaagcctcacaatcatggtggaaggggaaaggcatgtcttacatggcagcagacaagagagaatgagagccaattgaaaggggaaccccttacaaaaccatcagctctcatgaggcttatttactaccacgagaacagtatggggaaaactgcccccgtgattcagttatctcccactgggtccctcccacaacatgtgggaattatgggagctacaattaaaaatgagatttgggtgaggacatagccaaaccatatcaggtaggatgctgtatctgtgaggatacagatacagcatcaagactttcctttctggcaggagacaggtagcacactcagaaggggcaattaaagagaggttaccaaaatatttacaaagattgtgaagggttaagggaaaccaataaggaatgacaagggttagtgaatgaccccagggctagcaacagagagggaagaaattgccaccctaaggtctgcagaggcaagaggagggagtggttaacagaatgcaaggatagctgtaaacctaagagaggcatgcctgataacaactggattatagaagatttagtaccttctactaaaccccagcccagtagggaaagagatgggagaataagtacacctctctctctttccatccatctgtcaagaagtgtccttatgttgcctcctattggttcatctcaacccaaagccaggggggcaggtgaacctatagctgtccctataggtctttctcctagagtatgcaactgggagaaaaaggatggagaatagatctggagtgaagcatgaaggatatttgatatggttgcagtaggatgactgaccttaatctgtccttcctctctttatcttcgagttcttacctaatagtgccacttggctttaactgtcgtcagctgttaggtgcaaaagttattgctgtctttgccattacttttagtggcaaaaacgacaattagttttgcaccaacttaataaaataactcaggcggaaaagaagggaacaatgaattctcgcaggcctggtgccaagaagccaccccattctcttcctgctttctctctttgctgctgcttctccccctttgactttgtgactactctgcctacaagttcagtttcattcctcaaagattgcggctgcctctgacgactgagcaaggggcacttgcagaaaagaaggtttcttgggtacacgaaatcatcccaacttgctccaacggcaacctttcctggctaagttaagaccaacttgagttcggctggtggacttgaactcttatttatctttgccaacagtttctggggcctgcaaaataagcacgttaaaataccagtgatttttttttttttttttgctgctttgttgaacctttgtggcagattaagtgggggtgaaaatggaagcacatggaccaaaaaatatgtaattcacaggtgtcacatcgcactgtgaggaatgatctttttggaggctgttaagtgaatgcctttcataatggaagcaataatgccacataaggagaaaaaaatctcattgggaccatcattccctgtgtctccttggtgggatatgcatgcatgcttagtcttaatttctatactgttttataaaaaaaattctccttctggcccctctgactgcattggaaaggctgcccagggggttgtgctaggcaaacacatctgaaatgcattttagctctaaggtggaatttaatgacttgggattggaagctctctatttagatggaacaaaagatatgctgtatcgtcaagtgaagaaaaagacaagccaacccaaccacacagattaagttagaggaagaatcagaggtttttctgtggaagctgcccagttaagtcaaaggtcaggaattctgtcccattctgatagtgtctcttgccttgacccttgggagtgtgtggcttgtgaggggaagttagcaagtactggggaagggaaagggaaaatccagggcgaatgagtaagagcacacagaataaagaggaaaaaagcatgcttggtagtcttttagctgtctttttcatcatgcagtattggacacattatatgtatgacctatatatgtcaggctgtaatcgtacactgaggaacagctgtgcccatctcgcagctttacagtggagcgtgtctgtattagtccgttctcctactgctattaaaaactacccgagactgtgtaatttatgacgaaaagaggtttaattccctcacttccgcaggctgtacaggaagcatggtttggaggcctcaggaaacttagaatcatggcagaaggcgaaagggaagcaggcacaatcttcacatggacagagccaggagagagagagagagagaagggggaagtgctacacacttttaaacaaccaggtctcatgagaactcactctatcacaagaacagcaagagggaaattcgaccccatgatgtagtcacctcccatcaggtccctaccccaacactggggattataattcaatatgagatttgggtaaggagacagagccaagccatatcaatggccatataccttggaggtcctttgggtgtcctccaagaatatatatatgtatatatatatgtatgtgtgtgtgtgtgtatatatatacacacatatgtgtgtgtgtatatatatacgtatatgtgtgtgtgtatatatatacatatatgtgtgtatatatacatgtatatatatttgagatagagtcttgctctgttgcccaggctggagtgcagtggtgtggtctgagctcactgcagcctccatctcccaggttcaaatgattctcctgcctcaacctcacaagtagctgggactacaggtgcacaccaccacacccggttaatttttgtatttttagtagagacaaggtttcaccatgttgaccaggctggtcttgaactcctgacttcaagtgatccgcccgccttggcctcccaaagtgctgggattacaggcatgagccaccgtgcccggctggacaagtgggatttctgaagtcaaacaggaaacttgaacacttagttattttttttccagagataaggtcttcttattttttattttatttatttattttcaaagacagggtctcactctgtcatccaggctggagtgcagtggtgtaatcatagctcattgcaggcttgaactcctgagctcaagcaatcctacctcctcagcctctcaaggagctgggactataggcacaggccaccacactggctaatttgtttattttttgtagagatggtgtggggtctcattatgatgcccaggctcctctccaactcctgggctcaagcagttcctctgcctcggcctcccaaagcactgggattacaggcatgagcctctgcacttggcctgcttgcttcttattaagacatttctctcttccttaagtctcagtctcttgaagtcttggggttcaaatatagcataactgagaggccgtgcatatagagcagaaaagaaaaaagtttcgccggatgcaattcctcctgtttggtggaaatagacaagggatagggtagtcagtgagcacttgctgaacattgcctatccttccccttcttgctcctgggctctcctctctgcaccctctgccacggctctagcctgcttgtcctgatggcagtgaggtttgtatctcaggccacctctgctgtctgaacctccattctcatgtgcttcaattttccactggactctgacgccatctggatgtcccacggatgcctcgtgtaccacatgtgaagaatggaactcattgtcttctcacactctcttctgtatgccctgtctttttgggcagtgttatcactcacctggaaactcagttttgctcagttcctccttctctttcagccttatctcttgtttatctcctaccctgggatggtatctcttaaacaaccctcaaatctctccattccttttgatcactgaccgctgccttaaaataagcttcctgccatctctcgcacaggctgctgcaagaattctgcaacaggtctcataatctgcctcagagcccggcctttatcctcctttaattgccatggaacctttaaaaagttcctatatttggccaggtgtggtggctcacgcctgtaatcccagcattttgggaggccaaggtgggagaatcatttgaggccaggagtctgagaccagcctggggcaccatagcaagaccccatctatacaaaattgttttaaaaaattagctaggttagtgtcacgcacctgtaatttcaggtacttgggaggccgaggcaggaggattgcttgagcccgggagttcaaagctgcagtgaatgcgctgtgattataccactgcactccagcctgggtgacagagtgagaccatcccttaaaaaaaaagttcctacgttcctacattctcagacccagtgtcctcgtttgtgaaacagagattgtaataataccttccccctgagcttgtcacgggattagatgagacaatggtagaataaaagtgaaaaattgctaaattgcccaccacatagtgagtactgaataaatggttgctgtcactactgttagtgcctggggtcagtccttgtgctgttattggccacacttcagatcttgttactttccttctttatttgtcacttatagataaaaagctaaagtcaagggacctagggctgcagaatgacttttgtgggcccagagactttagcctagatgggctccttcctccatataaaatactaaaaattagattttatgaccctgtttctatgattgtcttgagtactctctgaagagcttgtaatcttaaatggcaattctctgatctctggagactgtgtaaattcagacaaacatatgtgtagtctcaagtcctggattgcaatttttgcccctagttctgagcatatccatcttcttgtttgtctcattacgctgttccttggatttggggaaaaaaaaaaatccagtctttcagggacctaaatttttgcagatatttcagtttcaatgatatttctcaagagaacccaaaatctcatatcctgtgcacgcttgagctctgaaactgcagcttttagttaatgagcaactcatcctctccctctctgagagcagacatagactcaactccgattttaacttaccttgaggagtttccctttctttcttgcaaggtcacctatatattttaaatattttaaaatcgttttattgagtgtttttaggtatcttgctggaaaattctcatgttggatagcctttcatcttgctgtgaatagaattgtctatcataagtgttcttttcttaacaactggtttgagtttttgtttgtttttgtttgtttgtttgttttgtttttgtttttgagatgaggtcttgctttgttgcccaggctggagtgcagtggcgcagtcttggctcactgcaacctctgcctcctgggttcaaatgattctcctgcctcagcctcccgagtagctgggattacaggcatgcaccaccacacccagctaattgtatttttagtagagacgggattcatcatgttggccaggctggtcccgaactcctgacctcaagtgatccgcccacctcagcctcccaaattgctgggattacaggcgtgagccatggcccccagccatactgagatatacagctcatatcactcatctatttaaaagcgtacagtttagtggcttgtagtatcttcacaaatttgtgcacccatcaccatgagctaatgctgtcacattcccattactccaggaaaaagtgctatacatattaacagtcactgtccattttctccccaagttcccccttccctactgaaagcaaccatggatctactttcaggttatacagatttacctattctgtacatttcacataaatagaatcactatatggtcttccgtgactagcttcatttacttgtcataacattttcaaagttcactcatgccatagcttgtatcacaacttcattcttttatattgcccaatattccattggtctggagatactatattttgtttctccagtcatcagttgatggacatttagctaataagaataatgcaactgtgagcatttgtgcacaagtttttttggggacgaatgtttccatttttcttgggtggaaatttcttaggagtggaattgctgggtcatatggtaactatatttagcattttttgtttttgtttttgagacagagtcttgctcggtcacccaggctggagtgcagctgtgggatttttgctcattgcctcctaagtagctgggactacaggtgcacatcaccacactcggctaatttttgtatttttagtagagactgggtttcaccatgttggccaggctggtctcgaactcctcaggtgatcacctcagcctcccaaagtgctgggattacaggcgtgagccactgtgcccagcctatattaagcattttgaagaacagcccaactgttttccaaagtggcgggacaactgtacattcccactagtaatgttgcatcacaagtgattttaaaaccaagcacaggtgtttgtactcaacatgggaagaatctttgtggagttttgagcagagttcaggggttgtcatttgaagatgtgttacacatcagtgtggaagcagattcagcatgagggagcaggtagaaagtgctggagtactctaattctccgccgatagggtctctatggagatggtggcagcaagaaaagataccaggattcctgaagagcatattggacggtggaaatgattctcaagcagagaaatgatgctcgtctgacggtgctcgttcaacctttgcttttgatcttggtattacagaaaataaatttctgttttcagagaagcaggagagggaatacaagctttgccactaggtgatggggaaccgtctcactaccggagcaggtttcctggctcttgacttgcttaggggatgtcttcgtgggagatttggatccttctgggcgcttccggctgcccaggctgtgaaagccaaggaggctggtccttctttctgtcagtggcagcaatgaaacactggatattggatctccatcatttaaatggataaagtggtgtgtgtgtgtgtgattgtgtgtgtatgtgtgtatgtgtgctgagtagctggaacatttgaaatggcagaaggcaatgagaacccttaacaacaaaagttttctagttaagtaataaaacctcccataactccaggatttaaaaattgcccatcaagctgtttatcctctaatggaataataggtttaaggtgtcaccatcctgggagcttgcaattgctcagtgaggcttgttacagaggcctccaagtctacttggcactgttatcacccgtgtgggttttttcctctcctctgtgatttattctcaaacattttgtatttcctcttgccatttagataaaatttaaataaaaccattagggaaagagctgtgtcagaatgttggaccctttaaactcaagataaaaatcaatctgtatgtcactttctgttcaaatgaagcaaaagcatctgcagtttggcagttatctgtgacttgctgtttttattctgtgctatttcttcttgctgtagttcctcctagcaaaagggaaacaggcgtgaataatggccccagttctgtctcatttcctatgtcctctttcgtcctcatttctcccagtttagatggtctctcccttttacagacccccatctcatcccagtccccaaaaggagagagaggattcttttatatttatttatttatttttttgagacagagtcttgctctattgcccaggctggagtgcagtggtgtgatcttggctcactgcaacttctgtctcctgggctcaagagattctcctgcctcagcctctcgagtagctgggactacaggtgtgcaccacgacgcccagctaatttttgtattttttggtagagacagagggagaggattctaaccagactttaaccccagaactctctgtgaccttgaccttcctctcaatggaaatgttttcagggcctatacctgagttggataaattgaggacatcattttttctgtgacaagtaatgttaaaatgtctgttgaagctgcagcggagattgagtaatacatcctggtatggtggttttctaataattcttttttctcccactttttctaggcttatccaaatcccttgggctcattgaaggttatggtgggcggggtaaagggggccttccggctactctttccccggctgaagaagaaaaggctaagggaccccatgagaagtatggctacaattcatacctcagtgaaaaaatttcactggaccgttccattccggattatcgtcccaccaagtaagttctggttcagtcatttgcggagcttgatgggtcgtcagagtgggtgtagacccctacgtttgtgatattttccactgttatttgtaactcttgggggagtttttattttagtttcctctttaataaataaacttagtactcctgttgcatatgaaagattagctaaacaaaaaagttcagttgttatcaaagtgttccagaaacatatagaaagagcctcaatacaaaaagctttgtattttaattcttcttcttcttcttcttcttccttcttcttccttcttctttcttcctttttttttttttttttttttttttttttgagacagagtgtcgctcttgttgcccaggctggagcgcaatggtgcgatctcagctcaccgcaacctccgccttttggggtttaggtgattctcctgcctcagcctcccgagtagctgggattgcaggcatgcaccaccacacctggctaattttgtatttttagtagagatgggattttatgcctttggtcaggctgatctcgaactcctgacctcaggtgatctgcccgccttggcctcccaaagtgctgggattacaggtgtgagccaccacacccagccattattattcttttaatgtttattttatgttcaggggaacatgtgtaggtttgttatataggttaattgcatgtcacaggggttcagcgtacagatcatttcatctcccagataacaccatagatagtttcttgattcttacccttctccctccctccactttcaagtaggcctcatgtctattgttcccctctttatgtccatgtgtactcgtcgtttagccccgacttataagtgagaactggtggtatttggttttctgttctgagttagtttgcttaggacaatggcctccaactccaggttgccgcaaaggacatgatgtcattcttgtttatggctgcgtagtattccatggtgtatatgtgccacattttctttatccagtctactattgatgggcatttaggttgattccatttctttgctacagtgaatagtgctataatgaacatacctgtgcatgtgtctttatgatagaacaatttatattcctttgggtatatacccagtaatgggattgctgggtcaaatgggtctgctttgagttctttgcggcttcaccaaattgctttctacaatggcggaactaatttacattctcaccagcagtgtataaccattaccttttcttcacaacctctccagcatctgttattttttttactttttaatgataatcattatgactggttgaaatggtatctcattatggttttgattttcctttttctaaaaaaaaatcaccatgatctcatcccttggggacagcatctattgaagttttagtgtattgtctttgagtctattttctatacagattatgagcctatgatatctcactttttccctttttcatttaacattaaatcgtgagtattttctgatgttattgatgatctgtttccattgttggaaatttaggttattttcaatttttcattattatatataacattctattgaatattttttcactcatatctttatatgttttgatttgatatttattttctgaatccacacttctaaaggtatatagtagagggatatttttggagattcttgatacgtattataatattttcctccagaaaatctatagtaattctactcttgttagaattttactagacccttccaatactgggtactagcatgtaaaaaatgccaaactgataggttattgtttcaacttacacttttttgcatgagattcttgccttttaaaaagcgtgaggctggcagggcacggtggctcacgcctgtaatcccaacactttgggaggctgaggagggtggatcacgaggtcaggagtttgagaccagcctggccaagatagcaaaaccccgtctctactaaaaatacaaaaattggctgggcgcggtggcaggctcctataatcccagctactcgggaggctgaggcaggaaaatcacttgaaccagggaggcagaggttgcagtgagccgagatcacaccattgcactccagcctgggtgacagagcgaaactccatctcagaacaaacaaacaaacaaacaaacaacaacaacaaaaaaacttggggctgagtatggtggctcacatctataatcctagccctttgggaagccaatcgctttgggcagatcgcttgagcccaggagttcgagatcagcctgggcaacatggcaaagcattgtctctacaaaaaacctaaaaattgcgaggtgcggtggcctgtaatcccagcactttgggaggccgaggcgggcggatcacgagatcaggagatcgagaccattctggctaagatggtaaaaccccgtatctactaaaaatacaaaaaattagccgggcgtggtggcgggcgcctgtagtcccagctactcaggaggctgaggcaggagaatggcgtgaacccgggaggcggaggttacagtgagccaagatagtgccactgcactcctgcctgggcgaaagagcgagactccgtctcaaaaaaaaaataaataaataaaaaataaataaatatatatatatataaattagccaggtgtggtggtggtgcatgcctatatagtcccagctactcctgaggctgagggtcacctgagtctgggaggtcaagtctgcagtaagccatcgtggcaccactgcattccagcctgaggaagagagtgagacactgtctaaaaactatttgtgtgcatcttggttggattatgagaggtctttattttgtgctctcagatttaagaattacttattttctgcttgtaaaatagacaaaagaggatggacatagtgtcaagatgctggagagaaaacccctgtgttccaggcagaactccacctccgcttctcaaacagattctccattttctattagatttgtagtgtctctctttttctatttagagtgtgtccttgcttgaagtagattatttctttctcaaatgaattttgtacaaatcagttaagtgtcttggttactgagaaaaatagattcaaaataaagaaaattatcttaaatggatttaaatttgcagcattagctgagaaacctgttaaatctctctctctaccaaataagcatgtattcatttagaatcactaggaaaatatacatcacccctgctggaagctattttgtgtccctggacttttgctctccaaaacatctgtctgtttttatttcctgatgctctctcattagcctttcttattaggacattggcaaataaacatggccctatttttttgtacttctataagaatgaaaatgccttcaaaacgaggttactggaaaagagccggttgaacaagtattattgagcacttattatgagccagatagttttctccccactggagatagacacttggatgaagcacagtccttgcctacttacttcttgtctagggaggaagacagatataccagcagatcaggtcagcacaagggtatgtgccggctagagattcacacagcatgtgcagtgaggatctgagaaagtttcttgtttgagataatgcttgaaggaccattaagggatagaaagttgaagatggggggccaggcgtggtggctcacgcctgtaatcctggcactttgggaggctaaggcgggcggatcacctgaggtcgggagttcgagactagcctggccaacgtgatgacaccctgtctgtactaaaatatacaaaaaaagaagcggggcatggtggtgcacgcctgtggtcccagctacttgggagactgaggcaggagaatggcttgaaactgttaggtggaggttgcagtgagctgagatcatgccactgcactccagcctgggtgacagagtgagactctgtctcaaaaaaaaaaaaggaaaattgaaattgggagagggataagggtggaccaggcgggagaacaaacagaaggagcacacttggttgggtatgacgtggcatactcagggaggaacccatggcccaatattgccgtgtgatgtaacatgatggcttgaacataccatttacatgtgaaccttcctgaaaccctattaaaatgatagcaaaggaatagagagaatggcaacttacaaggaaaaaaaaccacaacaggttgggtgatgatcacagggaagagagacatgtacaaaattttggaagatggaaagaggatggtaatggcaactgacagagcaagctgggtgaagctgagacccaacctcccacatgaggtgggtgggggtttgtaagagcagaagaatgcagtctagccagaagcccctagagactcaagaattggagatgacaggcatttctgatggccgggggaggggagcagatttgaacagaagggatggttagcagttatgtccccagatcctttcttcaactctgcacagccagagactgccctttctcatctggcagaatatgggaggtttactccctagagaagatgaactatagttcatagaggtggccttggacagaggataacaaggctgcatatgaaatgggatgacttcccagctccattacctctctagtctctattactcctgtaagcaagagtttgaagaatccacttaaaattattcagcctaaggaaaaggctgatagatctgacagctggtggtacccctaaaatggctgggttctgctcattaactattagtatggcatgcgagttgtaaggcttcatccttttgcataaagcagtcctgctctaaaataagaaaggaaaggcaggatcactagacatctcagtagagtctttgttataaaagatgttaacaacaacaacagaaaacagtaaacagaaacaacaaactttgtttctgtttaatgacttaggagatcatagaatgttttgttttgtttataaaccaagagcaaatagatatattaagataataatcataaggccaggtgcagtggctcatggctgtaatcccagcactttgggaggctgaggtgggtggatcatttgaggtcaggagtttgagaccagcctggccaacatggtgaaaccctgtctctactaaaaatacaagaaaaaattagctgggcatagtggtgcatgcttgtaattccagctacttgggaggctgaggcaggagaattgcttgaacctaggacatagaggttgcagtgagcccagattgcgccactgcactccagcctgggcaacagagtgagactgcactgcacaaaaataaatcatagaataaaaaataaatcttaaaagttaaaagttagacctgtagtcctagctattcagaaggctgtgacagtaggaacacttgaacctaggagttagagtccagcttgggcaacatagcaagaccctatctcttataaaacaaaaattaaacggagataagtaatttaataaagagttggaagacagcattgagaaaagttctaaaaagtagaaaaaaagaaatgaaaattaggagtggaaagatcaaaagaaattagatcagtccagtaggttcaacatccactaatgagaaaatcagagagaacagagagaagaaagtcatcaaacaaatgatgcaagacaatttcccagaatccgtaggatgtgagctttcagattagaagatcccacccagttcctacataattcatgaaaagaaaaaaaactaaactcacatcaagaaatgtaaatttaaaatttcaaaacaacttggatgaagaaaaagtcctgaaagctttcagagaataaatgcagattacatatagttggcattagattcctctgtagaaacattagatgacaatggaagaatgcttaaataattttgagagaaaaaaataatgttccatttagaactcttaacagtcatctatagaatactttgggccaggagcaaatgcaaagtaaacccatcgcaaaaatgtaggctcttaacaattttacctcctctgaatttgttttgaggaagctactcaagcacatgctccagcaaaacaaaggagtcaagtgaggaagatgatgaagagatgctccagggtaacattctagggtgacagccatgtagcagaccaagagatcaattattcccacatctttagagagaaacctcctagaggctcctgtggatgcaggaggatgcagggctccaggaggtatgtctctaaaggaggtgggaagtggcaacattgtttgattgcctagagtttgtgactacattaagattttttcttaactcctcgttcaaaaagcttgggactgtttactgattgtgttaggccattgtgttgctataaaggaatacctgagactgggttatttataaatataagaagtttaattggctcacttttctgcagcctctccaggaagcatggtgcttggcttctacttggcttctaaggaggcctcaggaagcttacagtcatggctgaaagcaaaaggtgagccagcctgtcacatggcaagagtgggagcaaaagagagagagagtgggagatgccacacacttttaaacaacaaaatctcatgtgaactcactcatcatccagaggatggcactaagccatttatggagatccacccccatgatccagacacctcccactaggccccacctcccacactgggaattacatttcaacatgagatttggctgagacatgcatcccaaccatattactgatagacacaaaacagcttgtgaaaaagcaaagcaattaatacagaaaaaaaacaaaagctctccaataaacaaactatacttcccatatactctgtagctcagctctgagcaatatattgtagtcataaaaatgtaaatatttcatattgatttaaacacaaattatggtataattattggaagaaggaggaggcaaaatgtgtatgtgaggtgggggtttgtaagaaaactaaatctacatcttcagtagcaggaagtcaattgaaaatgtgtattacacatcaagaaatactaacataatcattgttatttagcaacatggagattacaggagttgaaggagactgtgtatgttttattttaacaaaatttcaattaaacaataaatataaatctataccaaaaaatgcaagatgtgtgggatgaaagtacagtagaagaatgagttggagaactagcttgaatgatatgatcacatttagattattctggccactatgtgttgggtaaatttgaaggtgaattttgagataaatttgagagcccataggccataggcagtaaccagagagactgttgtaaattctgagctccacagcaaaagttaccaaattaacctctcttcattgcaaactaatcctagccatcaaagagttgtaaggctcttgcctgtagaagcaactttgctgatatctgagccctggagatgtaaggagaggcagctgcctggggctgagcagtttccttcctccagagaaattattccccaatggataggatcctttttgttaagccccagacagctctcacaagtttttaagaagctttaagtaggctaatttcattgcaattttaaacagaacctcaagttgctttaattcttactgttttattgctatattacacttgagaaaattgtttttcttataaatatgaatgaatgtttaggtagcagtgagattaaccatttgtttgtcacatttcaggcaaatgaattccaaaatgctgttttccattttgttttaattccgtgactattttttttcttccactggacagatattttaaacttgtatgaatcccaagctgtcagtctttccattttcatttcttccctgctttaaagtgtaaaaagatattatccctcagaatacttataaatattctattctgttttgtgttgcttttctatgactcttttatatttcacccttccttctagagtttattttggaatatggttcaagtttgcatcttttgttccaaagatctgtccctctttttagagaagagctttttcaaaataatcttataaataacccttctctttctcttatttggaggtgctaaatatattacattttatgctttttgtatataagtaggcttattttctctgtggtgttcttttggtctgtatttctttttttttcttcttcttgtcctttcttggttttgtagaaattactaaaaatgattttttgactaaagtctccaatctgccaggcactgtgccagcagtttggagaagagcaaggcatcttggccccagaggacttcaaagagagtgggagaggctggtggctatttatagtccttttggtcacttttagagggccttagaaagtaagacaagggcgtgagccattctgtgggaggcagaaggtgaccttgatcttattggcaagcaggagttttccctctaaaggggaggcagggcatttgagagagagaacagcaagtgcaatgataagtagctcagcttgtgaaaaagcaaagcaactattaactacaggaaaaaaacaaaagctcttaaagaaaggaattgcaattccaggcactccatggctcaggggacagttcttggattttgggattaggggaaatggaaaacttttggctagagaatagtttccagattgaattgtggaagaaaaatttggagtggaaggaggaaaccaggctgggaagtgcctcatgttctagccctgggtggggactttcacattttcagtagatgccagtaaaagattagagtcaggatggtattattattataatttcttttttttaaataatgataactgtggcagaaatgtggagaattgaatggagaagatggaggctggtagcaggatggctaaatattaagtcatggttaccaacgtttattgagtgccaactgtgtgcgagacattgccagagagagaagaggggtgtttttaataatacagcaagcactttattattattgtgctacttttatacaattgttttcctgtaacaaactaaggactaagcagggataaggtggaagagctggattcaggaaaatcctagagagaattagtaaaatgaggcaactaattggaaatggatgaagtgggtgcactagcttgggagatggagtggaagtgatcttgttaaccaggagagagaatgctgtaggggttcacgttttgtaaggaagacagcagctctgcttgtccggcgtttcccaaagtattggttttcttgagtaaccacaggacataatctgtctggctttatttatgatttggctctgtgtttgtaagaagataacctttggtgacaccagaagctgggcaaggctttctaagcccccactgttttttttttgttgttgttttttgttttttttttttgtttttttttgctgagacataccattctatatcacactgtggcatagtaattatctgcttttccgattatctcgtactgtgagggagggaccacagaaatctgtctgtgcttattaaagccactgctgagatccccgcaccaattttatgatatgctttctcctctcaaaccatgtaggtaatttatgagcggtttctactgctgttatcttcaatttctcctttggcctcctgcttataaatccagatgtcaggtttctttggaattcattttgcttcactcagaaagtctcctctttctttcagcacaacaaattctaacccattttatcccgacaatgtctgctttggatgcggctggcatgatgaccctgtggagcatcctcatgtcatgcccagtgaacagaggcatgttgtggtctggaggtcaggaatgatgtctgggctgaccatgggtatttgagaatcatccaactccagtgggtattttaggttgggtctgtgtgcatgtgactcgtatgtgtatgtgagtcctggtcttataatgaatgagtggagcaaatctactcatggctcaatacccaactcaagtttccctccgctgtgaaaaggacacatctgattatagtagctgcagtggagctttttttatatgaatcattcctctaacaatagataccctgtgtctcacaggtcggtttttatatagggtgaaagtgccttaaaaagagtcaagaatccagctgggtgtgggggctcatgcctgtaatcccaacactttgagaggctgaggcaggaagatctcttgaggtcaggagtttgagaccagcctggttaacacagtgagacctgtctctactaaaaattaaaaaaaaaaaaaaaaaaaagctggatatggtggcttgtgcctgttgtcccagctactggggaggctgaagtggggggattgcttgagtccagagtccaaggctacagggagctatgatcgtgccactgcaccccatcttggataacagagtgagatgagtgtgtacatgtgacagtgtgtgtgtatatatatttatatattatacttacatattatatatattttaaaaggtcaaaaattctatgttaaactttctttttcacagactcacatggacacagagagtagctgtccaatgagtaataataataagtagctgtatgcttaggagtgtccctgaatcactaaccacaataatttttcccttttattgactaccttttatgtttttgtcgctgtatggcatgttttattgatctcatttaaatttaactgctctctgaaatagctattcccatcccttcttttgtaaatgaggcaaggtggccttggagaggttaagcaacctgcctgaggtcacacagctagtaagtgcagggacctggattcaaacccagctctgtgtgtatcttcaaggtctgtggacgtccccacatcaactgcctaaccttctgtgtctgcagaatggaaccttctcctctatgatggggttgccagaaggaaaagaaattctgagtcttacagcaagtggacagtttatctagggaatcttgcctgttgggggggcgggggtgggtgggtgggtgggtggagttacttctttagttttcctctcttggtacttttcaattctttcgaagctaacaaaattccaaaggagctttatgttaaatttgagtagctattgcctgtgatggccctagtatgtagtgtaatacagttgaaaccctctttaaggcatacagtatttttttttttaaataaaacatgggaaagaaaaattgtataatattatgtggcttaggaaatgtcttaccatagagtttataccgaggaggaacgttatttgctaacgcaggtcttcacgcagcaatgggatggaagagtggagtatgtaagttgaggggtgccctttcctttagtgtgtgagggtgatatgattcctgcagtacttatgggtgaatgttcatcccacttttgcagattccctaggtctgaagaagatatctgggccacctaaaaaccttcatgagagagttatacgtgaaggttaagagcctggattcagaaatctaacttctaatctcagctttgtccctttctagctatgtgaccttgggcaagttgcttaacctgtctgtgcctcagtttcctcatatgtaaaatggtgatgtaatcatatctactttatagaattgctgtgtggattaaattttccacgtgaaatgtatagaataatatacctatacatttcacacaataatatacctatacatttcaggcacaagccaccacacctggccataccccttatcatctttaaaacaccttacattaaatgacaggatcttcaggaaaatatctactgaaaagtgatatatccttagccttgcacttacatggaaaactttaatctaggacaatgggcatttccttgtccccaagcagcacagaaatccagagggtccagcctgagacagatgccagggtgatggtgagagtctggggagggtattttccttcataaggttcttcccaggcctggatcagagggggcagctgtggattccccacagccaacatattgaggaagattcagccctcactagggatgttctgaggtcatgggagactttgtgaaagttggaggatgggctcagctacctcctgcttctgcttcctccatagtagtcagaccagaagaaaaaaaaagtataatgtgtgtttttcctcttttcatgatttgattttttccacatattgaagtaatttttccttgaaaaggactgaatattaaaaaatacattttatgtctgtaatcctagcattttgggaggccgaggtgggtggatctcttgaggtcaggagtttgagaccagcctggccaacatggtgaaaacccatctctactaaaaatacaaaaattagctgagcgtggtggtgggtgcctgtaatctcagatactcagggggctgaggcaggagaatcgcttgaacctgggagaaggaggtggcagtgagccaagatcacaccattgcactccagcctggaccactgagtgagactctgtctcaaaaaaaaaaaaagaaatggatgctcttgagacttaactgtgtaagaaagaattcccacttcttttagaggcactgccagccccaaaggttatgaattggcaatgttaattagatcttttcttggaacttgaaagtattctcacctgaaatgcgtttaaaacaaagttaccatcaagattcccctctgtttctttctagagagctttctggacaagtttcaatgtctttcatggagaatttgaaaccagtggatagaaagcagtgtcaaccttgtcctgtttatgcaaatggatctgctctgtcacctgtttataacccccggggtcattgactctcaagttcacattccccagatgtagatgcagctatgggacatggaattcgcgatttattagtttgaatcaaaccaatgttgagatttacagtactggctgttgttgcttctgctggcctttgatagtttaagtaaggattgtagacagatgagagctgcaggaggggctagctcatctcatctaatattcagaaatcctcacactgttactggggacttgagagttggtacttaaacaacctttgtgtttctaggggattatcctgtctgcctagtccattgcttcctcactctagcagtgcactgagttaaaaccaacccatcctaaacttgcctccaggcgtctacatgggcacacacacatccccacaccctacaaggaaacccaagctggtttatacaagctcactttaggcagtttgccaaattatactccgattcgttcagtggacagatagttacgtgaaatacttgcagtacgggaaacatttgtttctcagccctggggataatcaatagaggcaaatgcctttgcaatcacaacgcctgtttatgtgtggagttcttcattgttcttggtttgtgagtacagtaaacattctccaagtggcagcaggagagaaccacggtgctttcgtaacaagctgagatttacaggcttgtaagagctggggttataaatcaggcttctggtggaatgggtgaaatggactaaattcaagtattaatgggagagccacgtgtgcgctgtgcagggagaaaggctcatcagtattacagatggcatgtccctttagttaatttagaagaaattccgatcacccaacagaactctgaggatggatgcaggaaaaagaagactgtggcatatggagggaacatatttgttcttggaaaatcagtagaaaatgtttaatgtcatcataacctcatttgcataaaaatagtcacatgcggtaaaccagataaaagcaaaggaagacgtgacggaaccaatgctgtttggagtttcgtttcattatgaataacataaataattcaattgaataaataaatacgaaattgctttaagtagatgtactacaagtgattattccttgaaaattccttaatggtacgtgccccaatgatgaagcaatgtgattatgtctccatgggcagccctttgctggacacttgacccttgacaataatattgagctctctgtagctctcaagtgttttatgaacacaaatgaagtttttagtttcacaatcttattcataaacatgatcttgaagttgtttaaatagacttatcttcattgtgatgaatgcagccccactttgcacatggttgcgcttaggcaatattagataatcagaagtttgaagagtcttgggctgtgcggtactagaaacataattctaaataaatatttggaaccctggtggcagaatttgagctgttgtttctgcctcacagagtctggtcaggggaattcttgtgtaaggacaaattgtggcatggataaaattgatggaaattatttatgagttaaataaaaataaagaaaggaatttatttatgatttcaacaaatgttttctagggttttgtagaaagccatgcacaggtactatgggagctataacagatgtgtatgacacagtccttgtactcatttgattttattcattcactcagtaaatactcgtcaatcagctcccacacaccaggcactatgttggaggttgaggttataagggggagacagatgataaactgggaaaaataaacacgagctaattatagattgtgataaatgttttgaagtaaatgaacaggtgctaacatacatctgacccttaaaatccctgggttttacatctgcaaattcaaccaactaaggatgaaaaatactagaaaaaaaataaaaataaaaaatagcaatacgacaataaaaaatacaaataaaaaaacactacagtataatgactatttgcatagcatttgcattgtattacatattataagtaatctagagattatttaaagtatccaggagatgtgagtaggttatgcgcaaatactataccattttatacaagggacttgagcatccttggattttggtatccatgagggggttctggaaccaatcccccttagatactgggggacaactgtagagagtaaatggaaacaagagtgtactttagagaaggtgaattgaagaggcagaagagatgaggataaaacagcagctcaaaactctggcagcggctgggcgcagtgagtcatgcctgtaatcccagcactttgggaggccaaggctggtggatcacttaaggccaggagtttaagatcagcatggccaacatggcaaaatctcatctctactaaaaatacaaaaattagctgggcatagtgttacacacctgtagttccagctactcaggaagatgaggcacaagaattgtttgaacctgggaggcagagggtgcagtgagccaagattgagccagtgcactcaagcctgggtgacaagagagaaactgcatctcaaacaaacaaacaaacaaacaaagaacataagtaaataaagcctctgtcagaaaacctctctggacagaaagaatagtgcctagaaaaccctaagtttggaatgggcttgatttaggaactgatagcagatactggccaattgtttgagggtgatggaagggaggtaggaaccatagcatgtgggattgtgggcaatgaatctgggatttatttcaatgggaacaaaagtgatatactgggttgataatatacccccaaattcaagtccatctggaacctcaggtcaccttatgtggataacagggtctttgcagatgtaattagttaaagtgaggcatacttgattagagtgctccctaaatccccaagatggttggtatcttaagaggagaaaacacggagactaagacagagacagaaggaaggaggccaagtgaagacaggcagagattggaatggagcatccacaagccaaggagtgctgggaattgccagcaatctccaaaaagtagggaaggcaaggaaggattctcctctagagccttcagagggtgcatgcccttgctgaccccttcatttgggacttctggcctctagaaccatgagagaataaatttctgttgttgtagtgcccccattttgtggtactttgctatggcagcctagggaacagatattaaaggtcatggtagccactggggatttgacatagcgaagtgtcctgatctggggtatgtttttagaaggtcattctgaatgatgtttggagaatggattgcagagtgcagaagagatgtaaggagtccagtttggaggatagtgctagtaggagatgatagtgattccgactagggtgtgcctagtgatatgtgcctagtgatttggctgtgtccccacccaaatctcatcttgaattgtagctctcataattcccatgtgtgagagggactcagtgggtgaaaattgaatcatgaggtcagtttcccccatactgttctcatggtagtgataaagtgtcgtaagatctgatcgttttataaggggaaacccattacacttgactctctaattctctcttgccgctgccatgtaagcagtgccttttaccttctgccatgactgtgtggcctccccagccatgtggagctgtgagtccatgaaacctcttttactttataaattactcagactcaggtatgtctttatcagcaacatgaaaaagaactaatatacatagtaagatgggaagaagtagagatttatggtggaggtcatcaaggaatactactgggttttaggttgcaacatatgggtgcacggtagtgccatttactgaagtggtaaaactgaaaaacagatttggagggctctttaagaattctacttgggatttgttaagtttgatttgatgtttagtcatatattgggagatatcaaatagatggttgaacaatttatgaatctggagcttgagagagagataggggttgggagatagacctttgaaggcatcaacatagacgtgaccatcaaagctgagatcactaaggagagagagctggagatgtggcagcagcccaggagtgagtgctgtgccactccaaaatttagaacgtgggtagaggagagaaattcagcaaaggatgtggagaaggaacaactaatgaagcaggtagaaatccaggaaaaagaagtgacgtggaagccagaaaaggagtgttccaggaggaagcagtggttactggtgatgagcgatagtgagatgccagaatcgttcagcagatttggcaacatgaagttcattgatgacctcaacaaggatattcaaccctgattggggttgattaaggagtgaatgggagggaagaaatgagagagcaaaatgactactctgatgaattttattgtgaaagggagaagaggcatgctagcctgagggctttggggggtgggggtcaaaggaggttattattattattattgttccttataaaattcccattttgtcataacataagagttacagaaaagttgcaagaatactacaaaaaattctctattttctttatccagtttccttaaaggttcacattttacaatatttatatatctccatgtgtatatctatttttttctgaatcatttgagtgtgagttgcagacatgatgcccctttgtctctgaatacttcagtgtgaccaacccaagaacaagggcattctcttacataaccacaggacaatatgatagtattgcctatccacatttcaccagttgtctcaataatgtcctttacagaaaaagaaagtcctagatcatgtattacattcatttatcatgttttattttgaaacagccctttagtctttgtctttcatgacattgacatttttgaagatgacagtccagttattttttaaaatgcctcttaattcatatttgtccaatatttcatcagaattagattcagaatgtgcttttgtggcaggaatactacaaaaatggtgttgcatctgttgcatcttatcaggacacacatgagggaaaggaacagctaatgaagaaggaaaaaattcagaagaatgtagtgacatagaagccactcattacttgtctcattactggtggtgataatattgattcctgggttaaatgtggtgtattaatctgttctggcattgctataaagaaatacctcaggctgggtaatttacaaataaaagaggtttaattgactcatggtgtcacaggctatataggaagcatgatgctggcatctgctgggcctccggggaggcctcaggaaacttacaattgtggcggaagatgaaggggaagaaaggtttctcacatggtgggagcaggatcaagagagagagagaaggaggtgctacacacttttaaacaaccagatcttatgagaactcactcacagtaccatgggggaatggtgttaaaccgtaagaaactacccccatgatccagtcacctcctaacacaccctacctccaacatcaggaattacaattcaacatgaaatttgggtggggacacagacccgtactatatcagatggtgtctgcatggtagtcaattatgtttcctaatacctccaggacaatgttgaattagtggagatagtgggaacccttgcctttcctgtctttgacagaagtgcctctagtgtttctcattaagtaagatgctatctctatggctatggtatagtttattgtgttaagaaagtattcattagttttaatgatcttgagggttcttttattaggatgggtgttgaattttccaaactcatttcagttttttcagtaactataccgaaaatcatcaatttctttcttcctatgtctataaatattttgcattataatagtggatttcttaatgttaaaccaaatttatattaatggaatttattccattaggctatggtgtattattttcttaatgtgatgttggattctgttcactaatattttatttacaacttgtgcatcaatatttgtaattcattctctctctctctgctttccttaagaagtttaattattaatacattacaaaaggaattaggttttcaatcctctggaacaatttatggagcattatgactatctggttcttaaatgtttagtagaagtcacctgtgaaaccatctgggcctgatgttttttatggggtagtttcttgatggtttttgcaatttttttcctgaggaaatagctctgtttaaggtttctgtctctaatgatgtcaaccttggcaaattgcctttccctaggaaattatccattacatctaggcttttaaatttatttgtatagggatctgcaaatgagtctttatttttatttttaacagttatttgtttcaatgattatttccccctttggtttcttatttatgtatttgtgctttctcttttttcccataagttagttaaatgtggtctactttgttaattatgttttaaaaaacagaattttgatttattcaagatcttgtatttttctattctctgacttattgagttctgctttttatgtttattattgccttccttgtattttcttttgacttactttgttgttgttttcctttctgaaaagcattctaagttggaaatgtaattcaagtatttttattgctaaaaggttttaaggctttgaatgtttttcttcttaatgcttaaaacttcccactgattgtgatatgtggtgttttcattaccattattttttagaaatgctttaacttcggtttgtatttaccttgtcactcaagacaggtttagtaggtttttgaaatttgcagatggataactttttaaaaacattattaataattttaaattttattgcatagtgatcagagagtgtctttttttttttaagatggagtctcactctgtcacctaggctggagttcagtggcatgatctcggcccactgcaacctctgcttcccaggttcaagcaattctcctgcctcagccttccgagtagctggattcacaggcgtctaacactatgcccagctaatttttgtgtttttggtagagacagagtttctccatgttggctaggctggtcttcaactcatgggctcaagggattcacccacctcagcctcccaaagtgctgggattacaggtgtgagccaccatgcccagcagattctattttacaactgttcccctgaggttgagaagatgtgttgcctgttttctgagagcagtgtgtatttctatcacatgaggcattctgattttctgttttcactttcttctcgatatagttactttgtatatacggagtctgcttcctttttttttctgagacagagtcttgctctggtcacccaggctggagtgcagtggcgcgatctcggctgactgcaacctctgcctcctgagttcaagcgattctcctgcctcagcctctgagtagctggaattacagacgcccaccaccacatcaggctacttttttggagttttagtagagatggggtttcgccatgttggccaggctggtctcaaactcctgtcctcaaatgatcctcttgccttggcctcccaaagtgctgagatttgcttacattcattaattttgttgatttgcaatgattcacaagatttgtagttcaaagggaccattgtctgttagtgtcacaagtacggtgcctttgtctgtgttgctgtcaaggaatacctgaggttggataatttataaagaaaagaggtttaactggctcacagttctacaggctatacaagcatgacaccagcatttgctgaggttctgtcaaaggcctgaggctgtgcccactctcagaggagggtgaaggggagccagcctgcagagattgcatggtgagagtggaagggagagaggggtggcaggtgccaggctcttttcaacaattagctcgcagggaactctcttgagaactcacagagtagagaacttactcactaccatgaggatagctccaaggcgttcatgagcggtcggccccatgacccaaacaccttccagtgggccccgcctccaactttgggaatcagatttcaatatagcgtgtcaaatatccaaaacatagcatataaattctgcagtgagcatatatatatattttttagatggtgtctcactgtgtcacccaggctggagtacagtggcaccatcttgagtcactgcaaccaccgccttctgggttcaagcagttcttctgcctcagcctcccaagtagctgggattacaggcacgcaccaccatgcctggctaatttttgtatttttagtagagacagggtttcaccacgttggtcaggctggtctcaaactcctgaccgacctcaggtgatccaccctcctcggcctcccaaagtgctgggattccagccatgagccaccatgcctggccagtgggagtgttttttgtgtgtgtttgcgatagggaatatgttgtgtcatctggcctctgggttttctcttatttagggacccccaacccacaggccatggactggtacgagtttgtggcctgttaggaactgggacgcactgcaggaagtgagtggcaggcaagtgagcatgaccgcctgagtgccacctcctgccagatcagcggcagcattagattctcataggagcgcgaaccctattgtgaactgtgcatgcattgcacgctccttatgaaaatttaataccttacgatctgaggtggagcagtctcatcctgaaaccattccccatccccccacacccttggaaaagttgtcttccatgaaactggcccctggtctcaaaaaggtgagggactgcttttgaagaggacactaagttttccccttttgcatattttcccattcaccactcagtgtttaaaggctgcctccccatactttttaactttcttctctcccagaaacaatgccttgagtcatgcagatttaaagtcccgtctttggctaggtgcttacgcctgtaattctagcactttgggaggtcaaggtgggtggatcatttgaggtcgggagttcgagaccagcctggccaacatggtgaaactgagaggtgaagcctgctggacttactgggttgagtggggacttggagaacttttaaggggattgtaaaatgcaccaatcagcgccctgtagctagcatcaggattataacatgcaccaatcagagctttgtaaaatgcaccaatcagtgctctgtaaaacgcatcaatcagcaggatcctaaaagtagccaatcgcagggaggattgaaaaaagggcactctgattggacagaaatggaacatgggaggggacaaataagggaataaaagctggccaccccagccagcagcggcaacccgctcgggtccccttccatgctgtggaaggtttgttctttggctcttcacaataagtcttgctgctgctcactttttgggtcggtgccacctttaagagctataacactcaccatgaagatccgcggctccattcttgaagtcagcgagaccacgagcccacaggcgggaaccaactgcggacacaaaacctcatctctactgaaaatacaaaaattagccaggcatggtggcaggtgcctgtaatcccagctactcgggaggctgaaggggagaatcacttgaacgccggaggcggaggttgtagtgagtcgagattgcgccattgcactcctgcctgggcgagagagtaagattctgtctcaaaaaataaataaataaataaagttgtttgttacagaacctgatcttatctaccagagctcgttttccatattttcacacttaagctgagtttccccttctgatggttcttttagctcagtcctactcttagcagcagcttcccactttctggttccacagttttcctagattttccttgcgctctgtatgaaggtttgcaataggagtgggagagagaaagctcactggtagtttgtggttttctactttgttgtaatttgttcttttaactgtatttattattatgttgtaaaacgtgttcagagatatgtggaacccagaattttcactgattatcataagtttgcttttctttcttttttcttttcttttctttttctttttctttttttttgagacgtggtttcgctcttgttgcccaggctggagtgcagtggcacaatcttggctcactgcaacctctgtgtcctgggttcaagtgattctcctgcctcagactcctgagtagctggaattacaggcgcccaccaccacatccggctacttttttggagttttagtagagatggggtttcgccatgctggccaggctggtctcaaactcctgacctcaagtgatcctcctgccttggcctcccaaaattctgggatttgcttccattcattaattttgttgatttgcaatgatttacaagatttgtagttcaaagggaccattgttagtgtcacaagtacagtgcctttgtctgtttgtgttgctgtcaaggaatacctcaggttggatactttataaagaaaagaggtctaactggctcacagttctacacgctgtacgagaagcatgacaccagcatttgctcaggttctgtcgaatgcttgaggctgtgccacctctcagaggagggtgaagaggagccagcgtgcagagatctcatggtgagagtggaagggagagaggggtggcaggtgccgggtgccaggctcttttcaacaattagctcccagggaactctcctgagaactcacagagtagagaacccactaccatgaggatagctccaaggcatccatgaggggtcggccccatgacccaaacaccttccagtagacccccgactccaactttgggaatcagatttcaatatggcgtgtcaaatatccaaaacatagcatataactactgcagtgggtataattttttttttttttagacagatcttgctgtcacccaggctggagtgcggtggcaccgtctcggctcactgcaacctccaccttctgggttcaagcagttcttctgcctcagcctcttaagttgctgggattacaggtacctgccaccatacccggctaatttttgtgcttttagtagagatggggtttcaccatgttggccaggctggcctcaaactcctgacctcaggtgatccacctgcctgaaatgaacgaataaataaaaattcatgataatccaatccagggttgatttccgtttatattgctgaaaccatgtaaggtttcaaccagatgagatgtggtctccacgatctccccacttggttttaagtggggagatactagattgaaggcttatgtggatgggaatacttacctacatcagtgtagacagctacattaaaatcccttgaggctcttattgaagtacagattcccaggttccaagtttcaaagaactgaagtattaggttgcactgtatgaaattgctatttgtggccaaatatcaacaatctcacatgatccaaccaaatatgatgaaaatcccacagtactgaagtaaacctactgaatacaatttgatatcttagctgttttataaggacttctagtgaactcatttgttcaaaaattcattcatccgatcgaccagatataaattatgactactaactcggataagatgtgatctctaccatcataactactaaataaaaggaaaacatgtgatttccagttcagatgagtcactgaagcaagaaacccagaaggaagaaccaacttgtgatgaaaaagtcattttccaagttcctgggactatggataccgaacttcggttatcactttaattactgcagatatacaagccacgacaaactggcctgatctatatataattacagacacaagaaatgctttggttttactaaatttcagatatcacattgccattgttcctctctcctaataagagtgtgtaaattacagatacagatgtttttaaaactttctgatagccagcgggtgcagtggctcatgcctgtaatcccagtactttgggaggccaagatgggcagatcacttgaggccaggagttcaagaccagcctggccaacgtggcaaaaccccgtctctactaaaaaaaacccacaaaaattagctgggtatggtggcgggtccctgtaatcccagctacttgggaggcagaggcacgagaattgcttgaacccgggaggcggaggttgcagtgagccaaggtcgtggcactacactccagtgtgggtgacagaacaagacgccttgctccttaaaagacgtccttaaaaataataataactttctcgtagctgtatttcacatcaagaaacaaataatcctgataaaacttatttgactagctacttattggtatcaacaagctcttattgaataaatatgtaactgaatgacatcctgggggctcattattattatatgagttacccaaagttcccagaatttctggtatgcagtgctgtagccaacagtggtcattcctatatctgcttttacagtttttactatctataccagttactctcaaaacttcatgggcataagaaacacctgggggggtgtcaattgaaatacaaaataaataaaaaataaaaaaccactatcaacaacatttgagtcttgcattttacctgtgatatgggtgcctacagactttatcagtgtgcttctcatgggaagttttagcacttgaaacccagggacaccatttctattatctgagaccgccttgaaggtttcttcccctttcgatattcctctctgttctttctcactaattcttggaaagtcatcttcaattcagttcaacaaatacctattgtatatttactatatagtagacacagagctcagagcttaaggaatgtgaaaatgcacaagacctgccccctggctacgaggagttttttcatctagtaggagaagcatatgtgtctggctataatacttggcagaataaaatagctgtgatgttgagtttcgttgagttttatttctattgcatagattgaatgtcttcagcttcaggttgcaaatcctggtgactccagcacaatatgtgttataaatagcattgcatcttgactgcaaatgaactcagagagagagagagagagagacagagagagagagagagtgggcaggcaggaagataaaaggttgagcacaatttgggcgtttgtttatgtgattgaactacggctggggctgggctaggtgctgttcatggctggaggaggcaggttcttttcctgtatgagatttttactttttatttttattttttgagatggagtctccctcagttgcccaggctggggtacagtggtgcagtctcagctcactgcaacctctgcctcttgggttcaagagattctcctgcctcagcctcccgagtggctaggattacaggcgcctgccaccacgcctggctaattttttgtatttttagtagaaacggggtttctccatgttggccaggctggtctcgaacccctgacctcaagtgatccacttgcctcggcctcccaaaatgttgggattataggcgtgagccaccgcgcccggctttgtatgagattttgtctttgtgactaaatcacttctttgtgtacaaacttacattctgcccctgagcatgtgtgttcatgcttaactgattcaaagactacatttcccccaacatattacaccaaatgtacttaacagcaattagaatgtttgccgcctgctgtgtgcagatctccccagaaaacaaaattctcctaaatggcagtataagtaattctgaagattaaagctggtgatttgcagagtgcttggttcgctggcttcctgcaaatatcaagattaacaaagaaattcattgatcccattttgcctccttaatgcctgtgcacaggcctaagggaacgcatcccacgtggctgtgtgattcagatgaagacttgctgttgctttttttcatggccaagatgctgatttagtggcatttttcttggcaaaagtgccccaagaaaacaaatccatttgtgtatatttttacgggaaacgctccacctaaccctgccccgctgaaagccttccccgtgagtcgtgaaggaaacatggctgatttgctactgttcaaagggcgactcaggtcttgactgaaagaccgtacacgggttgtttgatgctgtgtaaatctcagccacgctgaacactcctttccccaactctaaatacaggacccctgaacatgttgccctccacaccttcttccatttctttctttctttctttctttttttttttgaggcagagtctcacattgtcacccaggctggagtgccgtggcccgatctcagctgaccgcaacctccatcttctgggttcaagtgattctcctgcctcagcctcctgagtagctgggattgcaggcacgcaccacgatgcctggctaatttttgtatttttagtagagccagggtttcaccatgttggccaggctggtcttgaactcctgacctcaagtgatccacccacctcggcctcccaaagtgctgggattacagtcgtgagccactgcacctggccactttgttccatttctaatgtgttaatgtactcaataagcaatagttttggagtgtagatggtgtaccctgaaatgcaccaggcactggaaaatacagtggtgattgagaggcaaagtccttaccctcagagcagagcaatcttttgcaaacacacgttgtgtcctggtcactctagtgagaccagcagccaatgccagccgccagtttggcggctttctctggacagctccatcacccccattccctttgattgagacctttctgtgtccatgatgatctccccaacttggaattctgctccattctctgatttcttcattctccgacttcaaaaccagccttctttagtattcccttccagcagttaagtaactttcgtatagctgatattaaaaagaaaaccctagacaaattaaatgaaacagagtttaattgagcaaagaaggattcgcagatcggacagccgcgtggtggataaagatttaaggacagcaaaaggagagtggtggacggaaaacagaagcaaggtagagaagcagcttcttgattacagctcagtgtttgccttacttgagcacagtttgaacagttggccacctttgattggccgaaactcagtgattggcacaagaataggtgacagtttgtttccatatccagtaaggttacagtccactatttatggagaaaccttgaggtttaacttaaagtatgcaaggaggcagctttaggctaaacttacatatatacatgtttttttccataagttattggggtacaggtggtatttggttacatgagtaggttctttagtgatgatttgggtgcacccatcacccgagcagtatatacagcaccctatttgtagccttttatccctcacctcccctcccacttttaccaccaagtccccaaagtccattgtatcattcttattaggctaaacttaatttaacagtagttagtggcaggccagagatttgaagtcaggcctcagtacagatttggtgttctgccttcctcagttcttggcatgtaggatcttggtgctcccacacagttttatcttttccttctctgagtgtcctggatggagtgtctcgcttcagtcctggttttcacaggactcagtgccctccaccaatatcctgctgggcctaattctgcctctcttctgtgaggtcgttgtatggggtgggattcccaaggcaacataccattttgccaggtaaatggcattcctggcaatattcctttggaccagtgaggaaagtagaacattttatggggtagtgcagatgtgtgactaaatatttttcattagaacccgttttcaatgactcattaaagcaatttttaaacccaggcatggagtcagggagcaaaactgtcttagggagaaaagagggaggtatgtcaggacactcattttgaagaaggcatgactttgcctactagagcttagcatgctttctgcttacaatcccacctgctggctgagtggagagcaaaattctttaaagatgtaggaatgtaagatgagaggaactcatttgctggggctgaatgccaagtgaaaattccgcttctttaatctacttcccttctcctatctttcccctgcattcccagatttctaaaaggaatcattttaatacttttttttattatttttattttgagatggagtctcactctgtcccccaggctggagtgcagtggcatggtcttggctcactgcaacctctgcctcctgggttcaagcggttctcctgcctcagcctcccaagtagctgtgattacaggcctgtgcaacaccatgcctggctaacttttgtattttcagtagatactgggcttcaccatgttggccaggctggtctcacactcctgacctaaagtgatctgcctgcctcagcctcccaaagcacggggattacaggcataagccaccacatccggtcatggaaggaatagtttttgtttttttgaaacagagtctcgctctgctgccagggtggagtgcagtggtgcgatctcagctcactgcaacctctgcctcccaggctcaagcaattctcctgtttcagcctcctgaatacctgtactacaggcgtgcgccaccactcccagctaattttttgtagttttagtagagatggggttttaccatgttggccaggatgatctcaatctcttgacctgtggtgatccacccgcctcggcttcccaaagtgctgggattataggcgtgagccacagcgcccacccaggaggaatagttttaatctgttgcatccatcactccctccacagctcagcatagtaagcactgtattgaaatgtgcagatgtctcctatgatttcctgccaaatttaatagttttaatagagttttaaattcttttttttttaatttaaagaaagtatccaaatgacagttgaatatgttatttatgaattgtctagatcagcagttcccagcctttttggtaccagggactggtttcatggaagacaatttttctatgaactgggggtgaggggtgggttggtttggggatgattcaagctcattccattgattgtgcacttgtttctattattattacattgtaatatataataaaataattacacaactcattacaatgtagaatcatggggagccctgagcttgttttcctgcaactagacggtcccatctgggggtgatgggagacagtgacagatcatcaggcattagattctcataaggagctcgcaacctagatccctcgtatgctcagttcacgatagggcttgcactcttacgagaatctaatgctgctgctgagctgacaggaggcagatctcaggtggtcacgtgagtagatggggagaggctgtaaatacagaagaagttttgcccactctcctgacgctcacctcctgctgtgtgacctggattctaacaggtcacagactggtattgttccgaggcctaggggttggggacctgtgatctaggtgtatacatagaaaaagaaaccctcggctgggcacggtggctcacacctgtaccagcactttgggaggccgaggcgagtggatcacgaagtcaagagatcgagaccatcctggccaacatagtgaaaccctgtctctattaaaaatacaaaaattagctaggcatggtggcgggcgcctgtaatcccagttactcgggaggctgaaacaggagaattgcttgaacctgggaagcggaggttgcagtgagctgagatcgtgccattgcactccagcctggcgacagagcgagactctgtctcaaacaaacaaacaaacaagaaatcctcttcaagccccagccccagatctctctcttctcagcaaaggtgactactgttggctgtttcttgtgtgtccttctgctgttttcttatgcatgaatatgttagacatgtccatttttaatcttgaaagattctgccgacttgctctctaaaggactctgcctgtttatatgtcacccaacagtacatgagtggccttcctcacacctgactccctaggtaagaccagtcttcatttgttttgccaacctgaaggctaaaaaaatatttctttatagttcttggatgcctttctttgactattacagaggttgatcatctcttcatgtatttattgaatatgtgggttccttctgttgatttctgagagacatttgttcatatcactcactcggaccgagactttttgtcttttagttcatggattttcaatacattttgttctacctattggtgaactatgttgttaggtatgtatattcatgactatttaattgtctcaagcaatacctttgatcaataaaaaacattcctctttgaccctggattccttcatgtctcttgtaaaaccactgccgtaatcttatccatctacttctcttgcctctcctcatcaatacttcttccttataggcttctgagtatctttgtaaaacatcagtaggttctagctgggtgttagcctgaggataaactgatgaagggtatgggaccaaaaaacatataggtggaaaccccaaatcccaagcgctggccatgggtttaccttgacatgtgtgcaggggaggtgggaaggggacagtctggaccactggcatttggaccacacatcataatgacagccgagaagggaacctatttggtatagaccgagcttcccttctgtttgacatgtttgttggtggtttccagacaagtgtccctaatctatgtggttgtttgcctttaacagatggttccaggttacagtggggcccccaatgcctgaggccaccgggaaattgagaaatcagatctagtgagttgccaatttctttgactggtctcactagccactgacgagtccaccagctcctttcaaatttaatttcaggggtcaaatgcccccttctatttggggctcttcctatcagaccaaatgccttgtttgtagttctgatgatttaggctggaaaacaccgttttctgccaacgatgcagtcagctgcatagaacaagctgccattgttaattaggtaagttatgtggtcaaggaagtaccttttactggtggtctttattcagaataaggaagaggggacttgtgatggagccacacagagaactagcaggtcaccagccagagcactggaccctaggagaggacttgggctctctgagccagttctgactgcccacggaagatgtctccacacattccccattgcttggggccaaaaggcagtggcagaatctctggggccgtgggaggagccgaagaacagacgtggggagggggaggattgtgatctggggaagagagcgtgcacacacgcatcttggttggacctgaagggatgctatgttgttctttgattaacacacatgctctgtgtaatgtcacttctctggtctaaaacccttgacactgggacttcccatgactggaggatcaagtctgaattttataaggtggcttcagaacacctggtacactgctgtcttcttttcctcgcctcagtcccttcctgaaacatctatttcagtttcttggcggtacattgtacattttctctcctctgtttttacacatgctattcatttttttcctagagagtttttcccgtcttcctgtctccccctttgcaggccctcacctggaaattacttactcatgcttcatgacccagttcaaattttgtcacctctgtgaaaccttccctgggccccgttgatctccttgaaggcagaaataagctcccagagcaggatgaacaaacgtctcttgtcgcatttatccttccgtgtcataattatgatttacatatatatttttttcttaaggagctgtgagcttttccagaataacagtgagattttagaaatttctgtatcctcaacactttgcttgcccataattgatgctcagtgtttgcaaatgtcacagttaagctaatgtttctgggtgatatagacatacttgttcttcggtgtgttaagaaggaagaaacagatttttaaactgatacaagatccatattaaaatcaaaggctaggcatggccctccatcagtgataagcattgaggcgtatctatactgcccagtttcctcgggggtgggggggggtgttcctctctcctagcttttaccactgagatgaaataagaatcggaattaaataaagtcaccatcctcagcaagagatgagtttcttctccagtgatctgatgtggcattttcagccaggaatgagatatcctgggaggggaatcagtatttctacaattataggttcttcaataagtcctagaatactagaactctgtgctctgcacaacctactcttagtacacatgaccagaatgccttttctctgttacattgattaatgtattaaaccaatacttatcaagtatctgggatgagcctaacctatgtcagtagatatatcagccaaagattagtggtccctgacctcatggaacctgtaggctagggatgcaaagggtaagagtcaggaacaaaggctatggagagatttattgttgctaccctgagttcctgcctcatgtatccactaccatttctatagcttcctcaatagcccaaagtgtgaggagtaaagttaatatggcagtctccaagttcgtaggagatcttccctgtggggttttggaaaggaaggcactgctagttggaggaaggttgaaaagaatgaaaactatgtgccaggcgtggtggctcacgcctgtaatcccagcactttgggaggcagaggtaggcggatcacttgagttctagagttcgagaccagcctggccaatatggagaaaccccgtctctactaaaaatacaacagttagcccggtgtcatggcacgcgcctgtaatcccagctactcgggaggctgcgacacaagaatcacttgaacccagaggcggaggttgcagtgagctgagatcgcaccattgcgctccagcctgggtgacatagtgaggctttttgtcaaaaaaaaaaaaaaaaaaaaaaaaaagaacaaaaactatgtattattgacctgtgtcagagggatggtccagatggcagggagaattctacaggacgttcaaaagccagtggaaatgggatttaaagaggattgaaaacgttcttttgatgccattctgtcctagggtggaagtgaggtctagaggaagcaattggccatgtaagttattagattgctttacaagtgggtattagtgaatgagacccaatgccagggatgctcagttagagagttcggcttcttaataaaacacccagccccggctcccatcctgtatggcattgtcatcattgtaaacagcagttctataaccttaagaaattggcatacagctggagctaactcagtttccaaacaagattttagtcattgtatgtttaagtctctcatgcttcttcagagccacctgttcaccaacagaggaaagtctccaagtggagtgactgattttatgtttattttattttagtttgttactttttgaggcgggggctgaagtgcagtggcagcatcatggctcactgcagccttgaactcctgggctcaagcgatcctcctgcctcagcctcctgtgtagctgagactacaggtgtgtgccacccaaggctggctaattttttaaaatttgtattatttatttttacttttttgagacagagtttccatctgtcacccaggctggagtacagttgtgtgatctcggctcactgcaacctctgcctctcaggtttaagtgattctcaagcctgagcctcctgaattgctgggattacatgccctaatttttgtatttttagtagagatgggttttcgccatgttggccaggctggtcttgaactcctggtctcaattgatctgcccacctcagcctcccaaagtgctgggattacaggtgtgagccaccaccgcgcctggcccttatttttattttttgtagagatggggtctctctttgttgcccaggctggtctcgaacttctggcctcaagtgatcctcctgcctcagcctcccaaagtgctgagattacaggcatgaaccactgtgcctcgtctgactttatgtttcttatacaagcatatcgtgggattgctcctgggtagagacagaagttggaggtcccctttagtggtatctgtatttgttttcaagaatgaataatgtgaggtcaagttgtatctttcttcccccacatctgcctgtcaaaggaatagttgtgatttcatttttgattcagaactgttgctgactgtggcatcagtgggcaattgtagggtaacacagtgtgtctcttatttaatgcctcttcatgtcatgcccatgtgaaaatctcaggcttttagtcaagctttgcagttccctttgattttgcaatatgattttgtcagccatgaattgatctaaatcgatgtgtttttctgttacatttgcttatgataaaaaaagaacagaaaaagtataaagaagcaacaaaaatgatttataatttcaccacccagaggcaaaatgacatttcattgttttttactttgaatgtcttttattactcatgaagttctacctgtttttataagtttgttagccatttgtctcttttgttatatgaattatgcattcatgttttttgtttatttatctaattgtgctctttgagttttcattatttgaatagtgtaagatctttcactcttttgttattgctgtaaatgacttttttgcaatttgccgttgtcttttaatgttattttgatgatcagaggttttcggctattattaaactattacttttaaacttggaaattctttcatatccagaatttgtatgaatattcacttatatcttgttttattttccctatatttataattctaaatttaatggttttatctatctgcagttggttttgaattgtgtttggaagggagacgtgcactattataccccatggagataggaaaggacccccaacaccatttattgaatgattctctccttgcttttggtttgtggtaccttctaggtatttattctctaagagcaggtctgcttgtggcctcttggttctgttgcacttgccagttggcttgttctggagccatcctgattaaattatattagccttagaattagagttattatgttgtgtgtgacagggtctcactctgtcacccaggctggagtgcagtggtgccatcatagctcactgccatcttgaacttgtaggctcaagtgatcttcccgcggcagcttcctgattagctaagactacaggcacgcaccaccatgcccacctaattatattcttttctatttttttattttttgagatggagtctcgctctgttgcccaggcccaggcccgagtgcagtggcacaatcttggctcactgcaacctccacctcccggcctcaagcgattctcctgcctcagcctcctgagtagctgggattataggcacccaccaccaagcctggctaatttttgtatttttagtagaaacagggttttgccatgttggacaggctggtctcgaactcctgacctcaagtgatccacctgcctcagtctcccaaagtgctgggatcataggcatgagccaccatgcccagcatgttttacttcatttttaagatagaatcttgctctgttacccagtggtaacatcacagctctctgcaacctcttcctcccgggctcaagtggtcctcccgcctcagcctccctagtagctgggactacaggcatgtgccaccacacctggctaatgttttaaaaaaattttgtagagatggagtttcaccattttgcccaagctgatctcaaccctctggtctcaagtgatcctcttgcctctgcttctccaagtgctgaaattatagatgtgagccactgcccccggccataattatattagctttatattggattgaatatcatatacagatgtgtagcatacaacgatgctttggtcatctgtggcctacacacgatggggaaaagctgaaaaatagttcccaggtagcatacaagaaagggatccccatgctagctcccagaagggcttagctcttgttattttaaggaaactgaggcccaaaaaggagtgatccgcatgtcgaggtggggagcttttagtatcaacacagtttgataacatgcttctttatgcattgcgtgtctcattagcatgtgaaacctctactcctgggcatgattttcagtattataatgagattatattgaggaaaaactcagtgaaaggtcagcgcttggagcccatcttgtcttgagctggctggattcagtcaggctcttttcaggaatgccagcgtctcacttcactagccttggaagatggccacgttcttaccaggaatggtggagtccctctgtaacaatctggggagaagtaattcaaggagagaaacaggttctttcttttatggttgggaattctgcttggttagctaagttaggagggcctgctttctgcggtgtgactcaggtcagctggtgaagggaggcagggaggttggggaggggaagatgtgaagggtcttggtgaccatgcctcttgtctgccaggaccgagtctctataccgggggtccccagaccttgggcagtggagtggtttcggtctgcagcctgtggcctgataggaactgggccgaacagcaggaggtgagcggcgggtgagcaagcgaagcttcacctgtatttacagctgctccccatccctcacttgagctctggctcctgtcagatcagcggcagcattgaatgctcataggagtattgtgaattctgcatacgagggatctatttcataggctgcacactccttatgagaatctaatgcctgatgatctgagatggaacagtttcattcttaaaccatcacccccacgccacacccccggttcatggaaaaattgccttccatgaaaccggtccctgctgccaaaaatgttgggggccgttgctctatactgtctcccaatgataaaatctaaccacacgtttctccaaacatatcatattgttaaacaccatatgactgtgcatctctgggtttccttataccctttccttttccacagttttgttatttattgttacctattctttcaggtgcaatgttgaaatcatttctcaagtgctaaaattgtttccatagaaatatttacaaaggtaacatttatagtattttttaaattataaaggtaatgcgtttttggtgtggaaaactggagaccacagtgaaatataaaggagtaaacagaagcaataaaaaattcctccactcacaccttccttgatgaataattccttcttttcagaagcaggagctttggagtcaggtagataaagtttaagtctacccaccactttcttggctttgtgaaagtgactctgagcctcaattttctcatctgcaaaatgaggaatcctacatgactggcttattgtgaaacagaatgagataatgtataggctgtacggttccagcatagcagccagaacggctgggctcacccttgcacatgtccagctgggggccgcctttctgctccttgtgtttcaggaccagtgggctagcccagtcttctcattatgaaggcaagagagcccctcgtgaggctcacgcttggagctggtacgtagctcttcacctggtcaaagcaagctatgtggccaagcccagatccgaggggtagagaaaacagactttgcctcttgagtgggaaaaacttcagtcacactgcaaaggatgtggagacgtggaaggtgaaggattgggctatgaatgcattttcccacatagtagaaacaggatctgctcaatctctctggcagttcaggatgggaaggcattttagatggactgagataagaccaggttaggactaagctggacctggaggggctggggtataggatctgactgaaaggtgcatttggcttgttcttgaggaggatttttttttttttttttttttttgagacggagtcttgctctgttgcccaggctggagtgcagtggcgcaatcttggctcaccgcaaactccacctcctgggttaaagcgattctcatgcctcagcctcctgagtagctgggattacaggcgcacaccaccatgcccagctaatttttgtgtttttagtagagacggggtttcaccatgttggccaggctggtcttgaactcctgacctcagatgatccacccacctcggcctcccaaagtgctgggattacaggcgtgagcctctgtgcctggctggaagattttataagtggagataacaataatgaaagtaacacaaggacatagggatggcccagatgtgggaagaaacagaagtgtttcagggtcaatgtcagtaaaaacacaagcttgcagggccaatttgggcagaacagtaaaaggaaaatcggctcatttggtaatacgtttctcatttctctgctgacgttgcagggtaacaacttttaggaccagtttggagctctgtaaagggccaaagaggttggagggtgagacattgagtgagagcaaagggttttatggccttcagagatggtctcgctctgttgcccaggctggagtgcagtggtgcagtcacacctcactgcagcctcgaccttcaggactcaggcgatcctctcacctcagccttccaggtgagtagctaagactacaggcacgtgtcaccatgcctatctaatttataaattatttttagagacacggatctccctctgctgcccaggctggtctcaaactcttggggtcaagtgatcctcctccctgggccttccaaagctctgggattacaggcatgagccactgcccccagcctttggcttttagtttctataaagaaacctactgggccagacgtggtggctcatgcctgtaatcccagccaaaaatctgtggggctcagctttccttggccagatatgccagtttcaacgtacagtaggagggcagaacacttgaggtcaggagttcacgaccagcctgaacaacatggtaaaaccccgactgtactgaaacttcaaaaattagccggtgcggtggcgtgcgcctgtcatcccagctacttgacgggggctgaggtaggataatcagttgaacctgggaggcagaggtcacagtgagccaagattgtgccactgcactccagcctgggccatagcgtgagactccatctccaaaaaaaagaaaaagaaaaagaaaaaaaagaatcttactggccaaattttggatctgctgctgcttggcgtaaagctatttattatttctaatttgcattatttcctgatgtattttcatccctcttgcagcagtcagggttgtcccctcgtttgacatgtaccatagaaaggttataggattgaatactatgtaagaataacgtaggcagcatttcctgtgcatgcacaggaggattttttttttttagctctggcctgaaactgtctgcattaatttacccttaattgtttttagaaattctattcctgagccattgcttaataaaacttaaggtttggagttgttttttttttttttttttttttttttttgctttagttgaattcatcaagataagctgtattatactcagattcatttactgaactgagaatctgaaggacgcctcccttctgctcccgtatgtgtgcgagtgtgtgtgtatgtgtgtgtgtgtctgtctgtgtgtcttttcttcccttttagagaaagcagtgctgtacaaagcagggaactatggtagaattgagggtaaaagaagaaaatccttctaggcacagtggcccacgcatgtaatcctggcactttgggaggcccaggcaagaggattgattgagactaggagttcaagaccagcctgcgcaacttagcaatgccccatctctgaaaaagaaaattaaaattagttggtcatggtgtcgtgcctgtaatcccagcactttgggaggccaagacaggtggatcagttgaggtcaggagttcaagaccagcctggccaacatggtgaaaccccgtctctactaaaaatacaaaagttagccaagcgaggtggtacacacctgtaatctcagccattctggaggctgggacaggagaatcacttgaggccagaaggtggaggtggcagtgagccaagattgtgccactgcactccagcccgggcaacagagcgatattccatctcaaaaaaaaaaaaaaataaaaataaaaaaaatatatatatatatatatatatatataaaatctccttctgatgataaagggttagtttgtttgcccatgacaggccctcctactgtaccttgaaactggcatatcaggccaaggaaagctgagccccacaaatttttggctaaaggcaattacctcatccctggaaaagcaactctttatgactcaaagaaaaatacatatttcccaggtagccgtggagccagtaggtgaatattcggagaatattccaaaataaatattaataggagccaggctgtcaaagaagacatagagctttgttgagcctaaagtgcttggcaacagaacctgggctagtcactggcctgtgaccatggtgttgggggagactcacactgacagtgatgttctctgggtgtgtagactgagttcatctcttcctgccctgcttctgagggaagctgttaaaaggtatgaattctctccccagcaaaaacaaaacaaaacaaaaattccttgtccatgcacccacaatgatatggtttggctctgtgttcccacccaaatctcatctctaatcgtaatccccatgtgtcaagggagggacctgtagtctccacgtgttgagggatggaggtgattggatcatgggggcagtttcccccatgttgtccttgtgatatagtgtgtgagttctcagatctgatggttttataagtgtttggaagtccctccttccttctctctcctgccgccttgtgaagaaggtgcttgcttccctgttgctttctgctatgattgtaagtttcctgaggccttccaagccatgtggagctgtgagtccattaaacctctttcctttataaattacccagtctcgggaatagctgtgtgaaaacggactcatacaatatcttgcattcaatttctaggagttttgctggggctccatagaccacaaaatatctcatgctttaaagcaggctaaatcttgatgtgtgaacattgccccaatatgactaataggcaggacacacttggactcaaatgctagagtagacagtttgtacgggagactgctctgtgagggaactgagctaatgaggtgtgttgttgcttcctggaagaactgcagagctcaactggaggaaattaaaccactcagcaaagtgtgcatttttcctaataatgagagctccaaaagcggggcctcgcacctctcagtgattccaacccccatctcattttgcaaggttcgctgttgccaaaaatgataccactctttcccgagattatagggaagccttgatgaggagggaagcataaagggaaaattgggctggttaatgcacttgacccaagcagctttcagagtttgagccctgattagtaaatcaagggagacagaagtgtggttgtgttcgggatggtatcttttaagcgttgaggtgccatcactgatgctttaattgaggtaggaaataagtgatgcctttgatcataagagaagcagagggaataaataggaaagggattttcatttgttcattcagtaaccatttatctgccaagcattctgccaggctctaggggaacagaaagaaataaggccagtcactgtggctcgtgcctgtaatcccagtgctttggaaggtgtacgaggaagaattgcttgaggtcaggagttggagaccagcctgggcaacacactgagaccccatctctacaaaaaaaaaataaataaataaataaaaataaattagccaggtgtggtggtgcacgcctgtagtcccagctacttgggatgctgagacaggaggattgcttgcaccctggaggtcaaggctgcagtgagctatgattgtgccgctgcactccagcctgggcgacagagcaaaaccctatctctaaaaaagaaaaaaagaagatgctgtagctcctgaacgcctgcactcttggagtggggatgaccagagtgaagagtgccatgatggcagcccacagagggacagaaagtaacaaaggagaagtgcctgataccaggctgggctctgggaaggctagggctggagaccagaggaagtgcctagcaggaggaaggtagtgttgggcagatagaacagtttgtgtgacttgagagacagcattctcagttctaggaaataacaaattcatagtggctggagaaagggcagggagaggcgatgaggttggagagatggatcgggctcaacttgggtgccaagcagaggaatttaaacctaattctgaaagcttagaattaggagaggccaggagatcctttaagtagaggagtgacgtgatcatatgtactctagagaggtcattctggtcgcagtagggtaagtgggatggggttggaggcaagggaccagttaggtggcttttggtgtcattcaggaggtaaccagtgaggactggaactaaggcggtagcaatggaggagaagggacaaatgtcacacagagatcctgaaaatggcagaatctgcaggatttggtgaccgataggcatgttgaggggtcatgacttgaatttgactcctgaagagacagggtggtggccttcagcaaagacagggtggtacaaaaagaggaggtttcagttttcagcatgctgaatttgggatgtttatgagcgctccacgtggagatttacaagggggagctgaagtttcagtgaaggtccaggctagagatgtgggtttgggagttgccagggtacttggagctgtagacttgcatgaggtcacccaggacccgtttatgaagagagaacagtgaagggcaaaagaaggagcttaaggatttggggaatttaaaggaaagggtaacctgtgcaacaaaaccagtggccaaggaagatcccagaggagaaaaagcccagataggaatgggggaggaatattgagtgtccaggatccgagaggaaatagcgattatacaaggagagggatggcggtgttgcatactgcagaaaggatcatcagcgatggtgaggttgggaaggtccctccattctggccacgtagagtagatgtcactggaaactttaacaagagcagtttcagcaaaataggttgcacaggagccaagtgctgggtgaagcgaggaatgaatgagaggtaaagaagggagacagggagggaaaggaacatgtcaattaagccaattaaggctgtggaaaaagagactatttacttattttttattagtattaatattattattattatttttgaaacagaatcttgttctgttgaccaggctggagtgcagtggtgccatcatggcccccagcagccttgaactcctgggctcaagccatcctcctgtctcagcctcctcagtagccaacaccacacccggctaattttttaaatgtttttgtagcgatgggatcttgctttgtcgcccaggctggtctcgaactcctggcctcaacaatcctcctgcttcagcctcccaaaactctgggattataggcatgagccaccgcaccaacccagtttttttacttaaatgggagggagttgagtagaaaaggttggcagagggagagcgaagatgcaagagagagagtgatggacgaggcaaggctctgaggtgggaggaggctgggatccacagtaaggatgcaggggtcagccttgaactcctggactcagcttccatcaagagaggaggtgaagacaaagaatgggttgagaggtaggtaagcttgcaggagggaagtgcttctcccatttccagtgtgcaggaaccacccagagagcttgataaggggtagattgctgggccccacctccagggattctgagtccctaggtctgggaggagcctggggtttttgttttttttttttaagacaggatctcgctccgtcacccaggctggagtgcagaggcgcgatattgactcactgcaatctctgcctcccaggctcaaggtatcctcccacctcagcctcctgagtagctgggactacaggtgtgtgccaccacgcccagctgatttttatatttcttggtagaggtgggatttcaccatgttggccagactggtcttgaactcctgacctctggtggtccgctgcctctacctcccaaagtgctgggattccaggcgtgagccaccacgcctggcttggtcctagggatttttatttctaacaagcccccagacgatgctgttgcggatgctacagacctgtggaccacatgtggaaattagggctgatggtattgatttctctgtggagtaggaggcactatcccttgcggactgggaggttggcccaaggaacttggcaaaaggtagaggacagtgaagggtaatgaaatccagggttctgacctagaacagaaagaagcctgcagagcaggccaggtgcgggggctcaggcctggaatcccagcactttgagaggccgaggcgggcggatcacctgaggtcaggagttcgagaccagcctggctaacatggtggaaccccatctttactaaaaatgcaaaaattagctgggtgtggtggtgcatgcctgtaatcccagctaatcaggaggctgaggcaggagaattgtttgaacctgggaggtggaggttgcagtgagctgagatcatgccatggcactccagcctgggctacagagcaagactccgtctcagaaaaaagaaaagaaaagaaacctgcggcgcaaagagtggagcccctggaggtgtctcctttgcagctgcatgaatgtgagacttggtcttgcagcctgcagtgtcagctgtgtaagaaaaggggagaagaggcaagtgggtggttctgtctagagctggggtccttcagcacttgtgggaaagaaaggcagagggacaggagaactgtggggttggcaaaaggcagagcctggttgaaggaagtatggagagtccagttggactggacgaacttgaaaccagggaagggctaatagattaaaaaaacaaaacaaaatggctaggcgtggtggctcacgcctgtaatcctagcactttgggaggccgaggtgggcagatcgcctgaggtcaggagttcaagaccagcctggacaacatggtgaaacctcgtctctaataaaaatagaaaaattagccgggtgtggtggcaggtgtctgtaatcccagctacttgggaggctgaggcagaagaatcgcttgaacccagggggcggagggtacagtgagtcgagatcacgccattgcaccctagcctgggccacaaaagcaagactccatctcaaaaacacaaaaacaaaaacagaacaaaacaaacaagtgtcccagggcctgaaagtctaagagtaagggttttgggactacgaggctggagaactgggatgaagagagattatgactgttgaagtcaaaggtggtccaactgcagctgttctgggtgtcagtgaggtccaggaaaagccatgggggtctgagataattgcactgcagtaaccgaaacgaggtggtcctcctgggcatccctgggtgtggggtcagaggctcttgaagtggtgacaggaaggagaggttgcagtgacaaggttctgatgaggtgtgacaccgcaatctggtgtaatcttcttttccaaaccaaagggcagtgcgttcattcgggttccctagagaaagagaaggaattgggcaggggcaggatggggaggtagagagagagaatgaatttatttatttttcccattttttattgtgttaaaatatacataacataaaatttaccatcctaaccatttttaagtggttcattggcattaagcacgtttacattgtcatgtaactgccaccaccgtccatctccaggatattttcctcatctgaaacagaaacactgcacccaatcacaataatttcccattcccccttccctgtcccctgataacctcttttctattttctgtcaatgaattggaccattctaggtaactcctgtaagtagaatcatacagaatttatgttttgtgattagcttatttcacctagtaatcctcaaagttcatccatgtggtagtatattgcagaatttccttcctttttaaaactggataacattccattttatatatacacagccatcccttggtatctgaaggggattggctccagatcccccttggataccaaaatccctggaagctcaaggaaatccctcacataaaatgacataatatttgtacataaactacgcacatcctcacatatactttaaatcatctctagattacttacaatatctaatgcagtataaatgtcatgtaaataattgttacgcttattgattttatatcattattattattgttattgagactgagtcttgctctgtcgcccagactagagtgcagtggtgcggtcatagctcactgtaaccctgaagtcctggcctcaagcaatcctcccacctcaggctcctgagtggctgaaactgcaggcatgtgccaccatgcctggctaatttttactttcagagatggggtctcactgtgttccccaagctggtcttgaactcctggcctctagcactcttcccaccttggcgtcccaagtagttaaggctacaggtgtgagttgctatgcttggctctgtgttttttttatcttgattttggggattttttccctctgtggttggttgaatatgaaaatacagaacctgtggattagaaaggctgactccacatactacattttcttgattcatttgtctattgatgaacacctggattgcttccaacatttagctgcgaataatgctctatgaacatgcgggtacaagtatctcttcaagactctgctttcagttcttctgggtatatacccggaagtggaattgctactctactgttaacggaccacccaccatactattttccacagcggccgtaacatcctccccttccatcaacagtgcacaagggtttcaatttctccgcatcctcttcaacacttgttattttcaggtttttgttttgttttgttttgtttttttgttttttgttttaacagtagccatcttaatggatgtgacgtggtatctcagtgtagtgttgatttgcatttctctaatgattagtgatgttgagcagagagaggtttattttaagaacctggctcacatggttgtggtaactggcacatcccacgtccgcatggtaggtggagaccttgggaagggtgtctggtggcagaatttcctctggcagtggaaagagacgatgtgaagatgggtatgtccacagcgtgctgcagttctcaagggttttctcattgtcttgcagctactctgaggatgtcaaggtggtgttctctgactcaaactaccttttccatcagaatcccacagtttccgtcccatgttgccttccagagctctgagagtttgagggtagtatgtggtggagaggcctgagtgcccagagaacacggaccttcatcagcggtaaagactttattaattaatgctcatgatcttctgcatgtttatggagcactttggaaatgaataggaattagcccggtaggaatttgcagagcctggtgtgaggctgtcattgcattgtgagtctagctctttactgtgtaatctctaaagcttacaagatttctcctggaaggtcaaggaagagtgcctctgtactcagtagagctctgatatcacatttctccctctgttcttgaccatgcaagtctaattcagtgagatctatccattcagatccagcctggagctcaccgtccccaccttcctggtccagcttagcccatctattacagctgttgtagatacttcgtttgacacttagcatctcctgcattgcattgacaactgccttgttagaagtgtttaatgtgctttagccctcatatcccagaactctgggtgattggggtggggcagtgcatggtgattggtcctgtcccttgggtgtggcagatgttagggcagagactgaggggcatcactgcacttgggagctagagttgaggcaagcagccaggaaggcctgcagatcagccacacagtttcgcccatgtgagccaagcgataccgagaaacccaggtagaccctcgaaaggggagcgctcgccttagacagacccaagagacaagggctggaggctgagctcaggcccagtggtcacctgcccagcccggcagtcatctgcccagccgtctgagcatgcacagtgcagcttccatatccagcccctttaagatcctcttctgtgcccctgccctgagggatgatggtgacgacagagtcaggccttggtgcacagtggctgaagtgctgcagtggctcattagcacaggacttttgcaaggcctagagtgactgagggcaaccttggctcctccctgcctgggattcttcagttccagggcttgggggcagaacactctcccacatgagctttatgcacattcccgccagcctgattaaccccaggggaggtggagccggcttctgctcacccacatcccccttgaagggaaatcaaacctgacccggctcagtgatactatgtgggaatactttgcccccagcaggccatgggcacggtgcacctggctgcagaggaccttctcctagttggggcttttagggcagagatgaagaaatcaagaaattggctgggtgcggtggctcatgtctgtaatcccagcagtttgggaggctgaggtgcgcagatcgcttgaggtcaggagttgaagaccagcttggccaacatggtgaaaccccatctctattaaaaatacaaaaattggccaggtgtggcagcacatgcctgtaatcccagcacttgggaaggccgaggcaggcagatcacctcaggccaggagttcgagaccagcctctgagggaccctctggagtgctcttgttttgtggaccaccacacagtcaatgagatgattcctgccaactgcctgtgagcccgtcaataatcactgtaatctccctggcagcccccagaagtagatttacagcagcatggtaaaaatgaggctgcttgatcaatgcatccctggacgatcttctccaggagacaaacacatattgtaacaaaactttattttcttctgaaaattgcctacatgattaatatggcctgacatagcccaagctgctcagcataagaaacagctgtatttcttgctccctcttcagctctgcttctctctcactccatggcttcatctgttttctttgttctgctccctgttccgttgtgctatatattgtgcaatctcccataaggagaagaaggatgcattaaagtgcaggtacctcggcactccattccactgtgtttctctttgctatttccaatgtggcttaggcgtaagcatgaaatgaaattcctcagtgctccctggacggactctcggtgcacctgtgactgagagaagcagagcacgttccccgggtactaaatcatctcttacatcacctggagccgtggagaaggccaaagctctatgctctggagtccatactggatgagaggaattcttccctttaatcactgcgctcgggcatatgagggctgctgggtattctgagggagggatgtcagcaggttgtcctgtctcctgtctccagggaggttctaggacttcccgaagaagagctggtgtgccttaggttgcacactcctccaggtgtagggtccttttccttgactatgattattggcgtgggtgttttatttcctctcctggaatgttagctctgtgatagcaggaacctctagtataacataatacagagcacttagtgggttcagtagatgccttcatttgggttcccccagaaacagagcctgaaacaaagggtttgagtgcaagtagtttattttggaggtgaagagagcatcactaggggagtggcgagtaagactgggagggaaagacatcccctctccaaagggtgtgttatgaagattgctcctgtgggtgatgggggcttaatcctgctgcggaaatttacatttaacctgctcttgggctgagggagctggggtatttgtattaggttggtgcaaaagtaattgagggttttgccattacttttaatggcaaaaaagtacttttaatggcattaaaagtaatggcaaaacccgcaattacttttgcaccaacctaatacatcagttcctggtgttctttttttggggggcggggagggggaacagggtctcattatgttacccaggctggagtacattggcatgatcatagctcatggtagccttgacctcccgggctcaagtgatcctcccaccccagcctcccaagtagctgtgaatacagccatgcaccactgcacctggctaattttaaaattgtttataggtacaggatcttgctatgttgcccaggctggtcttaaactcctggcctcaagcgacgctcccacgtcggcctcccaaattgctgaaattacaggtgtgaggcactgcaccgtgttccgggtggtccctagttgagagatttagggggtggagtaatcgcttaggcatcagcaaagaaggtttcaggcaaggaaatggaggggctggagtcagaagttgtgcggtgtgccctgaagctcagggcacaggtaggcagcacaggtagatgcgggtagatggcacaggtagatgcaggtagacatatgcctgggactgatgcctgggactcccctagtgatgctctcttcacctccaaaataaactacttgcactcaaacctttgtttcaggctctgtttctgggggaacccaaatgaaggcatctactgaacccactaagtgctccatattatattatagtagaggttcctgctatcacagagctaacattctaactcaccacctgtagggtggtgaatctgggagaagtggggctgcatctgttaatgctgtcctccttagggtttattctcagttcttagccaaggagaagcctaagggaaccagtgattcacgccttgggacgactggatgaggattcggctgaaatcttacactatgtccagctgcagtgcctgagcttttatccttcctctgactctgcatttccgatctctccttccccaggtgtaaggagctcaagtactccaaggacctgccccagatatccatcatattcatcttcgtgaacgaggccctgtcggtgatcctgcggtccgtgcacagtgccgtcaatcacacgcccacacacctgctgaaggaaatcattctggtggatgacaacagcgacgaaggtacaggggtggctgacctgtgcacaggacatgatgacagcagggggaaatgccactttcattccaacgcgagcccgagcatctgtgtctcctggtccctggagcatatctggggaagggatattttttctttttctttttttgagatggagtcttgctgtgtcgcccaggctggagtgcagtggcatgatctcagctcactgcaacctccacctcccgggttcaagcgattctcctacctcagcctcccgagtagctgggattacaggcacccggcaccacgcctggctaatttttgtatttttagtagagatggggtttcaccatgttggccaggctagtctcgaactcctgaactcaggtgatccgctcacctcagcttcccaaagtgctgggattacaggagtgtgccaccgtgcccggcccaagatttttttagaggaagatatctaggcttaccctagtctattattccttgagtcctctagagcaggggtccccaaccccagggccatggaccaatagcagtctgcggcctgttaggaactgggctccacagcaggaggtgagtggcaggagagcaagcgaagcttcatttatttttacagctgctccccaatgctggaattactgcctgagctccacctcctgtcagatcagcagtagcattagcttctcataggagcatgaaccctgttgtgaactgcacaagcaagtgatctaggttgtacccctgccctttttttttttgagatggagtctcgctccatcacccaggctggagtgcagtggtatgatcttggctcactgcaaccttcacatctcaggttcaagcgattttcctgccttagcctcccgagtagctgggactgcaggcacacaccaacatgcctggctaatttttgtatttttagtagagacagggttttgctgtgttggtcaggctgatctcgaactcctgacctcaggagatctgccctcctcaacctcccaaagtgctgggattacaggccatgagccaccgtgcctggctggttgcaacctttttatgagaatctaatgtctgatgatctaaggtggaatagtttcatcctgaaaccatctcccctgacccccatgttccatggaaaaattgtcttccacaaagccactccctgatgccaaaaaggttgaggaccgctgctctagggctcataagaatcattgactggccatggatctagatgaacttccttcttctcattagctaaagcagatgacagtgaagagctgaattcctcctccactccccaccccgcaccccatctttgttgtccttctccaaaaagcgaaataaaaaattccatcccgtgttaggaactgtttatctacattggaattctcctctgggccactgtgcccaaaatgatcttaagtagaagtgagtggtgtttgctcatcttctggaattcagcgctactaggaatgatggctcaatgaaaactgtacaacaggcaaatattgcatgtcaataacaaaactcctgggagatccttggagatatttaacagttggacaaaggcgtggcatccagggcaatgggggtgggtgctgctgatggtgcctttgtgttggatcccaacctgcaaaattcagtgtgctcactgctgggagccacccccacaagctcatgagataaaagaaagccagctagagtgagtgcctgaaggccaagaaagcttatcttctcagcaactacaggattaggagtaggctaaaccccttcctttcatcgtgctgggtaggagagggattaccctgcaagctgctccgtcgtccggaagatggtgaggaggaggcaatgccacgggtcctgtttaaaaccggattatcttgaggagcacaggaatgagcctctcctatttaatcagcctgggagctgatatccctggccccttctgaaccggcccactcttctgaagggcttgggtgcacctgggcccagtggtttgccttctctgggacctctggcttacagagatgggtcatttgttggatttttcacatccttagttttatttccttacctttggccattagttatctatagattcttctaaacctgagaatggttgtctccttgtgagaaggaggctctttcagttcctggaagcctctaagttgtgcagcaaagtctctttccttgacatgcccacggctctctgctctgtggcctttctctgcacctaccacagacctcttgctccagcagtccttccacacacccctgcatattttccccaggccagaaatctcttctctcgaactccctgttcctgtggcccccttcatcagccttctaagtcccacctgtttcccagctgtctccagcagagcacttcctcagagaagcctcctctgatctctgagtggggaagtaagactgtgaagggaagccattgtaaaaagattggtactgtcagtgtcagagcttaatcccactggggaaaatccaggagcaagtgtaaacccagacctcagagttaacttgctccaagtgcgagggagctgtggtatttatacacctttaggataatgaggccccggttctgtgctatcttagcaccttgctactagctgtcgcacttactagcatgtggtgtgtctgcacagtggactctctgaactgggtgggatgtttcccagggcctggctggtggttgaaactcagtaagtctttcaacaagggagtgcatgatgaagccaggtagcactaagaaaagtgcaggtgtgagctagtggcaaaaagactggaggtggcccggggctagaacacccagagaggagcatgaactgcagatcgggctggattggggtgaagactcactgccaatggcgcaccctctcctgaggaaatctaggtagagcccagcccaggaggaggaagggaaggttaaggcaatctcagccataactccagctccttgaccgcagggatctccagtacagggttagacacttagtgggttcagtaggtgtattagtcccttttgtgttgctataaaggaattcctgaggctgggtgattcattgattgacagattgattgattgattttgagacagggtctctcactctgtcgcccgggctggagtgcggtggtgcgatcacagcttgttgcagcctccaactcctaggctcaggtgatcctcctgtctcagccccctgagaggctgggaccacaggcatgtgccatcatgcctagctaatttatatatatattttttgtagagatggggttttggcatgttgcttaggctagtctcaaactcctgggctcaaatgatcctcctgcctcagcctcccaatgtgctgggattacaggtgtgagtcaccatgcctggccttgggtgatttatttaaaaagaaggttttatttgtctcacggttctgcagaatgtacaagaaccatggcaccagcatctgcttggcttctggtgaggcctcagaaacttctagttatggcagaagggaaggggagcaggtgagtgtcacatgatgagagagggaacaagagagtggtggggaggtcccagactctgtgagaacttcctcattaccatgaaggaggcatcgagccacaaatgagggatccacccccatgacccaaacatttcccaccaggcctcacctccaacattgggggtcacatttcaacatgagatttggaggggacaaatattcaaaccatatagtaggtatcttcatttagtttcccccagaagcagaccctgaaataaacatcttcaagtagatgggtttattcacatcaagagtgcaagtagtttatttgggaggtgaagagagcaccagtaggggactggggaagtaagaatgtgaagggaaagcatccccaaaagattggtagtgtgggtgatggagcttaatttcactggggaaattccaagagccagtgtaaactcagacctcagagttaacttgctccaagggtgaggaagctggggtatttatacacctttagcagcaaatgttttagtgtaagaaccccctgggactccaccctggaggaagttctgcttcaggaggcttggggtaaggctgaaaatgtgcatttcttataagctcctatttgatgcttacgtagcttgtgtggggagcacactttgagaaccattgggttaggtaaccacgccttgagccctgtctgtgagtcccattttaatggttcacatttcagttctacatgaagatgttcagtgagtaagaaaatgggaggaggaggtatttggttcagccagaccataaatcaatatccattcatcatcctcctcctcctctcccaaatacccaggggaccgggagttgacgatattaacatgatctccctcttttcagttcctggttctgttctctatgttttttccccgggccagaaatctcttctcttgaactagaagaggaatctaatatttttcattttattaagatgttctttgtaactggtattatcgagttttgtaaatgttctacgtctatttaaaaagacccccacacactgtaatcatggaattgaattcctgccagacatcaattttgtgtattctggtaggctatgagtttattttttttaagtctttttgataatggtgttttaaaatctccttttataatgactcttccttcctgtgttcctaatacttgttttctggtatcttgttgtcagtttctttggcaactatagatttgtatctgcatggcttcattaatagtgatggttgttaccattatgtaatgctctctttatcttagaagcatactctgttttttttgccttgaatttagttcttcttacattaatattgttgttcctgcttgctagttcacatttgattaaaacttttttttcccagccttacaattttgttttctgatcttaaaagtaatgcgtgctctttgttggaaaattcgaatgtatcaaaaagcaaatataattggaaaaaaataaatactgaagagactaaccagaggcaactgctcattcgcccatgcccttaccctctttaatgcacattttgcatagttaagatcaatagtataaacaagttgatgttctgctttttcccccgaagtgtaaagcataatcagtgccccccttttttttttattaaaaaatctctgcaaacatcattttaatgagggcagattgatctattctcagactcactaagctctggtcaagatgggctcagggaatgggtgtacaaagccggggcactctggagaagcagacgagatgagactgcagattttcctttgtcagggaattttgtttttattttaagtcatttgtttcactcagtttgaatattgacattggcctgtgttaagcccaggtaagatgcaattctttgtactctgtacatccagctgaaatcattcaggcaacatttgccagaaatcactgctcaccaagtccagcgagcattttgctgcccagatcttttggcaccatctgatattgtcacgcagcttccttgatggggtgtatcgctcctcctggtgccccgacactactctctgctgattctccccgatcttctttttgcagctgttcttctcttccttggtttcttagtccatttgtctttctacaaagaatacttgagtctaggtaatttataacggaaagtaatttatttcacacacggttctgtagactgtacaagaagcatgatgccagcatctgcttctggtgagggtttcagaagcttccactcatggtagaagaggaaggggagctggtgaggtcacatgatgagtggagagagagaggggaggaggtgcgaggctctttttaacagtctgatttcatgggaactaagatggagaactcactgaattccataagaatggcaccaagcctttcgcgtccatgacccaaacacctaccaccaggccccaccttcaatattagggatcacatttcaacatgagatttggaggggacaaaccatatcactcggccccctcccttcttaaactgggatcacttgtgattctcagcatcaggacacactgggcagtctgctccactttatgtgttctgacagtttcccattggaattgtccaataggatctaccactcaagcccagaacaattcaaacctgtaaggcctctgtctcccagatggtcatcctgggtctttgtagctccattggtccaatgatgaacttactgtgtttgccttgatctttgtttgggtgaccaggatggaggaattcgggtgcacagaggtatcacagtcataatacttgacacactccatcactggttcatgcatagccattctttatttttcctcacttctgattgagatgtaattcacataccataaaatatactataaaaataaaatagaccaggcactgtggctcacacctgtaatcccagcactttgagaggccgaggcgagcagatcacttgaggtcaggagttcgagaccagcctggccaatatggggaaaccttgtctctactaaaaatacaaaaattagctgggtgtggtggcacgtgcctgtagtctgagctactcgggagatgggggcaggagaatcacttgaacctgggaggcggaagttgcattgagccgagatcatgccattgcactccagcctgggcatcacagcaagagtctgtctcaaaaaaacaaaaaataaagtatacaattcagtgattttcagtatattcaaatgatttgcacctatcaccactacctaattccagaacattgtcatcacctgcaaaataaaccctgaacctgggagtagcctctcccaattctacccttaccccattccttgccaaatattaatgtattttctgttacgataaatttgcctcttctggacatttgataataaatgaaatctacaacatgtggccttttttcctggcttctttcactgaacataatgttttcaaggttcaaccaaattgtggcatatataagtacttcattctttttatgactgaataatattctgagtatagatacagcacattttatttatctgtttatcagtttagttgatagacatttgggttgtttctactttggggctattagggataatagggctatgaatattcatgtacacatttttgtttggatatgttttcagttttcttgggtacatatctaggagtagaattgctgggttatgtgataattctgtggttaactttttgagaaactgtcaaattgttttccacagccagactgtttttcacctcagctgcaccattttacatgatcaccattcatatatgagggttccagtttctccacatccttgacaattgttacttttttaaaattatggccaatctagtggatataaggtggtatcttgtagtttggatttgcatttccctaatgactaattattttgagcatcttttcatgtgcttatttttcattagtctatcttctttggagaaacatctattcaagtactttgcccattttaaaattgattatttgactttttaaattattgactcataattattctttattctctttatactcatctttatcaaatattctgcaaccaatttttgcaaatatgcttgcaaatattttctctctttctgtgggttgtcttttcacattcttgataatgtctttggatgcacaaaagtttttaattttgataaagtccagtttttctttttttcctttgggtgcttgagcttttggtgtcatatctaagaaactgttgcctaatccaaagtcacaaagaattgaacctttgttttcttctaagagttttatagtcctagcacttccatttaggtttatatccattgtgagctaatttttgtatatggtttgaggtagggatccaaattctttctatttttcttttttacatatatagttatcccatgagcatttgttcaagagtccaatttttcctcattgaatggttatgtcacccttgtctaaaatcaacttactgtaaatatgaggagttattttgggactctcaatcctatttctttgatttatgtgtctatgcttatggcatgatcacactgtcttgataactttttctttatagtaaattttaaaagtgggaagtgtgagacctctcaccttgttcttttttcaagattgttatgtctattctgggttccttgcatttacatattaatttcaagaccagcttgaacatttctctgagaaatagctgttagaattttgttgggattgtattatatgtgtaaatcaatttggagagtattgtcatcttgataatattaatgcttgtaatccatgaacatagatgtctttctatttatttatgtctctaatctctttcaacaatgttttatagttttcagtatacacattttacactgccttggttaaatttatttcttaatgttttattctttttaatactattataaattgaattgttttcttaatttcatttttgcatcatttattgttattgtatagaaacacaacttatttttgtatgttcatgttgtatcctttaactttgctgaacttgattattagctccagtaggtttttttgtagattctatagagctttctatatagaatattgtgttatcttcaaatagtgataattttacttattactttccaatctggatactttctatttttcttgcttaattacctcctctatttatttttaaaaatgtatttattaataaatatctcttttcctaccatgtcaaggatgagaacattcacccatataccttcctaagggtttataaaagcctcttctggagaagacggctaagtcatgagtgagctcagtaaacatgggactcaccatagtgggctattgtgtggaccaggtactggacttaaggcaaaaatctggacagaatgcaatgggcttctctgtatttactgcttctgatcttatcaagacctactgcctatcctcaggagcaggtcaaagcagaacatgtcttgagagatacgagatatgatacagtgaatgtcttccactgatccaggcagtagacagaaagcctgtagtcagaacatccaattatagataagaatgggtgctatactcattcaggcaatccatcctcagcttaaaatgaggtacatttgcaggagcagtgttaaaaatgacaactctcgctgcatctatctgaagtcacactgccctgttatggaggttggcctctgtggctgtgcgttgttgtcgtcttggatctcccttcactgtcttcttgtggactctctgaccctcttctgtgctgtctcctgtgctcttctcttggtttatgttcttattttggtggaacacaacacctggaagcttcttaagagagactgcaaggaagagaaaatctttcaagttcactcatgcctctaaagatggctttagcctcatcttctaggtgaatgatggtgtcgttgagttagatgttgccttctttcagaattttgatggttttgctccattattgtctttgttgttgttgttgttgttgttgttgttgttgttgttttagaagaaccaaaggcattctgatttcctggttttttgcatgttcttttttcctttctggaagcctgtagagtctttatcttgtcaccatagttttaaatttcacaatgatgagccttgatatgggtcagtttgcattgattagatggggcatttagtggcttccatcctcaatctattgtctatccatttttggaaatttcttggaattttaattgataattcctcctcattttttctgttctctctttcagcatctttcattattctagtttggggcctcctaaattgaacctctaattttcttatttttctctgctatcttatctttcgctatctgatatttttgctctgttttctttattctcgcttcagtttttttattcttcccttctatccattttttctatttctgctatcatagttttacttccaagtgatcatttttattctctgaaagctccttttataacatattgtccttttttattggaagcaatatgttttcttgtccctggaggatgttaataatattttttgttttaactttttctccctgcatagtctgtttctaaaagttacatttttctcattgatgtttagtttctatctttcatgttggaggctttccttagatatctggtgagtcttttctgcttatgattatctcttaaatagtgattagacagccaggggctgggtggagggggaatggggagttattgcttaagggtatgggatttgtctgaaaagatgaaaaaagttgtggaaatagatgatgatcgcacaataataggtatgtacctaatgtcactgaactgtatacttaaaatggttaaaatagtaaatttcatgttatgtccattttatcagtttttaaaaagctgatcagacattgtgcacttgagttggacttactggatttgacaatagagtgatttgtgtgggctgaaacaagaagtgggagtgggggctggacgtggtggctcacgcctgtaatcccagcactttgggaggctgaggtgggacgatcacttgaggtcaggcatttgagaccagcctggccaacatgatgaaaccccgtctacgctaaaaatacaaaaaattagctgggtgtggtggtgcacgcctgtaatcccagttactcaggaggctgaggcagcagaattacttgagcccgggaggtggaggttgcagtgagctgagattgcgccacggcactccagcctgggcaacagaatgagattccatcccccctgccctcctccaaaaaaaatgtgggagtaggaatttaccgatcagtttcttttcaaatagccttcgtgctagtcttccttattctggtctgtccattttacccccagttccaaaggcacctgctgctgccggttccattgcctcttgagtgtcctctggtatatatcgagttgatttctcagttttgggcattgttagcttgggatcatctgtcacacatctgtcacttggttaaccctctgattctgcgttctagcttcctcaatttcatggctgttgtcttgtcttgcatttcctctggctttggagggttatggtttttgttgttgctgtttgtctattttagaaatccttttactgtagtttttttgtgaattttgactagtggtctctgattcatgagttaaattcatcatcttattctgaaagttttatattcatctttgagaatgtttaatataaattgataaactgtcttccaggtatgtggtaatgtcacatgaagagtatatgaaaggcttttttttctctgtattcttaccaacactgaattttattaatctttgccatctttgttgttctggtgcaggggaaatggcattccatttttaagtgtgcatttaaaaaaatagtattgatgatgaatactttttcatatgtttatatattttttagaggtttgcctattgatgactccttatcccttttttattggagtatttatctttgtcttattgatttacaagaactttttattttattttactttaagttctgggatgcatgcgcagaacgtgcaggtttgttacataggtatacatgtgccatggtggtttgctgcacccatcagtccatcatctaggtttcaagccctgcatgcattaggtatttctcctaatgctctccctccccttgtcccccaccccctgacaggccccagtgtgtgatgctcccctctctgtgtccgtgtgttctcattgttcaactctcccttatgagtgagaacatgcggtgtttggttttctgttcctgcattagtttgctcagaatgatggtttccagcttcatctgtgtccttgcaagacatgagctcattttttttatggcttcatagtattccatggtgtatatcaagaactttttatatattaaacaaaccttttttacatcactttgcaggcatttctctcaacttttgcttctcactttaattcattcataatcttttttggcaagtataaattttacattatatagtcaaatccatcagtcttttctttttgataccaaagtcttaagaatgtgattcattatgcttagactatacaaatatcgacaactatttttatgagtaaatgtttctttccaaaataaattccagacagaggaaatatttttatataaagtgtaagaattttttaacacagagactctgtcccaaagtatggttatctcaatttaatagtaagtcctttaaccaccgatatgaaattcactgtttttatctgctgaattatttaatatttggaaacactgaagctgaatcacatgatgactgattggttataaagaggaggcaggagtcaaagaggacccccagggtccctgctcaggtgacaagatgggtattggtgcttctcattaagaatgggatatgctaagaattaagaatcacaggtttgggaaggcaatggacttcactttttggatttgtcaagttccaacatcctatggaaatttactgtgcctttaaaacttaggtgagttgtaactttagccataaagttttccttaaactactatgagaagcttctttgtttttacaattagtgtcctcaatactcttttctttttctttttcttttttttttttttctgagacaggttcttgctctgttgccttagctggagtgcagtggtgtgatctcagctcactgcaacctcccacctcccaggttcaagcgattctcctgcctcagcctcccgagtagctgcaattacaggtgcccaccaccacacctggctaattttaatatttttagtacagatggtgattcgccatgttggccaggctggtctcgaacttctgacctcagatgatctgcccaccttggcctcccaaagtgctgggattacaggcgtgagccaccatgcctggccctcaatactcttttatatgtcttattaatacttcacttttttaatttaccttgttaccttctttgttgtaaagcaggggtccccaaccccccaggccataaactggtccatggcctgttagggactaggccgcacagcaggaggtgagaggcgggtgagggagcaaaacttcgtctgtatttagagccactccccattgctcgcgttaccacctgagctccatctcctgtcagatcagcagtggcattaaattcttacagaggcatgaaccctattgtgagctgcacatgtgaggaatctaggttgcgcgctccttatgagaatctaacgcctatgatctgtcactgtgtcccagcacccccagatgggatcatctagttgtagaaaaacaagctcagggctcccactgattctacattatggtgagttgtagaattacttcactatgtattacaatgtaataataatagaagtaaagtgcacaataaatgtaatgctcttgaatcatcctgaaaccatccctctgctctgtccatggaaaaatggtcttccaccaaagttgttcctggtgccaaaaaggttggggactgctgttctaaagcaatagcatggggaggaaagagaggaataaaatcccagcccaaactttagctatgtggtcttggccaaggcacttaacttttctgaccttgtgtaagttggggtaatagtagctttcattcagggttttcattgtgaggtttagaggtaatacttgcaaggcacatagtgcaagtcctaacaatatcataaagggtactgttgagtgtgctcatgacattatttgatttgctaactccagttcattcatcggtattcaacttgcatatcatccacactgggaaaccatactgaattgcattcatttatctgcctatctctaagtggtaagacacttgatggtaagaccaatagcttgctctgtgccataatcccaggatctagcccacagctaaattacagtaattgctgaataggttaatttcaattgcacatgtgcagagatttttttccccacttctggaattgttctggaagcttttgcatttcacattgtacatattttggcttgaatgctacagttattttggtttaggtgtcagaaattgcctatctcccatcaccatcatttgagtttcttgatgatttggacagttgtacatcttgtcactaatacttccctgtacgacaagcatatctgatcaacatcttgtctcggttggttgtattcaaaggttgaaagcaagatggctgaaaactttttggagtggaaggttataccctctgcacttccaaaagggattttggagaagtcacactggcattgtttgcttttcttcttggtttataattgcagagatgggagaagtcttgtgtttccaagagataacattcttcctgtgtcgctgaggctctgagtgaaatagccgagagacaacttgttatcacacagctccatgcttggccaggctctctttatttgaacatcacctgccttcccccctgcctgtaaagagccttcctaatcagtaagaatacttgtttttgcccccaaccagatcatagcaatgtgacagcatttgctatgtgggtctgtaatcctaactaggttgtgcatttacatttctctttgtgtttttttaggccccagggaggaaagaatgagagtgtgtatctttacacaagcaatagtgtgtgaaaaccccagctaaagcttcagccactaactggcttttaaaaacaagaagaacaacaacaaaaccctttttagttcaaactaattataggttcacagaaagttgcaaagatgaacaggaaattccatgtagccttcgctcagtttctcccagtggtaacatcttgcaaaactctaggatactgtcacaactaagaaattggctttggtacattggctttttagcccagataattgagaagtgtgggaaggtcaggtggtttggtattagcagagctgatgttcagctggaatgtgctacagtgccattccagtccacatctgctctgatgttatatagctcgatagtctccgctagctagaagaaacatgttaggttctgcagcccttttggatgctaataagagctgctattgatagaacactcgtatgatgcattagtaacttaacgtggacatttcctgtaagcaggcatgagcatttcgtttgcgcataggattcacactgcctttgaccttggaaacttcagggtcctgaatacggagcaccccagaatgctagagaaggatgaactggccggatgcctcacctcagttattccactcccggctgccaaacgcgtttaaagaaaactcgaggaagaagtgaccaagcaccagcgtgtaaccctgttctccccagggctttacatttcttgtgttctgttttgctctctctttaatgactgtgactttggctatttcaaggaagagattcgccagcttctgagcatttggaatcaatatcaccgtaaataagaacataatgaaagaaaaacacagcccagcctgtagacaaatttgattgctgaaattcacgtgttattattagaatcagctgcaaatgccagactttcaaatgcctttgatggggtaaggtaggggaatgctcttttaaattggggagacaacttggagctctcacctggatagcctatagcttatgcgtactatgatgtttccttgtaggtttgggctactcgtatttattttctaaaaggtaaaatgtaaatggaagaagcagtagagatgaatttctcaacaaaggaattggaagctgagatggctttcctttacaaagtgcccctcatgaatgcacaactcagtgtgatatatttggtttaacactttggtattttgcacctcacatctctttgcttttcttttcgtcttttgctttcttttgtcctttttgtccttgctttgatctcactatggaatcgccctcaaaatgctttcatacacagcaaaagcttccctctttaatctctctcattcttcctgaagtttctcactcttgcctcatttttgctccagcccatagtcagcaagtgcattatttaagtctgcaaagctgagagatgctcagagaataaaatatgcaatgcagccacctcctgggttatttcatcttgcagttttagatgcttggttcctcaccatggctattcttcaagcccaggatttcagagacagatgggcccatgccatagtggcaaggctggggtggggtgtgtgtgtatcaccatatatgtggctcctgtatccctgaggcttcttcagagcttcattgtattgtttagaagagttggaggcccaaaagattccctggatgcccactcttttgaaacctcttaatcagcccttaggcctcttctctgcggagcactgaccatagtcagcagaaggcagcctagaaaaaggaggcgcctgcctcaagtccagagcctgctgctcccatcctgcagcctggccaactttccactcatggttacagccctaatcctttatcttcactctctgaaactggtgctgatggctgcagattcagaagaaaatgggatcatcatactggtgctttgcactcacatttggtcctcatgcaaccctgtgcagtggaataatgttgtacacactgataattagtctgtaatcagaagtgtgggtgcttccaagctacttgagggagccagctctcaggacaagcccaggccaggccacagcagctttgtattagcagacaaatgacttgagatttcacaacatcacattcacaggaatcagaggtaacaatggtgatgcatgtaggcatgccacttacaaatggtgtgacctagggagagttgctggccctctgtcttagtccatttggggactgctataagaagtacctcaggttgggcattgtggctcatgcttataatcccagcactttgggaggctgaggtgggaagatcacttgaggccgggagtttgagaccagcctgagcaacataacaagaccccatgtctacaaaaaataataataataaaatattagccaggcatagtggtgcatgcctgcagtcccagaaataataccgtaactactttgtatccataaaaataaaaaataacaaagttaaacaaaaatgccttagactgggtaatttataaacagtgaaatgtattgctcacaattcagggggctgggaagtccaaagtcagtgtctggtgagggcctagtcctcatagatgtctctctatgtgtttctatgtcttgtaagtggtgaaccagctccctggggcctcttttgtaaggacactcatcccattcatgagggtagagtcctcctgacctaatcagctcccaaacacttgccctcttaataccaccccattgaggcattgattggcatttaacatgaattttgagggaacacagacattcagcacatagcacacgctctgtgcttccgttttctcatctgtaaaatggggtcgatcgtgcctttacctcacagagtctttaagaggtatgaaggaattgttgtaggccaacagcatgtggctcttaataaggacccagtaagtatgaagacaaatgttgtggaatgttacgagtttccaagacagcccattcactggttaaattaccaaaggagatctaatttggctgactagtgttctggagtgtttcctgattagctgacatttttagtgagcttggttagcaatttggggatataaatatttcattatagacacagacaagcatagtatttgaaatgtttgaaaaatagtgattgtcagcagaaaaggaactctggcattggtggaatctgcctccccagttggtattctcactgagaaactaacaaagcttccgcattgggccccttacttgcacgggtgcccttcgaggtcatctgatggccccttgttgtgtgtttacatgtcatgcatttttggagaacttacaaaagtaagcttttaaaatgtttctcaaagagaatgcctcaaattgtgtaaatttcaggtcccacaaaacccaggttcatttctgggatttgctatctccattggacagataagaaaccccctaggttgcatgagcagaatatgcaaccgagtttctccccgcgccaccatcttttcgttcatttttaaagataatattttaaaactttgtctaataatatttttaaaatattttaaaatagtctttgtagggctgcttttatacatttagctgattggttatttcaggcataaaggtattctcaggcgcacctgtatttccaggtggtttttttttttttgagatcgcatcttactctgtcacccaggctggagtgcagtggtgcaatcaccgctcactgcaacctctacctcaagctgggctcccacttcagcttcccaagtagctgatacccaagtgttttcagtctgtgttttatgttctttctagggcatcaaagctaattcttacatatataaaatattgaaatctctctgaaaaaaagaaaaaaagagatgatgcagaaatgtcaagtgtcctgactaatgtctgtgccaaactctgcgttgaagaccattttttcactgtgatctctgtcataaatccctaagcacagagaactggaagtttccattggggtggagagaaaggccggcatctgggagggcccagggtatggtcaccatgcaggggctggattctctccacatccagtcttgaagagctcaggaactcaagtcccatcaggatgaggagtcttatctaagtgtctcaccaaatgcttccagacagaggtagacttggaaacccatggaacaagctaggagcagagatgtgcccagggagaaggtggcctaggaggaacccaggggaggggcaggccagctgaccagactgggctttaggagcaagcctgcagtccatcaattaccagcatgggggttggaagaaccccctggccacagaatatgaatcagaccttcagcaaggtcaagggttttaaattcacacacacggtccaggcatggtggctcattcgtgtaatcccagcactttgggaggctaaggcaggagcatcacttgagcccagagttcaagaccagcctcagcaacatggtaaaaccctgtctcttcaaaaaataaataaaattagccggacatggtggtgcatccttgtagtcccagctactcaggaagctgaggcaggaggatcacttgagcccaggagttggaagctgcagtgagctatgatccggccactgctttccagcctgggtaacagaatgagaccctctctcaaaacaaaacaaaattacacacaacataaaatcacctcttctgcaccgtcaaaattaacagacataaaagaccacatattttacgactccattttcatgaaccatgtgtattaggcaaatttataggggcagaaagcatgttagtggtcaccaggggttgggaaaggggagatggggagcagctgctcaatgggtatggggtttatgtttggggtgatgaaaaagttctagatagtggtgatagttgcacaacattgcgaatgtactcaatgccagtgaattgtatattgtaaaatggtcaaaacattttaaacatggtaaaaacaatgaaaaaagtgaaccagtgcttttgagatgtttggggtttgcgtgagaacgacctgggggtgctggccagttccactaaggcccactgaattagggataccgagaaaggagcctcggaacctgcattttcataaggtccccagtgattctcactctgggaatactggcaggcattttcattctattttgtttcttaattggaacgtgccatatgtgctatgttctcgtccccagctgtcacaacccatgcattcacagtgagcagcatgcccaaacctcagcagctgctggtggggagaggtgttggtgataagcgtggcagtggtggcaatgggagttgatggtgtcagaaggagtgttgatagaattgtggcagtagtagcagtggtagcaggaacagggaatgaaagcagaaggcaggaccatatgggatccttgtccagggactgacctaattgtgagattgccccacgcagaggtggccagccatcaggatcccagtattggagccaagcttggtggctcacatccataattccagagctttgggaggccaaagtggggagcgggggagggattgcttgacgccaggagtttgaaaccagcccgggtaacatagcgagacctcatctatacaaaataaaataaattagttgggcatggtggtgtgtgcaggtagttccaggtactcaggaggctgaggcaggaggatcgcttgagctcaggaggtcgaggctgtagtgagccgtgattgcaccacttcactccagcctgggcaacaaggccagaccctgtctctgtctctgtctctgtatatgtgtgtgtgtgtgtatgtatgtatgtatgtatgtatttatatgtattttatatatatatactgtatatgtgtacatgtgtatatatacatatatatacacacatacatatatatgcacatacacaaacacacacacacacacacacacacacacacacacatttaaatatatctatattttaaaagattccagttttggaaatggcatgccaaaccctcaccatgtaggccaaagtcacttccaaggggttcagttttttagatgaggcaggacaagtaggtcgtaggcagtggggaaagtggagatggacagggcaacactgggattctggaatgtcagctcagttggagtaagctctggcccacactcagggtctaattcatcccagatggagttaggcaggggggtaaatgctaagccagagccacccaatatgcacttagcagaccagttgatgcagcagctccccatttgaagcttgtaagaaatacaagttcttgggccacctcagacttactggtgattcggatgcaggttaaaggtagaggaacactcactcatctaagcttagacagattctcctgaatctccatactctgaagggcaattgaaatattcagtaagtctcatcatcaaggcttaacaactgtgtgagggttgagaggtcaggttgcccaccattgtggatgtgcagacttggccaagtcctggactgggtggccacttcccaagtacacataaaaatcccaagcactgacacttttgcattggttctggaagcaggtggagctgagtctgttttaggaccaccaggttcgtatgtccactgtgcagtaacagatcaattatgctgagacagcaggatttgcaacagagaaagagtttcatgagtatagggtagccaagtgaggagacaggaagagatcctcaaatccacctccccaacgatttctgggctggggctttgaaggggatcatggaaggtgagaggctggagaatcaaggtcattcattgatcagggtaaaggggatgaaattatcaagatgtggaaactgcgttctttggtgagtcagcttcttgtggggtccttcagaccagctgatgtcagcagtttcattggtatgcaggacatgaaagaatatctcaaagggaaaacttaatattttataatgttcaagttgttatctatagagcagttaaaggggactgtaatcttgtaacagggtctattgtcctagtcattctaggacaataggcactaagaaactatgatgaaacaggtcagagactaatgattaatgctgaatgtgctgcacgcttggtttattttaattttcccctcacttctttcctgatttttttttttttttgagacagagtctcactctattgcccaggctatagtgcagtggcatgatcttggctcactgcaacctccacctcccaggttcaagggattctcccacctcaggctcctgaatagctgagattacaggcgtgtgccacaaagccaggctaatttttatatttttagtagagacggggtttcaccacgttggccaggctggtcttgaactcctgacctcaggtgatccacccaccttggcctcccaaagtgctgggattataggtgtgagccatcacacccagcctcctgattaattttataaagtgtataggggcaatttcaagtctactaggtcaatacttgctcctgagcagggctctgagcccagggatggtaccgatagtttattctgtcatatcactgaaagtgcgggattgagacagaattctgtaatgttctttgctttagttcttaccgttttgtagctttctttttgccaatttatgctccatgagcctggatgacatgtgtttgttttattgttaaggagcaggtatgcatacctccctctccagtccttcctgatcacaggcagtgttcgcttctccccctcaacctcctcaaatgctgtttatcaaaatcttaaaaaacacaatggttcccaaatggcacttggccaattttgtattggattttataacatttatttttgtcgaaatgagtttctgcatttatttttgcagaaatgagtttctgttttcttctctgagttttttgtgaggaaaaaagaaagtaagatgtttttcttagtgttcttataatgtcctagaatggtttcatctgttaaggatgataaaggatcttaggtgaaggggtgactttctttttttttcttttttgagagagtctcgctctgtcacccagactggagtgcagtggcacaatctcagctcactgcaacccctgccccctgggttcaagcgattcttccaccccagcctctcgagtagctggggttacaggcatgtgccaccacgcctggctaatttttgtatttttagtagagataaggtcacaccatgtggctaggctggtctcgaactcctgagctcaagtgatctgcttgtctaagcctcccaaagggctgggattataggaatgagccaccgtgcctggccaagggggtgactttctaaccagtgtcaggttggggatttgtgtgcttccatgggagcctgggggccttgttttacttggctaatttatagactcattcactttaaggtgaatttgggctcttgcaccccacctcttcttcggtttctctccgttttcaaatctcaacaccctaatgctcttaggctgtctcagatgtgttccaccagagccaggcttcctggaagtccctcttgagatgtcccactcatccagttctccttgtattgaccctgcccctgcaggagacagctgcatctgcagggatttcttttttctcactggtactatcaggggccttctgtttgtcttgatcaacggaccattctcagcttgcattttctctaatgcatttgactttcctgaccctggaggttgagcagcttttggaggacagggactctgaaccttctcacccacagaggctcctttaaatatttataaaatgaatgcacatatccttcttccagaaactctgccaaacacttcacaggataatgcttcggaactggtgtcataggagcattatcctgtaaagtgctggactctgtttcaacacctgcagatgatgctcttgggctctcaggtttgagaacttcatttcctccttggagtcccgtctgtaccgccttgagtatggcttctccagcccttcttccttctacattctctatccagccctgtacaaaataaaagacattagctgggcatggtggtgcacgcctttagttccagctgctcgggaggctgaggcaggaggattgcttgagcccgggaggtcgaggctgcagtgagccatgattgctcactagccctccttcctgcctcctaaatacatgtgttccacaacgtgtggttctaagtcttcttccctgcatttcctggaactgtcaccttctctcctaggccatcatctccctttttttttttttgagacggagtctcgctctgttgctgaggcttgagagcagtggagcaatctcggctcactgcaacttccgccccaccaggatcatgcgattctcctgcctcagccccgctgagaggctgggattacatatgcccgccaccacacccggctagtttttgtatttttaatagagacggggtttctccatgttaggacatcatctcttatcactcagtgcctgacacctctgccctgttttctcacctccagaccattgtcgtggttcagctgcctaccccagaatgtcctctggccccctcaacctgtcctcagagaaactcatcaacttgttcttctcttctcttctttttctctttttaaatcaatcttatctggctaagtgtggtggctcacgcctgtaatcctagcactttaagaggctgaggtagggggatcacttgaggccaagagttcgagaccagcagggccaacatagcaaaattctgtctccactaaaaatacaaaaatgagccgggcatggtggcaggcacctgtagtcccagctacttgggaggctgaggcaggagaactgtttgaacccaggaagtggaggttgcagtgagctgaggtcacgccactgtactccagcctgggtggctgagcaagcttccatctgaaaaggaaaataaaataaaaataaaataaatcaatggcatcttcccagtttcctagactgaaactttgatgctcatgatactgtcatctaagtagatccaatttttcacttaggtgttttttggtgtggtattttagaatagtgagagctcacgtccagatctgctgcataacttaaacaactttttccgttaatgctcccagccaaaacagtttctctgtctgtgactcctcacagcactcttcctccgtgaccattttttttgggcgagtgggggccattagcctcatttaccttataatattgaatattataatttgtttttattttattttttttttaggcagagtttcgcccttgtttcccaggctggagtgcagtggtgcgatctcgcctcactgcaacctccgcctcccaggttcaagcaattctcctgcctcggcctcccgagtagctgggattacaggtacccgccaccatgcccagctattattttttgtattttttttttagaagagacagggtttctccatggtggccaggctggtctcaaactcctgatctcaggtgatgcacctgccttggcctcccaaagtgcgccttcctataatttttaaacgtatctcatctccttaactcgattgtaagcatcttgagggagcacttgtgtctgaattgtctttgagcacaggccagagcacaactcagtatcttataaagtccagaatcacactgcagggactgggaaggaagcctgctcagtgtcacttgttcttaaaccctgatcattggaggtggcatctaccttgatgtttccatacactgttgtttggaacagtgtatccctgtacattgtaagagtgagaatggtgtctactgctatacagtaggccctagactttataaatcattttggtggccaggcacagtggctcatgcctgtaatcccagcactttgggaggctgaggtgggtggatcacctgaggccaggagttcgagaccagcctgaccaacatggcgaaaccccatctctactaaaaatacaaaattagccggctgtggtgacacatgcctgtagtaccagctactcgggaggctgaggcaggagaatcacatgaacccaggaggtggaggttgcagtgagctgagatcgcgccactgcatttcagcctgggcaacgaaagagaaactccgtctcaaaacgtaaaaataaataaaaataaaaatgatattggctagttagaaagacaatctgttgttcataggaagttatgtaattgatcaacattaataattatgataaaccaattattattagatttaccatttattgaatgcatattgagtgctttctatatagcttttcctttagttgtagcagccataaggctagtaccaaatgattaggccttatccttttactcctttaatacctcccaaagctctttagatgtgagaaggccagtggtaatgacccacactttcttttgccaaccttgccaatccctacccatatatcttccctgaagtctcgcaacttcttaacaaatgaggaactcatttgatacccggatgtggtgagtgatgtagccaggagctgacatcctgttcctgggaagagccacgactaagttgcaggtcacgtggcagctaagaggtaacagtgcctccagaactcctggcatggtgcccagcgctcagcattcagaatattctccctgaacttacagagattcctgcagtcacaagccaaccctggtcagcaggcgggattccccttgtagcattccatgacctgtggcctttagtgacatgtccctgagtcccccagcacccatgcaggacatgtacctggagtgcaagtatctaagaatcccctccctgttagcccctccttttcctccctatacctggtgatttttatgcacacaaagtatcactttttttttttaaatgcctttagttttatttattcttaaaattagacaccaggtctttctctgttgcccagaatggagtgcagtagtgtaactatagctcactgcagcctcctgagttcaagtgattcttctgctttggcctcccgagtagccggaagtacaggtgcacaacactgcactcagccaagtatcagtctttatgtctatagagttagattcagttgagttgtgtttcagctctcccgttagcccatatgtgaccttggaacaggttagcctccctaagattatgtcttcatttgcaaaatagaattaatttagttaattaatgaaattaatctagcaacctcctagggtttctgcaaggataaaattagctcatagaaatgaagcactttgccacctgcttgttgcagaagggagggtattcaatccctggtagcattagttctgcctccaaggtagcatttctactactgagcaaagacttacattgcatcccaaggcacgtactgtaagaacgagtctgtgtgcagatggaaaagcccatatagaatttgataaaccggacaaggattctggccaagtttggaggaagggccactaagaaaaggaatcttgaaggacgtctgccggctcatagcagccgggatataaaagccaggcctggttcccatcccgctgtacggattgcaaactgtcagaagatagctgtcctgggtgaatgcatcagagatgtcttctgactcctagactgatgagattttcttttctgccagaattactaacatgcgattttttttgagatctttgaactccctgaagatctgtgggcattgcagtgggttagatgcaaatttgaaatgacatgtttatagaccttcttgcatttttgtcatttgcagaggagctgaaggtccccctagaggagtatgtccacaaacgctaccccgggctggtgaaggtggtaagaaatcagaagagggaaggcctgatccgcgctcgcattgagggctggaaggtggctaccgggcaggtcactggcttctttgatgcccacgtggaattcaccgctggctggtaggtcatgagctgaaactcaggggtgctcaagacctgcattgtggttgagaggggctggaatctgggaggtgggacatttcacctgttacctgtagtggcactgggagactagagagagactcgtcaaagaagaaagtgagaccattgtctgggataaagctagggagcagggagaaatttgtctgccgtctgttcagttcaccatcattggcatcatcgtcatcatcatcgtcatcaaaatccccagtgaaaatgttttatcaggctgggcatggtggcttgcgcctgtaatccctacactttaggagcccaaggtgggtggatcatttgaggtcaggagtttgagaccagcctgggcaacatggtgagaccctgtctctactaaaaatacagaaattaacctggcatggtggagcacgcctgtagtctcggctacttgggaggctgaggcaggagaatcgcttgaacttgggatgccaaggttgcagtgagcctagatcgcgccactgcactccagcctgggtgacagagagagactccatctcaaaaaaaaaagaaaaaaagaaaacggtgtatcaattagataaaactcaacagaatccttgcaaatggtacaagacagtcatatttttcttgttctcttttccttctttgctgctctgtttgcagggaaggatggttgtctgtcattgtgagaaaagagatatagttataattctaactactcaggtaaagctccccagaatgtatgggattatctttcacatcattcggaggaaggtgaagcgcattttctgcagataggccctgatatttttccaggtgaaaagaacagaatgtgagaaattggttgagtgtacggggagtagaagattttggatgcacaaagagtgaggccacaaaaatgccagaatcatgttaaaattggaataggactttccagttttaaagcatggtcagataattgttgctaagtaaccaatgatccatcaagttagaggttaaataacctgtaccctgggttgcttaattagtaagaagcagagtcttgtatttcacaaatatgtttatttacactcattgaggccttcttgagtaagtgttgttcactgtactagatttgaagaaccaatatcccatcactaattaacattaaaatgtctgttcttcttcatttgcaacaacctctagaatccttttaatggcaggataaaaagacaatgtttatgcatgtgaccacgtaagaaacccagggccactgataacactgaccccttcaagtgcatgctggggtctattgccatctcggccgccaattttccctcccagttttttgctgtcatcaaaccctggtgacacccagctgcatgtcttcagccctcatctctctcctgagctccagagctgtttatctctagtaataatcattcccaaagtgtggcgccccagacccacagcatccgcagaatctgagaacttgtcggaaatgcaaattcctgggctccactcagtcccctgaaatcagaagccgtgcaggtgagatccagcgatctgttgtaatcagccctccagaggactctgatgcatgctacagtttgagaagcactgagccataatggaagccttctgaaaaagattcaggcgaatgttccgttacagcctcaggcctggcataccttgtcttttccttggcatcattgcctcctcgtttctttcctttcaaaactgaaaggacatggccccgacacatgtccctttcccttgattttccccttgccatcatgttactcatcctgtcaacctccacctccagccagttttgtctgccatttctcctgtctccctctttctctctatcttgaccaccactctcctagcttggttctttcttgacattcacctaaaccaatgcggtcactgctggaactcattcttttggcagatacttgctagatgcctaccatatccctggtgctgttctaggtttggagtttggcactgagtgatttctcaggactttcagtggtaaggctggaagagtactgcacaaactgggacagttggacactaagctggggttcaaaatccagcaggtttggtatctgccctcaagtctacagtctaattctagtctacctaatcaaatccacctatcatctaattctcactgatgtctgtgactttagtctttgccattcagacgcattttccacacttctacccgggtggcatagaaccctctctgaattaaaaccccttggcagttcttcattacaaggtagacagtgtgtctcaacttttaccaggttctactgcaataaaagtctccagtcacaatgacttacaacaatacatgtttctctcttgtctgcatggcacgtcagctgcggttgtctggctgtggctgtgcttgatttctcctctgtgttctgagagtcaaggaatcctcctgtctaggacattccatctttgtggctcagggaaaagaacagtggctgaacttcgaaatggctgtttctgctctgatgtgacaccgtcattttgctcacatcccattggcaaaccaattcacatgtccaagttaaatgggaattggagactgggggaaggagtgtgcttctctaaggaagcattgcaggccacctggtaataggcaggacatccccagggaggagggagcaaattattgggaatcgtcatacattgtctagtagacagtaagatcaaaattctcagccgcagaaatatcagtgggaccaggcgtggtggcttacacctctcagcactttgggaggctgaggcgggcggatcacctgaggtcaggagttcgagaccagcctagccaacatggcgaaaccctgtctctactaaaaatacaaatacaggcgcctgtaatcccagctactcaggaggctgaggcaggagaatcgcttgaacctgggaggcggaagttgcagtgagctgagatcatgccattgcactatagcctgagagacgagtgaaactccgtctcaaaaagaaaaaaaaagaaatatcattggaaccaaggtcttctgcctccatactcagtgactctttcgctgctgatagatgggctgaactgaatgcttctaatgcatgatctggacttgcatggggttcatcatggttcatcaaagaggtagtggagcttcagaattaagacatgaaccagaccagctaggttagaaacctccttctaccaccacttggctgtataacctggggcaagctacttaacctccctggtcctcagtatcctcatttatataatgctgatcattgtatctacctcatacgattatcttgggggttgcattagtcaacacatgtgaaatatttcgaatggcccccagcactagtaagtgcttaataaagatcagctatcattagctcataaggaaaaataattcgtgttcagagttgattagcaaaggcagctgcgcagtcattgtgacttgaataaggtggggaaaatgatctaagagttgagaggaagaactcccacgggagaggtggtacttggtcttgggaccaggtggtgagagaggtgtgggaggtggtacttggtcttgggaccaggtggtgagtgaggtaggagagatggtacttggtctaagcctccttagatggctgtgctctctgccagtagcaaagggcatccccaggggagaatttcatgagtggaggcttggccagggccatggtcctaagcctgcctggaagccttggaaaattagtgccatttggcttcagcttatatggtgtgtgcagaagtattggaagcaggtaatggcccagggtatattttattgctcattttaaatagaaagatgagatgagccaacaggtaattcaatagctgcaaatgaaaagagatgggttgtcgactgtgtgttctcattattcttcccgataatgcagaggaatgggattttcgcttgactctgttccaaagcctgcattctgttataagctgggagattaatgccctggcttaggagagccatcttctccttctcgaatatgggaaatgatcccttcccgcgcctgcctcggagacacacgatggtggaggtgtctggccatctgctgtctcctaagccagtcgggctacaccttgaacctggagccagattcctgacgaattacctgctgcagcctcgagctggggaagtgagcaggaagctgggattctgcctgcctttgcatttaattagtttccagtctcctattgctaaccaattcaattagatccctttaagaaatcaattaaatcatcaattaaaacaactgaaataatcacacacacacacacagagaagctagtgaaatgtgtgttaaaaccaggccatccgggcagaagtgacctattttgggaaagggaattcagtgccagcagaaaaaacaagcggtggcagtcagtgccctggggggaaactgacgacactgtataaaactgtcatgcaatgtgaatcatggagtccaccgtcagtatgagaagtgagacttggcactttcttgggaaggagaccccatgttctgaactcctcttgctccaggcttttcgggccagagcaggcatcactctagtgattccaacaaggggaaaggggtgcgctgatttcacacgcttcacagcccaggagtgaagctgcaggatccagcgtgggcaggtccctgggagcctcagtttgcatctgagttccagccttcccaaagcccagccttaagtagctaaatgctgttcattccgtgtggtcttgggaggtgtgcctcacgggagagaagagaggtttcatgtctatttctctatgtttcagggctgagccggttctatcccgcatccaggaaaaccggaagcgtgtgatcctcccctccattgacaacatcaaacaggacaactttgaggtgcagcggtacgagaactcggcccacgggtacagctgggagctgtggtgcatgtacatcagccccccaaaagactggtgggacgccggagacccttctctccccatcaggtctgtggctggtgagcctggcggccaacgagcccccaaattcaagggtaaaaaggagctactgagagaggccaggaaagcctgccttgggctcgagcagctgtgtgcacacagctctccaggagccgccgttgtctcaggatcacagctttcctgcagagggaggatgttgcattttgcacctttatgtaaagttttcaagtgcagctttccaacagcgatactgagaagtttcaaactgatagtaatgttcacacttctttattcttcctcgtataggaggaactgcgttcaggagcttttaaggatgaagtttgaaagttattttttctggggctattttatacttgaagccttgtactgttgtcatgtttgcactctttttcatgatacaagatcatatagaaaaggacaagggggtgtggcattctgaggaactggagggatgttggggagctctttatggctcttgccccgggtcccacccagctgcctctcgggatatggagatcaatatcttgaggcataccagttgcagaactcaaatagaaaggaggttgaggccgggcctggtagctcatccctgtaatcccagcactgtgggaggccaaagtgggtggatcacttgaagtcaggagttcgagatcagcctggccaacatggcgaaaccccttctctactaaaatttaaaaaattagatgggcgtggtggcaggtgcctgtaatcccagctacttgggaggctgagacaggagaatcacttgaacctgggaggtggaggttgcagtgagctgagatcatgccattgcactccagcctgggcaacaagagcaaaactctgtctcgaaaaaaaaaaaaaaaagcaaggaggttgaatgaaataggttgatttcaatgctatattagtttcctcttgctgctataacaagttactatgaaaataatgacttgaaacagcacagattgatgctgctacagttcttgaggtcggaaatttgcaatgagctgatggaactaaaatgaagaaggggttgggtcaggagggctgggtcaggaggtctggtccttctgggggctcttgggagatccatgtccttgccttttccagcttccagaagctgcctcctcccttggctcatggctatgtcgcatctccctttctctctggcacccttcatcacgtgaccttttcctcctttgcttccttccttcccacttataaaggcttttgtgattacattctgggaccatacaagaatccaggattatctcccatcttgagatccttaacttaacaacatctgcaaagttcttttcctaaataagggaccattcacaagttcctaatctctggaacctgtgaatggtcctttatttgggaaaaagtgaaatgggagtgttcccttatcccctttgcggggcatatgacaggggtgtggcttgcttcttcagtgccccactgctcaaacccctagggggatcatgcagatgggtaggttgcggggagcattttggggctccgaccccatggcggtctccaggattgagtgtttacagctcccgaagccccagtgggcatgtgttacagtgtgctctttcatctttgccatctgcagggagcttgtgttaatcagcttacttagaccctctgccttatcacaaggacagagggctttctgtatcctgggtccttgccctagtgtgtcagaaaaaccagatcacatgtgggcttagagaatgagtgcaaggtgttcctgagtggtggaggtagctctcaatgagatggatggggagcaggaagggggatggagtgggaaggtggtcttcccctggagttgggttgcacagcagccagactctccttcaactacccctggccgaactcccctcagcatccacgtcattctgttgttgctagcctgctggtgtctgctggtgtctgtccatgtgttctgctcctctcaacgtccagccgcttgtgtctgtgcccactgtggtcccgggtttttatgggcacaggatgggggacagggtatggtgggccaaagggcaactttttcagtgcgaaaacagaaatacctgtcctcatttaggtccgtgggcacaggcccgagggtggagcccttgccagggaccctgcccttctctacccagcacttccctgcccctgttgcatatcaaaaggactttgcagatgtgatatggaaatcctaatctctggaacctgtgaatggtaccttatttggggaaaagggcttggttgaaaaccctctgatccccgagttatagttcagtactttatgtgagttctacttgaggaccaaactgactctaaaatcatggttctgtcttaagtagggagaggcaggagaggcctgtgtacctgggctcggttttaggggtgtgcttgttggtgttaagtaagatagcacgatggaataatgaagtagggatgaagactttttacagataatcatgaagttctttctcagtttaaacatttgtgattaacaagagtaaaagtttagccaggcccagtggccctcacctgtaatctcagcacttcgggaggccaaggcaggaggattgcctgagttcaggagtttaaaaccagcctgggcaacatagccagactgtgtctccactgaaataaaattaaaaaaaaaaattagccggggtggtggtgtgctcttgtaatctcagctacccaggaagctgaggaaggagggttgctggagcccaggaggtcgaggctgtagtgggctgtgatcactcctctgcactccagcctgggcaatagaaggagaccctgtcacaaataataataaaaaaagagtaagcttttgaaaagttcgttatttttctgctgacaccaaaagctgaaaaatagcctttgagtagagcatgggcaaatttgtacagcagagaaggtaatcttttgggtctacaacttcctcaagctgtcttgtggctcagctcccacaccaactgttcatcatgcagtgtttcaggaccatattcttggctatctgcaaataatattaatagtgtaaggttaactaaatctaagccttcagggatatttgagctttaatggcgagtgcttgaagacatgttgaccttcagatctcaaagggatgaaactcaaatgatggactgacagacagtgagtttcatgtgttggctgaaagatactttctcccaagtcttcacactgatacacgggagactggcctccagccaggacagataacagtatgagggtgtcaccgtaagtgctgtcaacagagaaaaagaagtgcttgcagtggagtgccttcggatgcccagcaaacatctgtaatgattgtctctgggtgtgtaaggttctaagcaaaaagttagcttgtatttcataagttacggtaatattaacagatgattaatatgcactttaaaaagactcaagaaagtagagtcatgatcatgagtcattaatgtgacatgcatctctgttgtacaaaatagaatcaaatgccaatgatgtctttttaatgtgtcttaacttacggaatgcttaatttgttaatagttgatggggatatttaattgcagggatgaatttttatggtccttctgaaattattaagcggatacaatatgctttcttaaacatgaggacatggcagtttctctttcttgctgtgaagccaacattttaatagtacgattttgctccagtaaaagatgggccaaagaaaacatttcatcatccaaatggtgttagattagatgagtctttagatactgagacttcccggtaagcaacataatataggagatttgcattaagggaattgataattccttctgtttcagttcttttcctgtttctttctatatattaatattttttttgtcctgcctgctaaatagctgttttctcaggttttctctttgtcctccacttttatttttccacaccagagtttccagtatagcaagtgggcaagtgccattaaagagggcaaaggccgattgtaagggtaagaggtgggggaactgaagaacacaggtcctgcccaaggaggcagctgttcccagctctgcttggtggtgccagtgtggtcaggtcttcagaatttttttttttttttgagacaaagtctagctctgtcgcccaggctgagtgcaggggagcgatctcggctcgctgcaacctctgcctcccgggttcgagcaattcttctgcttcagcctcctgagtatctgcgactacaggtgcatgccaccacgcccagctaattttttgtatttttagtagagacagggtttcaccatgttgaccaggctggtcttgaactcctgacctcgtgatccacccgtctcagcctcccaaagtgctaggattacaggcgtgagccactgcgcctggcccagaattttaagagaagccataaatctagagcctttgtgaaatctcctgccttctaaatgttgacaataaacctctcttcttcaaaacttcaaggccccaaccacatgcgtctagactgcatttgaccacccggcccccagaacttgatcttgcctttacactcaactccttggagacctgtgttgttcccaggatagctttcatttatgcaacttacaccggcagtgggcacctgtggtatgtattgtgggtgccatggaggatgtattagttcttgccctgctgtaaagaaatacctgagactgggtaatttataaagaaaggaggtttcattggcttaggattcagcaggctgtactggaagcatggaggcttctgcgtctggggaggcctcaggaatcttacagtcatggcagaaggggaagcaggcacgtattacatggccagagtaggaggaagaagagagaaggagaaggtgccacacacttgtaaacaaccagatctcttgagaactctatcatgagaacagcaccaaagggatggtgctaatgcattcatgaaggatccaccctcatgatccaatcacctcccaccaggccccacctccaacactagggattacaattcaacatgagatttgggcgggggtgcagagccaaaccacgtcagtggggctgggggatttggggaaagtgtcactcaaagccacaggagcaacatggccagacttccttgaactccagttcaacctgtagagattcccctcatgttgtattattgtgtgtccacagccctctctgctgaggttcgtctatgtaagactttgtgcagcactgacccagctcttgcctctgtgtagagaagcttcttaaatctgctgtcttaagctctgattgttctccaagagcaacttcctttctgttaggcggttcttgaattgctacaaagaaatgcctgaggctgagtaatttataaaggaaagaggtttcattggctcacagttctgcaggctgtacaaacctggcactggcatcttggcttttgaggaggcctcatagagcttttactcatggcagaaggtgaagtgggagctgacacatctcacggcaaagcaggaagaagaggcggtggctcacacctttaatcccagcactttgggaggccgaggtgggctgataactgaggtcaggagttcaagaccagcctagccaacatggataaaccctgtctctactaaaaatacaaaaattagctgggcatggtgatgcacacctgtaatcccagctactcgggaggatgaggcaggagaatcacctgaacttggaggcggaggttgcagtgagccaagatcataccacctgcactccagcctggctgacagagcaagactccagactccgtctcaaaaaaaaagatattggctagttagaaagacaagcgtgttcttcataggaagttataccatcaatccatattaataatgataatataccaattattattagatttaccgtttattgaatgcatattgaggactttatatatagcttttcatttactcttttttttttttttgagatggagtcttgctctgtcacccaggctggagtgcagtggcatgatcttggctcactgcaacctccacctcccaggttgaagcgattctcttgcctcagcctaccaagtagctgggactacaggtgcgtgcctccacacctggcttttatttttattttaatttttttttgtatttttagtagagacgaggttttaccgtgttaaccaggttggtctcaatctcctgacctcgtgatctgcctgcctcagccccctaaagtgctgggattacaggtgtgagccaccaccacgcctggcctcatttactcttaacagtcagaagcctagtaccaaatgattcggcagtatcctttttttgttttcaatgtccacaccacattggggtgtaggaaatctgaacctccaggttgcttttttgaccccatgcaggcagtgactcccttcagctggcctctcctagggtactctcgacttctgccttcttgtttgccccatgtactcttattgctggagtctccatgctctggtaagccactgtccagggcagtggtcctcaacccctgagttgcggaccagggctggtcctggtccatggccttttaggaactgagcctcacagcaggaggtgagtggcaggcgagcgagcaagcaaagcttcatctgtatttacagcctcttgccatctcccacattccctcctgagctcggcttctcatcagatcagcaggggcattcgattctcataggagcacaaatcctattgtgaattgcgcgtgtgaaggatgtaggttacgtgttgcttatgagataatctaatgcctgatcatctgaggtagaacagtttcatcctgaaaccatccccacccaccacccttgtccatggaaaaattgtcttccatgaaaccagtccctggtgctgaaaaggttggggactgctgatctagagcatcccttttggttttgtttatgatgttcttaatcgtggcaatatatatgtaacataaattttaccattttatccattgtaaagtgtgaagttcagtggcaataagaacattcccagtgttgtgcaactatctccacgatctacttccagttttcttattcccccaaatagcgacccagtgcccattaagcagtcacttcctattcctccctcccaccaaacagtgaaggctgccaatctactttctgtctctatggatttgcctattttggacatttcatataagtggagtcctgcagaatgtggctttttgtttctggcttcttttattagcatacagtttatgaggttcattcatgcatcagaaatccattgcttttcttggtggacatcccttttattattttttttgagacagaatctctccctgtcacccaagctggaatgcagtggtgtgatcttggctaactgcaacctctgcctctgggttcaagcaattcttctgcctcagcttcccgagtagctgggactacaggcatgcaccaccatgcccagctaatttttgtatttttagtagagacgaggtttcaccatgttggccaggatggtctcgatctcttgacctcgtgatctgcccacctcggcctcccaaagtgctgggattacaggcatgagccactgcgcccggctgacatcgtttttaaagtggttccaagtccacattccttctgcaggttccatatctggtttctgggatttgcacacctttgtccctcttgggtggaaagacggcttccctgaccagggctcccctgtgttccagagggcacgttccctttcgtaagtgtgagtcgcacaccagtgagcatgtgtctccacttccagggacaccggccactaggcttggggttagatggtaggactctcgtccctcccttcaggtacagtttgcttctgggaaaccctcctgacaccttcttttcctggactccacttacttatccaaagtattcggctaatctgtttgtctgtctattgaaatttttgcaagatctcttttaatacagcatctattgtcagaatgtcttcagccccagtgtggacacgaagagccctgttttaacacagtacatacatctgaaggcatggaacagggagaaggggaaagtctgaaggcagaaaggaaggggtggggactgattgggaaagaaagaccctgaagaaggaggcgtgggtgggctaaggacatgaacaatggtttggtcttgaatggtaggaagggaaaggtcatgctgtctgactcacattttccttgtgaatgaggagagaaaatcatttgttaagagtgagagctgggcctcagataggaggctacccaaaaggggtaaaagtctggaatcattgctgaaagttcaccaagaacagaaaaaataatggctatttcaaggtgcaaagaatataaattcaacaaaatttccaccaggatttctttttcttagttatttatatttttagagataagatctcactctgttgcccaggctagagtgcagtggtgagatcatagttcatcatggcctccaactcctgggctcaagcgatactcctgcctcagcctccagcggagctgggaccacaggcatgtgccaccatgcacaggtaatttttaaattttttcttgagacagtctcactctgtctcccaggctggagtgcagtggcaccatctcagctcattgcaatctccacctcctgggttcaagcgattctcctactgcagcctcccaagtagccgggattaccagtgcccaccaccacacccagctaattgttgtacttttagtagagataaggttttatcatgttggcaagactggtctcaaactcctgacctcaagtgatctgcccgcctcagccttccagagtgctgggattacatacgtgagccaccgtgcctggctgtaatttttaaaaaatgtttgtaaagtcaggggtcttgctatgttgcccaggctggtcttgatctcctggcctcaagcaatcctcttcccttattctcccaaagcactgggattatgagcaagagccactgcacctgaccccaccaggatttcttgacaaaaaaaactaccataaattcagttgtgttttgttatgaactcagattttgttattcatgacattatgtatatatggggaaaagagtgaggtgtaagataagaatgaaggataccatttatttagcctgaatgcacctaggttaggtgcaccataagttcatgaaaacctggcttagttctgctgccttcagagaacttttgctcgtagcttgagaactgctgatctgtacacttctctccagctgcaaaagcctgagactttcaccatgagagggaaggttccaaaatgccacagatgggacattttacagcatatgttgctttcagggcactggctgaaagctgagtcaggcatcttctgtgaggtgacagtggttcctccctgctgtatgttaggtggtcctataattagtgacattgctcatgaataactaattaaaggcaatgattaacaatttagcaatccttaatccaacatataatttgataataaattataaggtatgggtgctgttagagcctgttagactcctttagttgaaagggatgccttggatatatagttgccgggatctcaaattctgtgcacagatatgtacaaagggagaaggttattttttcctccctaaaggaatatgactggcttacagaggaggaaagctttaagagaagaaatcagactttaaaatagaggtatctttcctatgcatcagcaaatatattttaggggccaattgtgtgctcagctttggggtaagcatttccagcagggatagtattggtaaatgaaatgattatcctgtcttgatggagttcatgggtggtgacacaggctttcaaatgtgtgtgatagcacttcagggcaatgaaatgtggaatcatgggagggagggaatttttgccattggagtggatggaaaagctcatagccataactaacaccacagtgttctatgtgtcaggtacagttcttgtatttagcacaatacacatctattcgctcctcattctcaccctatgagtatttttttttcttttcttttcttttttttttttttttttttgagacagagtcttgccctgtcacccaggctgggtgtagtggtgtgatctcaactcactgcaacctccacctcccgggttcaagtgattctcccgcctcagcctcctgagtagctgggactacaggcatgcaccaccacagctggctaatttttgtacatttaatagagatgggttttgccatgttggtcaggttggtctcaaactcctaacctcaagtgatacaccctcctcagcctcccaaagtgctgggattacaggtgggagccaccgtacctggccaagatgaatattattatatcctttttacaggcaaagttgctgaagcatgagttaagcaccttacccaacgtcacacacctggtaagaagtggagctgggattcggatgtagtcaggcccagagtctgtgttcttacctgctgttctgtctttcctggaaaagatttgactagctggaccttgccagctggaggagatttttaccggctgagtatatgcaagataacacaatgcagggtatagttctgcaaatgagtgtgtttggggtcttaaagcccactgtcatgtttcatgattcaccaggagaactctcgaaactcagaaaagctgtacaatcatggttattatttgttaatgatgaaaagatacagattaaaatcaacaggctgggcatggtggctcacacctataatcccagcactttgggaggccaaggcaggtggatcacctgaggtcaggaattcaagaccagcctgcccaacatagtgaaactgtgtctctactaaaaatacaaaaagtagctgggtgtgatggtgcacacctgtaattccagctactcgggaagctgaggcaggataatcacttgaacatgggacgcggaggttgcagtgagccgagatcacgccattgcactccagcctgggcaacagagcaagactccgtctcaaaaaaaaaaaatctgcagagatgcatgaagagtcccacagaagtcagttgcaagcttccacttgtcctctcccaaatggagttgtatgggtagggctgatttgctccgcggtggcacataacaactcatttcaagtcctgccaatcaggaagctcacctgagccttggcatcccgggtttttactgtgggtcagtcacataggcatggagagccttgcatgactctccttagctactcaacctccagcccttgcccaccagaagttaaactgcagtagcatcgtccagggccttggcatgcaaagacactcttatcaggtaggatattccaagggcttagagattgtctcccagaagctgatccagggccagttctttctctggattgtgcggggtttagacaacccaagcccactgagttaaccctttactacataatgaagatgagttgtttagtgtcttatgaagatactgaaggtgggaaatatgcattaaaaaacagaagaaagaggttgagtgcgatggctctggtctgtaatcttagcactttgggaggccaaggcaggaagatcacttgaagccaggagttcaaggccagcttggacaacacagtgagatcccatctgtatttctttttgttgttgttgttgtccagacagagtctcactccatcacccaggcgggagtgcagtggcttgatctcgactcactgcaacctccaccttctgggttcaagcgattattgtacctcagcttcctgagtagctggaataacaggcatgcaccaccacacctggctaattttttgtatttttagtagagacagggtttcaccatgttggccaggctggtctccacacctcaggtgatctgcccaccttggcctcccaaagtgctgggattacaggagtcagccactgtgcctggccccatctctattctttaaaaatataaagtaaaaatagaggaaagatggaagactatccggtcttcatctggaagtcgtcatcttccagataaaaacaggaggtatgctgtatagagggctctaaaaaccaaacagcagagcccagactcaccccactagtctggtgagtctaactaaagatgaataaaaaaccaaccaggggagacagaaagtagaatagtgcttacccactactaggggtcacccccatctgtggaggagggatggatagaggagtgactgataatgaagatggggctttggggtagaagtgatgaaaatgttccaaaattggtttttgtgacattgcataactctatgactatactaaaaaccattggcttgtacacagcaagcaggtgaattatgtggtccgtgaattctttctcagaagctgatggctatcggatgaccagtccttcaacaagatgaagacagattgagtatcaattattggttcacaatggcctggaacgtttctctctggttaaccctgagattttgcctgtcccttcttttgtcagagcagcacagagtacagcaggtgatccaatcggggtcaaattttaaaccagcagaactggtcatggtagagtcctgagtgggaatttagaaaccaagtctgatggttaatactgggtgtcaacttgattggattgaaggatacaaagtattgtttctgcatgtatttatgagggtattgtcaaaggagattaacatttgagtcactggactgggagaggcagacccaccctcaatctgtttgggcaccatctaatcagctgccagcgtggctaggataaaagcaggcaggaatgtggaaggactagattggctgagtcttctggcctccatctttttcctgtgccaaatgcttcctgcccttgaacatcagactccaatttcttcagcttttggactcttgggcttacaccagtgaattgccaggggctcttggaccttctgccacagattgaaggctgcactgtcaacttccctactttagaggttttgggattcagacaggtttctttactcctcagcttgcagacggcttattgcgggacttcaccttgtgatcatgtgagtcaattctccttaataaactcccctttatatatacatctatcttatgagtcctgtccctctagagaaccctcactaatacaccaaggaacatccttggtgaaggtttagcatcacacaggaccagaccagctgaggctgctgacctccctgggcctggtagagaatcctggtcaattgcagtgtgttgtgggtaaggtcaggttgaagactggtacttttccttggtctagcaaaggagagttcgtaaagcaatccagccaggggccaagtgaatgctggcacatttcaggaagagaaaagtcacagtgaagaagatagacattctccacctttctttttttccctgtcctgctagtcttccaataacagagaaatggcctgttcacttttgccacccgtgggttctgtgtccttaggcagatcactcacttgttgtgtaaatgagcttttaattttcttgtccttaaaacttcaccagcattgaaatgtcgattgttccactagtagaaaattgccgtaacaaaacttttggtcccttagatgaaaagcactaattataaactctctggagttgtggcatgggctgttgtagataattaatgtttcagttaatagaattctactacagaagcaagacatggagagatagatggtaaaaaacaaacaaacaaacaaaaaccctccacaaaattctgtttgctttcttcaggggaccagtctggagaaggctggttgacagagggtgttgcttccattgagggaattcacatcacactagaagaggcattattataaaatattactcaggaatatggacagatgcagtgggtcatgcctataatcccagcattttgggaggctgaagtgggaggattgttgagaccaggagttcaagaccagcctgggcatcctagcaagaccccatctctacagaaaaatttttaaaattagatggatgtggtggtgcgtgcctgaaactgcctttgcaaaattatgactgagacggtgaaaaagatctaacctaagtgactccatcttccttctaacctttaacctgtccttgttccttctgggtcataggctgaattagcttagggaggaacttagtttatagtttaaaacaaagatgataacagccctttcccaaaacaaacctcctcttgcctggggactagaccgcctttgtaggactaacaaattagccataacattagaaattatggtttaggagtcatgcagctggaggctacaagcttctgaccctccctaaaccacttcctaagatcagtgcttgagatattttgcagaccctgcacttgatggatcagctggtgccacccagatctataaactagttcatctgatcttcgggcccccacccaggaactgactcagcgcaagaggacggcatcaattccctatgatttcatctccgacccaaccaatcaacactctcaactcactggccttcccccaccgaagttgctctaaaaaactctgatccccagccaggcgcaatggctcacgcctgtaatcccagcactttgggaggccgagaccggtggatcatggggtcaggagatcaagatcatcctggctaacacagtgaaaccccatctctactaaaaatacaaaataattagcagggcgtggtggcggacgcctgtagtcccacctactcgggaggctgaggcaggagaatggcgtgaacctgggaggtggagcttgcagtgagccaagatcacgctactgcactccagcctgggttacagaacgagactccttctcaaaaaaaagaaaaaaaaaaaaaacaactctgatccccgaatgctcagggagactgatttgagtaataataaaactcgggtctcccagacagctggctctggtgcgaattactctttctctgttgcaattcccctgtcttgataaatcagctctgtctaggcagcaggcaagatgaacccaccgggtggttacatggctgtagtctcggacactcaggaggctgagatgagaggattgcttaagctcaagagttggaggctgcagtgagctgtaatcattccactgcacaccagccttggcaactgagtgaaaccctgtctctaaaagaaaatgaaatgaaataaaatttaaaaataaacttgttctatggaggacactcttattgtatgtcagtcctctttaaaaatgtatccatgttggctgggcacggtgactcacgcctgtaatcccagcactttgggaggccgaggcaggcagatcacgaggtcaagagattgagaccatcctggctaacatggtgaaactctgtctttactaaaaatacaaaaaattagtcagggatcgtggcgggcgcctgtagtcccagctactcaggaggctaaggcaggagaatggtgtgaacccgggaggcagagcttgcagtgagctgagatcgcaccactgcactccagcctgggcgacagagcgagactccatctcaaaaaaaaaataaaaaataaaacaaaaataaatgtatccatgtttccacactttcgagaccccaaatgcaaactctgaatgaaaacaactgctagagaaacagtgtgagtttgactgtctgtaagatggtctaatggaaggcatatccatttctctgcgggggtccatcctgcagaccctgacccaacaatggatgaataacgtacactgacacagatattctgcttatcagtccagctgagcatctgggctcctcacagacaccaaggaagatgtgtgaagagtcagcagccacatcttcgactcgctggccctcccggcatttattcagcacacattaaatgacagaggtcttaagtaaacaccactagaaggtaattaccgttgctgacccccctgagtagagagcaatcatgcaaccacggatggtcaaaggttagtcttaggaccacatgagtaaacaagctatttagataaactactctgcatccttttgtatctgcaccctaagctctctggctcctgaaaagagaatctggctgccttcagccaaactacctaaagttatgcaaaactccccagccttccaagatttgcttttttctattcctgtgattttacaatttctcccaccatcctgactgaatccccatatttctttaaaacatttgctatttgttcaaacaatcagctgggaagaatgcctacgaaccatcacagttgatcaggtccctaaaggagcatcatgatcaactttatcactttctgggaaagtaggtacagttcacaaggtgacacgggatatcactccctagttggtcggctctgcgtggccgtccacagctgactgctgccttcccacagggctcaacgaatatgtaacttcacagatgaggacaagtgattcttcagtgacttcaaatgtcagcagcatgatgtgatagaacatctcccaggttctggagcctgtttcagtttttgttgttgtttttgtttgtttgttttaaattttttgagacagggtctcactctgccacccaggctagagtgcagtggtgcaatcatagctcactgtaaccttgaactcctaggctcaagcaatcttcccaccttagttgcccaagtagctgggactacaggtgcatgccatgcccagctaattatttttattttttgtagaagtagggtcttgctatgttgtccaggctggtctcaaactcctggtttcaagcattcctcgtgccttggcctcccaaagtgctgggattacaggcatgagccactgcacttggcaaagagacctgttttctaagccagatttgaaccacaaattttgatattcagtttacttccctgtaaaatggtggatttggactatgtgatattagtcagggttctctagagggacagaactaataatatatgtatgtatgtatgtatatgggtttaataagtattaactcacaagatgacaaggtcccacaataggctgtctgcaagctggggagcaaggaagccagtccaagttccaaaactgaagaatttgcagtccaatgtttgagggcaggaagcatccagcatgggagaaagatgcagtctgggaggctaagctagtctagtcatttcacgtttttctgcctgctttatattctagccatgctggttagtgcccacccagattaagggtgagtctgcctttcccagcccactgactcaaatgttagtctcctttggcaacaccttggcagacacacccaggatcaatactttgcatccttcaatccaatcaagttgacactcagtattaatcatcacagatgcattggatgagatgtcttcagattcttcatctgtaaaggggataataatagtactgtcttatagggttgttgtgaagattaaatgagataatacatgtaaaatgcttaaaacagtccatggcacatagtaagtgctctagaaataacagctgttcttgctatcaatattattagagcaattctctattctacaatgctcctcactttgggaatattataatagcccttttctttttatttggtctaggtcatacaaccaaatagttataacaaataacctgatcattggattatcactaatttatgtcctacacatgacagactctggtcgctaataaaagatagacttttttttttttttttggagacaaggtcttgttttgtggcccaggctggagtgcagtgatgtgatcatagctcactgtagccttgacctcccaggctcaagggatcctcccacctcagcctcccatgtagctgggaccacaggcatgcaccaccaccatgcctggctaattttttaaaattgtttgtagagatgagtcttgctatgttgccctggctggcctcaaactcctggcctcaagtgatcctcccacctcggcctcccaaagtgctgggattactttgccaggggtgaaccactgcgcccagccaggccaggagagacattttaaatgccaagggatttgcacagaaaagaagggactcatgttcttgaagccactctcttcagaaagctattccttatgaaatgggagtgcacttacagaatggtgaacaccttgcttttgggtgaaatacatgctatttcttgacatcacctaggtaccttctgcaccagcctgggtagatcaatatttctttttgcgtgacacgctgatattgctgctagatagctttcctttggaagcaaaattcccaggcagtgccctagagctggagcaacattagcaacgtaaactttctctgcgatgacaagcagagaggcctgcctccatcaaccgacatgcactgtgacagctcccagcggcaggtagattaatctgaataatgtcagaatgacttttctcctcccttgtaaagaggttcagtgttgcgggctgccaaggagcagacacattttattttaaatttaaggatttttaaaaatggaggacactttacctctgaattaaatgctcagttcctgagttattgctggacataaatagggaagcagccatcccattaattttatggagctgatctgtggggagagagtaataggcttcatattctccttctgttggtgctagatgtagactatagtgaggggtggaaaggggtaggctccagctcttattttggtagctttaatccccctttctagatggttccagagtgtttcatcttccaggccctcttttttttttttttttttttgagacagaatttcactctgtcacccaggctggaatacagtggcacaatcttggctcattgcagcctcgcttcctgggttcaagcaattttcctgccttagcctcccgagcatgcgccaccacgcctggctaatttttcgtatttttagtaggggcaggatttcaccatgttggccagactggtctcgaactcctgacctcgagtgatccatcttttcaggccctcttacatatctttcttcttctgccctttctttttattcctttttccactgtatcctgaaaggctgaaaagtaactgcagaagactctgaaattcagttcagggcagaaaataacctttcttccttgctcccccacgacctctgatggtttttttctacagcacagttcagaactctttctttcttaattttttttttttttttttgagatggagtttccctctgttgcccaggctagagtgcaatggcacgatctcagctcactgcgacctccgaatcctgggttcaaccaattctcctgcctcagcctcccaagtagctgggattacaggcatgtgccaccatgcgcggttaactttgtatttttagtagagatggggtttcaccatgttggtcaggctggtcttgaactcccgacctcaggtaatctgcccacctcggcctcccaaagtgctgggattacaggtgtgagccaccgcgcctggccagttcagaactgttttcttgtctcctggcccttctggtcctccacgaattattatttcttagttgtttccagggggtcctttagaaaagaaaacgaagattatcacttgttctcaaacccaaacagccttttttgtttacctagtctctccagtagcacttgctggagttttcatcctccgaggtgtggcaatgagtaacttctcatcaggccttaccagtcatgcaaggtgtgttacgtttgaggccatccatttctcctcttgtttatggaaatacaggaacatatgactatttcatgtcttgtgcgttggagagaaagcatatcagtttttttgttgttgttcttttttttttggtttttttttggagatggattcttgctcttccgccaggctgcagtgcagtggcgcgatcttggctcactgcaacctccgcctcctgggttcaagttgttctcctgcctcagcctcacaagtagctgggactataggcgcccgccaccacgcccggctgatttttgtatttttagtagagacagggtttcatcatgttggccagtctgatctctatctcttgacctcgtaatccacccaccttggcctcccataccaaattttatttgagattgggaagtcaatcatgagtaccgatatcagagcctgcagagccttctcttccaaccaatgaactatctgcagtacagcatacacaaatgaccatttgtggttaaccacccggacaccatttccatttttcatcctgttgaccctccacagttttttttctttttctttttctttttttaattttactttaagttctgggatacatttgcagaacgtgcaggtttgttaacacaggtatacatgtgccatggtggtttgctgcacctatcaaccggtcatctaggttttaagccctgcatgcattaggtatttgtcctaatgctctccctcccttcgcccctcacctactgacatgtccccgtgtgtgatgttcccctccctgtgtccatgtgttctcattggtcaactcccacttatgagtgagaacatgcagtgtttggttttctgttcctgtgtttgctgagaagcatggtttccagctacatccatgtccctgcaaaggacatgaactcattctttttaatggctgcatagtattccatggtgtgtatgtgccacattttctttatccagtttatcattgatgggcatttgggttggttccaagtctttgctattgtaaatagtgctgcaataaacgtatgtgtgtgtgtgtgtctttatagtagaatgatgtataatcctttgggtatatgcccagtaatgggattgctgggtcaaatggtatttctggttctagatcctggaggaatcgccacactgtcttccacaatggttgaactgatttacagtcccaccaacaatgtaaaagtgttcctatttctccccaacctcatcagcaagttatttttttgactttttcataatagccattcaagcctgcagaagtgttttttttgttttgttttgttttgagatggagtctcactctgtcacccaggctggagtgcaatggcccgatctcagctcactgcaagctctgcctgccgggtttacgccattctcctgcctcagcctcctgagtagctgggactacgggcgcccgccaccatgcccggctaatttttttgtatttttttagtagagatggggtttcaccgtgttagccaggatggtctcaatctcctgacctcatgatctgcctgcctcggcctcccaaagtgctgggattacaggcgtgagccaccggcctgcagaagttttaagcagactttcccaaagtctgaaaattgggttggtactttgcaatatctttttggagtgttgggtcacagtctttccttttttggctgccaacatgactctaaaaatagcttctgctaccaggcacgcagagagtcaggggtaattgacttcattttcttccggaagtgtaggctcctgtgtcattaagtcattctggtagtacatccttacagcagcagagaggttgcaacaagcttgcttaactgttgtgaataacataactaccagtcacgcttgataaagcagtggccccttcaaagccctccgaaaacaggcagtgtgtgagacccgggagagctggcctgcatgggaggtcctttatacacttggtaggatgccccagtcagtattttggagtttaacttccgtgcatgaagttcaatggactcccaggctcttaagaacttcaacttaaaggaaagaggagagaaatgtttcttgagtgtcttttatgaacattgaatttccgactgtggtttctgtggcggctgcaggaggtttcagctggtggcatgagcccttcccatgctataagcaactctgaagtttcagttgcatggacagggtctgagaatgactcagggcaggttacagctcttcattttcgaggtcagcttcgtcgccaattcaaattcaggttattctagttgaatactgggtctctgcaacttctcagttctttgcctcctgccccattccttctctaggatggcttctgggtacgtggggagagggagggtttattttgtgatcaaggggaagcatgacggtctttacacgcactgtttctctgtagagttaggatatttgtcgcttccgaatctcatgctgaaatttgatccgcagtgttggaggtgggcctggagggaggtgtttgggtcatggggacagacccctcatgaatggcttggtgccctcctcctggtaataagtgagttcttgctctattagttcatcttagagctggttgtttaaaagagcatggcactttccttctctctctcctgctccccttatttctccacgtgatgcctgccccatcctccaccttctgccatgagtggaagctgcctcaggccctcaccaggagcagatactgatgccatgcttcttgtacagcttgcaaaaccatgagccagataaacctctattcttcataaattacctagtctgaggtgttcctttttttttttttgagatagagtttcgctcttgttgcccaggctggagtgcagtggcatgatcttggctcactgcaacctccacctcctgcgttgaagtcattcttctgcctcagcttcccgagtggctgggactacaggcgcctgccaccacccctcgctaattgttttgtattttcagtagagacggggtttcaccatgttggccaggctggtctcgaacttttgacctcgggtgatctgcccgccttggcctcccaaagtgctggaattacaggtgtgaggcaccccgctcggcctgaattgttcctttatagcaacacaaaatggactaagacatcctcttgccctctgggcagtgtccctggcctggctggccactccttgccctgctggcattcccagaagacatctgccatgggcctaacttgggatctgacctctcagcttcctcagggcccatctgacccagatctctatggctcatgctggctgcaaacacctgagccttggccacattcccctacccatcccagccccagctgcaggcttcattcctgcccagggaaaagccatcaacaactcttctgccttccctcgccacttcccctttccttcctatgagaaccaagcagaggggctaatgtacgtggcctcctgccatgtggccacactaaaccatcaggttcatgagggtgggcttaggaggatatagacacctgcaggcagcttcatgacacacccaccgtggaaaacaggggtgtcttccgtagcaaactcactatccaacacatctctccctctctgggccaaaatgttaactgagggccgggtgcagtggctcacgcctgtaatcccagcactctgggaggccgaggcaggtagatcacttgaggttaggagttccagaccaacctggccaacatggtgaaactctgtctttactaaaaatacaaaaattgactgggcagcgcctgtaatcccagctactcaggaggctgaggcaagagaattacttgaatccgggaggtggaggctgcagtgaggcgagatggtgtcactgcactctagcctgggccagcgagactctgtctcaaggaaaacaaacaaacaaacaaacgaaatgttacctgaaaaaaactggagttcatttgcctgaggattaacaaatgactctccaggagaacgcaggctttgatcagtaggtgttttattactcatcacaagtaaggacagcactgggaatattctccaaagcggtgtctctggagggaaagtgacaggagggttttatgggggaatggagaggggagagggtgcatcagcacatgtagaggaggggtctcagtggtgcagatgcggagagccatcatgccatcacccagtcacatgggatggtaatggagctatagcacctcccagggtggagccacctttttttttctttctttctttttttttttttttttgagacagattctcactccgtcacccaggctggagtgcagtggcacaatctcagctcactgcaacctccacctcccaggttcaagcgattctcctgcctcagcctctcgagcagctgggattacaggtgctcaccaccacgcccggctaatttttgtatttttgtttgttttttttttttaagtgtagatggggttttgccatgttggccaggctggtctcgaactcctgacctcaggtgattcacccaccttggcctcccaaagtgctgggattacacgtgtgagccactgcgcccggccagggtggaggcttcaacatggtcatgaggaaggttcattcaggttcatctctaagttgctggggtctgtcaggagctggttccagacaactaggtaaccacattttgcacagggcttgggaagaaacaggctgcaaggtaggagactgtaaaataggctgattgctgaaatcgattaaattcttataattcctggagactggagactgtccctttctgcttccagaaacatgtcatctcttacctctcccagctccctggaccttctttgcttcccacaggaccttgggcgggaagctgggctttcccctggagtgctccttaatgcctctgcacactcagctttagctgtgatgacaggagagagtcctaagtgatccgcctaccttggcctcccaaagtgctggtattacaagtgtgagccactgccttatagtattttcttaaaagtaactttattcagggggaaaaaaatcccctaaatcttgtagtcgtttctgagaaacgggaatattttcttgaagaagcttgaaattgcagaggcttaaatcttaaattatatgaggagggaggagcagaggctggcagccatgaaattagagctccataatttgtctacagccattcaagaggggaagaaataagaatgattttctgctctgcttccaatccagatgttgtcttccagcccagtagagaagaacaagaccagagcctaggagaccaatcactttaaaaattatagtgtaaaaatactttttttattatgtattcattataaaatttatactgtatccattataaatttaatattcactgtaaaaatcaaaaatacaaaagatcattagataatcactgataatcataacacccaacgataaccataaccaatgttaatatttcatgagtagctttaatatttcacattattttttactcctacaaataatgtaaaatttatattttcatataaacattttgtatgtacatgtttaaaagtcaaatatatattctacaaggctctacctactctttagaggtaccactttatttatttacttatttattttgaggtggagttttgctctagtcgcccaggctggagtgcaatggcatgatctcggctcactgcaacctctgcctcctgggttcaagtgattcttctgcttcgacctccagagtagctgggattacaggcatgtgccaccatgctcagctaatttttgtatttttagtagagacagggtttcaccacattggccaggctggtctcgaactcctgacctcaagtgatctgtctgcctctgcctcccagagtgctgggattacaggcatgaaccactgcggccgactctattcttttaaatatgccttttgtttacctctatatctctaaatagtacactttagtcctacatcatgcattttgagatgtgggcattacttcttgactttgactatgggagacaaggtattaactgttattcactcacccgcatccacctctcccgcaaattcacacactactcattcctttgctgagggcttttcccgccacaccagccaaatcttcagttctctgattctcaacactgggtttcctacaattcaattcaattatgacactgattacccagagtaagcattcgaatccacaggtttaagggctcagtcccaaagactgctcccactttaggcactagtcataaatatcaggtctccaggctatccatatttttgtccaacatggctacaaatttggggtttcccaccacctcccttcaggtttgatgatttgctagaatgaatcacagagctcaagaaaacactgcgtactgttacaggttgagcatcctaaattggaaaatctggaattcaaaatgccccaaaatccaactttttgagtgtccacataatgctcaaaggataatgcttattgggaagtattttgcattttctgacatagaatgctcagttggtaagtataatgcaaataatctaaaatcaaaaaaaaaatctgagatttgcaacatgggtctcaagtgttttggttaagggatacttgacctacaccagttcataataaaagatgcaaccccagaatagctgaatggaagaaatgtgtgcccactcttacaccacttattaatacttatattattataactatttgcatctgatccacatggtatactttggttatttttcccttccctgcacagctttttgtttttcctgtatttaaccattgcctttctgtttgtttccttaatttgttttctatatactgttaactaattcagctacatgctttctaccacttgtctgaattccctctcagtcctctcagcaaccttagatattctgtctgctttattttcatgaagagagctccccagggtgctatggcctcatccatcaggactggctgccctctagcagtgatcctgggattcctttcacttctcttctgtgtcccggatctcatgcctttatcttttttagcttattctctcattttattggtgcatatcttcaaataactatttttagtgcttgtatgtgtaaaaatgtctggattctgccttccactttgaatgaccttggcttagaatttgaagacaatattccattgtcttcttacttccaacatggctattggagagttcagagacattctgactcctagttctttcaatgtaacttgtctctttctcttttgaaattcttttattctgggtgctctgaaatttggtgatgctgtgttttggagtatatttctttttattcattgcactggcactcaatagaactttccatttgaaatgtgtgtgcattgttgatatccttacttcgtgtgtatgtgtgtgtgtgtgtgtgtgtggtctctatttttggaactctttttgtttttgtttgggtgttgaaccatccttgtggactgtttctttgtttttctttaatctctgatttttcatcttttatcttttgtctgtatttctggggtattttcttaactttgtttttctaaattttctgtttctgcttttacatttttaattttcaagggttctttttggttctttatcgatcttttgccataacactcagtacttgttttatcaatgcaatatcctttctaattatctgagactgtgaatgtcattttttcttgaaaacaaaaggcatgtatatcttgcaaacataatgttgaatcagagaatacaggcgcaaaaggatgcattactatttgattctttttatataaatttcaattccaaactcatcaagttgtatacattaactatgtatggatttttgtgtatgaatcataccttaataaatagtttaaaaataaataaattataaagccaagaaaaatttagctgttattggaagtcaggtagccagtgggggtaatgactgggagagtgcatagaagggatttctaggacactggttatcttctatttcttgacttgggtgatggtttaaacggatggattccatttgttaaagttgacagctgaacttctgaaacttgtgtacttctctatgtgtttgctctacttcagtgaaaagttttaattagaaataacagctgcctattttcttttttttttttttttttttttgaggcagagtctcgctctgtctcccaggctggagtgcagtggcgcgatcttggctcactgcagcccccacctaccgggttcaagcaattctcctgccttagtctcccgagtagtgggattatgggcatatgccaccacacctggctaatttttgtacttttagtagagatggggtttcaccatggctggtgttgaactcctgacatcaaatgatccacccaccttggcctcccaaagtgcttgattttcttatttttgtttttaccagtggataatcacattatgtgattttttttaataagtaagtaatttgcctctttatttcctatcattatatgtatattttttaccttaactgcagtctgcagagcaatgttgagtattaatggtgagaacaaatctttatctcattcctgacttaatgaaataccttgaatgtttcaccattatgactcatattggctgttttaaatagacatcagattagggacattttctgtctaatttactctgagtttttcttggcgacacatattggatgttttcattgcttttttggcatttattaaggtatttatatatttttctcttgatttattaatcttttgaattatattaatcgattgtctaaccgggcgcggtggctcacgcttgtaatcccagcactttgggaggctgaggcaggcagatcacctgaggttggaagttcgagaccagcctgaccaacatggagaaaccccatctctactaaaaatacaaaattagccagtcgtggtggcaggtacctgtaatcccagctactcgggaggctgaggcaggagaaatcacttgaacccgggacgcagaagttgtggtgagccgagatcgtgccatcgcactccagcctgggcaacaaagagcgaaactccctctcaaaaaaaaaaaaaagattgtctaaaatatgaccatatttgtatttctagagtaaacacttcttggtcctggtttattagttgttagtatttaaagattttttttttttttttgagacagtctttctctgtcgcccaggatggagtgcagtcgcgcgatctcggctcaccgcaaactctgcctctcgggctcaagaaattctcttgcctcagcctcgcgagtagtggcattacaggcatgtgccacaaggtctagctaatttttgtatttttagtagagacggggtttcgccatgttggccaggctggtctcgtcgcgacctcaagtgatccacctgtgtcggcctcccaaagtgctggaattacaggcatgagccagtgcacctggcttacttgaaaattttaaccctcagtggattagtggaactcgtgtactttttcttttgtgtgtgcatgtgctttttaaatgaaaaagacagccttggtgagatataattcacgtcatatattttaaacatttaaagtgtataattaaatggtttttagtacgttcacagagttctgcaaccatcactgcagttttagtatatgtgctgcacccttaaaagaaacgccattctcatttccctctaactctcccagccccaggcaaccacaaatctattttctgtctctttggatttgcctgttctggatgttttacagaaatggaataggtggtcttttgtgagtggcttctttctgttagcatcatgctttcaaggcgtgtgtgctggcttgagtgcttttctaagagcattatataagcttggagaaaatgataaacttttaaattttattttctgttctagactacttcagattgcatggcgtttttcttttttttattcttttttttttttattatactctaagttctagggtacatgtgcacaatgtgcaggtttgctacatatgtatacatgtgccatgttggtgtgctgcacccattaactcatcattcacattaggtatatctcctaatgctatccctccccactccctccaccccacagcaggccctggtgtgtgatgttccccttcctgtgtccaagtgttctcattgttcaattcccacctatgagtgagaacatgtggtgtttggttttttgtccttgcaatagtttgctgagaattgcatgacatttttctagtcctcaaaaaattgacagaatttacctataataccctctgggtctaatgtctttctggatagtcattctcgacagcctttccaggattttcagtgattagtctatgccagttttctactctgtcgcagaaagttttcttgaccattcttctactcatcatttaaaaatttaaaagcttctatatgtttttggtaagagttctttgctcagatctaatagcatttatcagtgtttttctctcctttaaaatgagattaattttaaaatcctttcgacgaactaactccttattctcggttcccctctttccttatatttgaattttattaattcattttgtctgttcctcttttctccttggtctgcttgctctctttctgcccttttgagttgaaatctcagttcatttattttctttttgtcttgcttaatagcaaaagcatttaatattatgtatttccctcaagtatggatcttgctacagctcataagtttttatatgtagtgtttgagttgtcactgttttctagatagtgtttaattccagactttctttcctctttggtctaagagttatttagaagtatttttaaaaaccaaatcaattttttaaatataagcttctattcttaatttatttcaccgaattgtggttttttttgtttgtttgtttttttaagaattaaaattttgatttgggcacagtggctcatgcctgtaatcccaacacttttggaggccaaggcaggaggatctcttgagcccaagagttcaagatgagcctggacaatatagcaagaccccaactctacaaaaaatgaaatgataaataagtgatacatgataaataaatgacaagaaaaatgataaatagggcgcacacctgtagtcccagcttcttgggagtctgagatgggaggatcacttgagcccaagactttgaggctgcagtgaggtatgatttcaccactgcacttcagcctgggtgacagagtgaggctctctttagaaaaaaaaaaaagattttagggccaggtgtggtggcttacgcctgtaatcccagcactttgggaggctgaggtgggaggatcacttgaggtcaggagtccgagaccagcatagccaacaaggtgaaaccctgtctctactaaaaatacaaaaattaggcaggcatggtggtgtgcacctgtaatcccagctactcaggaggctgaggcaggagaattggcttgaacttgggaggcggaggttgcagtgagtcaaggtcacaccattgcacccagcctgggtgacagagagagactccgtctcaaaaaaatttaaaaataaaaaaggattttagggaggcctaatatatgatcagtttttataatggctgttggataaaaaagtatttattgggtagaaaagttggtatgcatttaaaaaaatcatttgtatttgcttccttggtttgttcctgagaagcagtatgaactgagcagagcagggggtgactctgtctactttctagtgcagtatctgataaaaaggggcctctctggtggatacaggcccagaggctctggagcaagaattaagcatcttgtttttttgttgttgttgttttctggccagttatgtaaagtatagtcagtgttttctctgtgctgaatcatgggttgctttttctcaatttttctccatctgccttaacatgattggtgattctacctagatcctggccttagattctgtgttgctcttattattctgacttctgccatccatcattttctctgttctctctggtggtttagtaagtcccagaccggaaactccaggagggtaagagacatgccaacattgttcattattgtgtctccagggcataagtaccctgcctggaatagagtaaataaacatttttttttgcatgaatttcagttgcgagtggctgcctgggtaaaggggagtgctaaccagatttcatttggaacatcattcataattatattccaggtatcttttgtctagcattataacccagttcaccagcaaacttggttccacagttgtagtagtcttttgtcacattgctgataaagatataactgagactaggaaatttacaagagaaagaggtttaatgggctcacagttgcatgtggctggagaggcctcacaatcatggtggaaggggaaaggcacgtctaacgtggtggtaggccagaaaaaagaatgagaaccaagcataaaagatttccctttataaaaccatcagatctcatgagacttattcactaccatgagagcaggttgggggaaacttcccccatgatttaattacctcccactgggtccttcccacaacacgtgggaattatgggagctacaattcaagatgagatttgggaggggacacagccaagccatatcaacaatattcatggttgacattctttaatcactatcctgtgtatgtcagatagcagataagaggaaaatgtgaatgaggctctgaattaagccacatgttcaggatgctgtcccagacttccgctcttgactgtctcatctctttcagcaccaccttctctccttctctgcacaaatcctcagtgagtgttgaatatctcatcaggtctgtttgaggacatcagcagacactccttttggttctggcattccagctcccaaatgggctttccacgtctttcttccaagagcttttctcactgtgttctggctctactcaatgactcacttgctaatctcccatatacctattcacactatgatatcaaaagctcatatcacaacttaatatgtcccagggtattgtcaactgaagaatgatcgggttcatacatttggaaaggggagcttttttaaaatttttaagttccagggtacatgtgcaggtttgttacagaggtaaacatgtgccatggtggtttgctgcacctagcaacccatcacctaggtattaagcccaggatgcattgtcccccagactccaccaacaggccccagtgtgtgttgttcctctccctgtgtccatgtattctcattgttcagctcccacttacaagtgagaacatgtggtatttggttttctgttccagttttagtttgctgaggataacggcttctggcttcatacatgtcactccaaaggacatgatctggttcctttgtattatattccatggtgtatatgtaccacattttctttatccagtctatcattgataggcatttgggttgattggaaagaagaactttatttctcataaatggttgcagccttcccaggccattctgacagcctgggaagtgtagcctctggtcagaagccagaaatactttgagagaaggtcaaaggtaacaagaatttatgctgagtggggtggctaaatgtatgtatttaataagctataggaggagtcataaatatttaccaaaggagaaatgtgtgcatgaacaattcagctttatgcctcttcatgagttgcatgtacaaaaatggcagtgttagcatgatctgagggtggaattttcagctctctgacatcaaaaggtgaaatagaggacatgaaacccctcactgcacatcctccgttgaactattccatggtcagtggtctcttatcaagaaggaatcctgggccaggcatgatggcacacacctataatccaagcactttgggaggtcaaggcaggcagaatggcttgagctcgggagtttgagaccagcctgggcaacatggtgaaaccccatttctacaaaaaaatacaaaaattagccaggtgtggtggtatgcatctatagtggcagctactcaggaggctgagatgggcccattacatgagcctgggaggtcaaggctacagtgagccatgacacatcactgcactccagcctgggcagcagagcaaaatcttgtttcaaaaaaaaaaaaaagaaggaatgctggtcagttgttcatgttgaaaccatcaaagggaggggcagcagtcagacagttggctgaaatagtaggtggagcctattgaaagggctggtttctgtttggcacctagggtagaaagcttaatggcagttagggagggggaggtataaagaggtgtgttcaacctcccatcctgtcatggctggaaactcagtttgaaggttgctctggggtcctctttgccaggtggggtccagtcagtcagttgaggggttttggattttattatttcccagtatgaatattttccagggttttgttttgttttttgtttttgtttttttttttgcattttaataagtctgtatccatcttctcatttattcatttagcaaacatttcttgaacatcactatgaggaaagcgctgtgccagaccccagaccagaccctatgggatgagccaacagttcttgttcccagagaaggcagctctctctcatgctcatagtccacactccccagccagcacggggcatagggacttcatctgaaatctcaaatcccatgtggcaaatatcacagtggctaggagatgacttctttgtgagagattttcctgtttgagtaagagaacaagttaggcttttgaaaccaagtagagctggatcaaactttggtcccagtacttgtcagttgtttgacctaatgaaaggcagggaaccttctgttcctatgagaaggctcaggatacatcacctacccctcagagctcctgtgaagattagactgtgaggccggggacggtggctcacgtctgtaatcccagcactttgggaggctgaggcgggcagatcacttgaggtcaggagtatgagaccagtctggccaacatggtgaaactccatctttacttaaaatacaaaaattatctgggcgtggtgccacgtgcctgtagtcccagctattcaggaggctgaggcaggagaattgcttgaacctggggggcagaggttgcagtgaggcgagatcgcaccactgcacgccagccttggtaacagagtaaaactccatctcaaaaaaaaaagattaagctttgaatagtatgtgagatgccagtgacctgaccgccaagtatattgcgagagtcagtgaattgttagttcttttttataattcgaaaatcaagtattataaggcctgggaaggatgcttatgatattaaattcatattttaaaatgagccttggccgggcgtagtggctcatgcctgtaatcccagcactttgggaggccgaggcgggtgggaggcctaggtgggtggataacctgaggtcaggagtttaagaccagcctggccaacatagtgaaaccctgtctctactaaaaatacaaaacttagccgggcatggtggcatggtggcggacgcctgtaatcccagctactcaggaggctatggcaggagaatcgcttgaactcttggcggaggctgcagactccataaaaaaaaaaaacaaagcctctctgtagaaaggatctaatggcattcttgaacccaaaatatctgagacagatttcaaccattttagaaagtttattttgcgaaggttcaggacacacctgtgacacaggctcaggaggtcctgatgacatgtacccaaggtggacggggtgcagcttacttttatacattttagggagatggagacgtgagacatctatcactatgtgtaagacagacattggttctgtccagtaaggtgggacaactcgaagcggggggttccaggtcacaggtagataagagacagaaggttgaattcttttgagtccttgattaaccttccactgaatacacaatttagtctggctcagtgtgtctgcatttttacaaaaacaatagaggcagaggaaacaatcagatatgaatttgtctcaggtgagcagagggatgactttctgtcctgcacctgtgaagataagctatccgtttacattgtcagggtgaaattcaacagaaccctctgacggaaaagatcttgaggcctgcagggaatttccttgtgggcaaattgcaggggagatatgcacctcttttgtcttttaagctatcttatttaggaataaaataggaagcaggtttgcctgatgtagttcccagcgtgacttttcccttggctttgtgattctggggttattttgttaccggaaaggggtcctgatccagaccccaagagagagttcttggatcttgtgcaagaaagaattcaggacaagtccgtagagtaaagtgaaagcacgtttattaggaaagtaaaggaataaaagaatggctactccatagccagagcagccccgaaggctgctggttgcccatttttatggttatttcttgatgatatgctaaacaaggggtggattattcatgcctcccctttttacaccatatagggtaatttgctgtcattaccatggcatttgtaaactgcagtggtgctggtgggagcatagcggtgaaaatgaccagaggtcactctcgtctccatcttggttttggtgggttttaaccagtgtctttaccacaacttgtttttgatcaacaaagtttttatgacctgtatcttgtgccgacctcttatctcattctgtgacttagagcgccttaactgtctgggaatccagcccagtaggttccagccttattttacccagctccttttcaagatggagttgctctgtttcaaacagctctgacatttttacacattttatccagaacagcaggcatctccagaaggcagggacaccactgcccacccttcctttcctctaccactctttgaagccacgctgtgtttcccagtagggcgctctgttctctccaatccccacactgtcaaagacagccacaagcagagatctgtgtgaggggtcacctgctgccagggctcaggcagcaggcttggccagtccttttccagcattcagcctgtgtatggaaggattctatcctgtgcattagcagaataacatctaattggtctttgtttgctccagaacatagaaagtagagctttttcattgcattaacaactacatcgaaacaggagacttctctcaccccccttgcaggatgtgctgcaggggcatggcttgtctgttcgccacccttaataggacggggagcaagtaaacagtcaggtgcaggagcgggggcgagtgcttttgggctgcagccccacggtagcatctaagatgggtgcctgtggctgccaaagccctattgggcatgttgcatttatacgtttgtactcagatacatttagctcagttgcagtgctcctttagctctgctacctacagatggcttaaatgttaaccagctcagtgccctgttggtgcctgggttcttgcctggtgtccaggaagaatcaggtcacacatggacttgaaggatggtgaatgcaggggttttactgagtgttggaggtggttctcagcaggatggatgggaacgtggaaaggtgatggagtgggaagaggatcttcccctggagtttggctgtccagcggctcacctcctctccaaccgtccccagctgaactcctctccatgttcagacgctccttcttttctctcattctctgctgccctgttcagcgggtcttctgttcgtctgctccgggagctgggggttcggggtttatatgggtacagggtagggggcgtggcgggccaaaaggcaatgtttgggtgtgaaaacaggaatggctgttcccatttagggccacaggtttccaggcttgagggtggggcctttgctggggaaccgccctcttctacccagtattttcctgtctcctgtccatatcaacatgaagtagtacatgggcagaacggatatacaggtagggttggatattgcttaaaaaaaaaacacctttcggcaaattaaatttaacagagtctaattgtgcaaagaacaattcacaaatcagacagcctacagaagaagaataggttcagaatgactctggggctaccacatgggcagataacataacatttatggacagaaaaaggaaagcagaatacagaaaaaaaaagtgacagacagaaacagctgggctgattacagctgggcatttgccttatttgaacctgctttgaacagttggttgcctgtggttggctgagactcagttatttgttacaagagcaggttacagtctgtttacacattaagataagttacagtttactatgtatggagaaaatttcaggctgaggactaagctctaattttttcttgtcttgcccaaatatctaagagacctggggagtcatgccttataaatcatagtctcatcacatgggttttatttaaccctatagatcgtgacttactttccagtctgactctggcataacacaacatgacaaagaagaaagtcaaaatattttatcccaaaacatgtttcttggccatattttgaaatggtcctgcaaagccattcattgtgggggggaaaattgcatctgtaaagaatctctgtttacatagctagatctttttctctaggccctccctatcctgaagagattacctgacagtctagcaccttttaaaggtctgaataaaacattcgtcatctactgtctctaagggcagctgctatgagacttcaaaagaaccttggtctccacaatgttttattttaacatgaacatttcctttctattaaccccaggtctttagacacactcaaccagttgtcaactagaaagtgtttaaattcaccttatagcctggaagcccgcagcttcgaattgtcctgcctttatggaccaaaccaatgtagttctctaatgtatttgagtgatgtctcatgcctccctaaaatatataaagccaagctgtaccccgaccaccttgggcacatgttcttaggaccccctgagggctgtgtcacgggccatggtcactcatatttggctcagaataaatctcttcaagtgttttacagagttcaactctgttcatcaacaaggccaaacttaacacaacaatatgtctatgaaatagacaaggatggcagcattggaccataggagtgggagggaaaagtaagctaccaactgtgagattcttattacctaaataaaatttttggtgaaaaacgataaaaataaatactaaatcaccaccatctcaaaaaacaaaacaaaacactacaagcagggcagtcatttttgtggtcactgcccacctgcaattggtctgtgtgatggaccttttgaaggataagtagatctcacaccatataatggagtttgagaccaaaatataagaagtagtagtgttaccagaaaggggtcctgattcagaccccaagagagggttcttggatctcatgcaagaaagaatttaaggcgagtccatagagtaaagtgaaagcaagtttattaagagagtggaggaataaaataatggctactccctatgcagaacagccctgagggctgctggttgcccatttttatggttatttcttgatgatacgctaaacaagggggtggatcattcatgcctcccctttttaggccatatagagtaacttcttgatgttgccatggcatttgtaaactgtcatggcgctggtgggagtgtagcagtgaggatgaccagaggtcactcccgtcgccattttggttttggtgggttttggccggcttctttactgcaacctatttttatcagcaaggtctttatgacctgtatcttgtgccaacctcttatctcatcctgtgacttagaatgcttaaccatctgagaatgcagcccagtaggtctcagccttattttaccaagcccttattcaagatggagccgctctagttcagatgcctctgacagtaggggaaaggagagacataaaacttcacattcctgaagactttctcatgcttttgattgaaactcaagccattgaagaatatttcagccagagtatgcagcaacccatttttctaggtccagtagttgacaccgtagacttgtcaagggaaagccaaatgcacacatcactgtgaacattggaaatactatctccaggatgttagaaaacacttttaaaaatgacttgaaggaaaagtcggaaggagaacataggaaagggcctttcatttctcttaagcaggagtgttaaagcaattattgacctactgtactttgttctcattaagaaaccaagtacctttttaatgacttctatgggaagtattctaaatacagaagtgataatagaaggatttcttggaagcagaggatagcactctttcatccaaaagaacttagaggagcatttgaagagggattgctgaaggctgtggttttctttcctgtgcacattaattcaatgtcctttttactcagtagggtgtaaacatacatcatttaaattaacataaaaagtcagaaatgagacctccattaacatatccgcaggggaggaatgaggcagtcccacgtgacttcttgctgctgttgcctcccaggagtggggctgccaggcgggtcctcctgctgaccccctcctcctctgccttttcctgtccggttctgcagtgtcactcccagcaggtcggctcatcttggcgctctcggccacagatgtctcgacaggtccgagttacttatgtaattgctatcaacttgctgtgcaaccctctggggcaggacatgatgcctatctttaacctctggatcaattgaaaactggcttaattggctcagtgtccagcagtgccattatttgactcccctgtctggcctcttactcttcaaggatgcagaggtctgggaaggcagagcagacctgcccctactctgcgatggtgggagtgggagctgctctgggctagattcagaggattctccagctactcagccacccagagtcctccctggagcccttgcctggtggggcactgtggggtgcagtgcatgcttctcccctgtagtggagagcctgaaattctggccctttcatcctcttttcaagattattcattcctcaccctcagccattcgttccctccactcagagcctgacacttattaaaatactaaggaagactttattcaagactattgcaatagacgttgactctgttgcaatagaggagagagattggggtcaactctgaatacaacaagacaagtgggatttatagctaagtagcagagtgacagggttgtagctgtgaaccccccaaatttgggacaggtctcagttaatttagaaagtttattttgccagggttgaggactcacacccctaacacagcctcaggaagtgctgacggcatgtgcccaaggtggtcggggcacagcttggttttatacattctagggagacgtgagacatcaatcaatatatgttaaaagtacattggtttggtctgcaaaggtgggacaacttgaaacaaaggcgggaagacttgaagtgggagggagtgtccaggtcccagataggtgagagacaaatggttgctttcttttgagtttctgttgagcctttccaaaggaggcaatcagatatgcatctatctcagtgagcagagagataactttgaatagaatgggaggcaggtttgccgcaagcagtttccaccttgagttttccctttagcttagtgattttgggtacccaagatatattttcctttcacatggctgtaatatgtctgttgctggatccctatggcaagtggatgcactgagacagcagattgcagcagacaaaaaggtttaattgttgggccactgaacaagtagatgggaggaaacctcaaatccatcgcctcaaggaattggtggttaggggttttgagggttctggaatgggctgaagtgtggagattgttgattggtggaagagtgcagggtgaagtcacaggacagggaggggaagcatctctatattctcaggctgatcccattcctctgtgagggtcttaaaactggttgctagaatttggggtctaaaaaacatcttaagtgatccttaaacaaaagccgtaggattctaacatcagagaccttatatatagaaacaatggggttgcaaatcaattcttaaacagtctgagggccctaatatcagagatcctatctgcacatgggcagtgtctagtgctacaggactttcagcaacaaggaagtgggccagagtgcagcctgattaatgcttatgttaccagaaaggggtcccaatccagacctcaagagagggttcttggatctcacgcaagaaacagtccaaggtgagtccatagggtgaagtgaaagcaagtgtattaagaaagtaaaggaatgaaaaaaaggctactccataggcagagcagtggcatgggctgctagactgaatatagttatagttatttcttgatgatatgctaaaccaggggtgaattactcatgagttttctgggaaaggggtaggcaattcccagaactgagggttcctcccctttttagaccacatagggtaacttccgggcattgccatggcatttgtaaactgtcatggagctggtaggagtgtctcttagcatgctaatgcattatagttagcatataatgagcagtgaggacaaccagacgtcactttcattgccatcttggttttggtgggatttggcaggcttctttactgcaacccgttttatcagcaaggtctttgtgacctgtatcttgtgcccatcccttatctcatcctgtgactaggaggcctgacctcctgggaatgcagccagtaggtctcagccttatttcacccagcccctattcaagatggagttgctctgattcgaatgcctctgacacttaattataactatatttctgttccgaacccaacctccaagtcttttcaaccctattgggatggtttcagtgtcagtgggtggaagactactaataagagacattaagcgtgggggattcttgttaaatggacctaacaggattcttgctaaaggcaggccaagggctcagacagcaagggtatggggtgttgaacttgatcaggtatcaaattaggggattttctcaaacctgattttgcaggattcttactaaaactggacttggcatggacagacacagaaggccaagttcaaggcctagtagataagtgggatcagaggagcctaaccaaggattggtcaaggagagcatctttgccaagaacacgctcctggtccccttcccctttgcagctttgatgaacccaacctctcaacaagagtggggttggggaaaggctctcttttgggactcccctgaaacagaaagaagctgtcatactgtccccccatcttccctccctcagcacaacctttagaccacagatatttgctgggaaagtgatcttttcattctttcctgtttcctttgacaaacagaaagggcacgggtttgaatgccagttgataatccttccatgttgctagtctcaggctccccacttggtccgtggacaggatcaagactccaaaaaccttggtgctctggggctgaggagagacagacatgagaagagactgctttctcttttgtctgtttcccttgtctagtcttgttctccccagcatcctcaatacacattagttccagagttacaattgcagctgagttcaaacttgcactgctcagtgcaggacagccaataagtaaagagacaaggtgttggggcaaggaagacaaatttattttggagatccagcaaactgagaagatggtggactagcattctaaagaaccatcttaatacgaacttaagttaatatgagccttaagttaatagggctccttttatgctaggggaaaggggaagagaaaaggggttgagatcaagaggtgaccaatggccacagacatctaggtggcagcaagggtacaaggatgttgtgaaaattctttttccttggtcagatcacaatgctcctataaatgtttcacataacatgcttacttgtgggtataccctccttatctcctcaggggctaattttgggaagggactactgtccttactttaaagttaaatataaactaaattccttccctagttagctcagcctacgtgcagagataagcaaaagtagttaacctaaaagatatcaccctttggggggtgtcagaggcaaaatagagtcagtcatgctaagctcccctccactgttacacaacataatttaaagaagaaaagctttatgataactttattcaacctacttaagcatcactctcttgagcaagacgttgccaaatgtaattttctacatgcgtgtttctatagactttgatctctccaggataactgcatgggaagccacagaagaatgtggcggaagcttccctcccagcccgatctcctcctactgtgtccaaacctttggcccctctgaaagttgattgaaaaatcaactcacaagaggcagattcatggaaaaggcatacagatttatttaacatgtatacatgggagccttcagagtggagagccaatccaccaacgaggttccgaagcttatatactgtcttgaggttatagaaaggatgcatggccaaaaacaggttatggtggtaagtcagcttttattggaaggacagtttatggtggcgggagaaagaaagaggcttggctagcaaaggtggccttgttatgtagatgaagtctcacatggtagcagccctcagagagaatggatgttaaatatctcttttcagacttttaaaggtgtcagactctcaatctctcctggatctaggaaaggtctagaaagggaaggcctggctgcatgaatggagattctttacagatgcaaatttccgccacaaaagatagctttgcaaggccacttctgtcagctgaccctgcagtggccgtttcaaaatacatcaaagtcacgtactttggggaaatattttgattttgcaaatcaaaaataaaagtcctcctgctgactaaatggaccaccctcttggccaagggtatcccaaggaaacctgaaaaactagttcagaccatgactggaagttgaggggtcagatatgcctcattgtaccctctcccttggagtgtagatacaaatgaccagcattggtgttaaaatagagatcataagactgacaaaacagactctttgtagcaataaggtaccaacttccaacttcactctggtatagtatcacatgacagagagcagacctggaaagaaatcaaagtgttttacccaaaaatgtatttctctgacatattttgaaatgtctctgcaaagctgtttcttgtgggggaaatttgcattctgtagagaattcccttcccttcctaggtctttcctggagagtctgacactttttgtggtccaaagagagatatttaccatctattctctctgatgcctgctacctggaggcttcatctacataacaagagctttggcttccacagtcctcatcttgactcaagcatttctttatgctgacttgaaactccgcagacaaaatttagctcttttaacagattgccaatcaagaaatctacgaatccatctacaacctggaaacacccgttttgagatgtcccacctttctgggatgaatcaatgtataccttccatacagtgatttatgtttttgcctgtaacttatctctccctaaaatgcataaaaccatgtgcccaaggtggctgtaacccctccaccttgggcacatgtgctcaagacctcctgaggctgtcacgggccatggcccttaacctgggcaaaacaaacctctaaactgattaagacatgtcttgggtaatttttgatttacgattttcttcatggcctctgacattggtgggaatgaagttcctaaatagcttcttttatctcaaggttgcttagtagaagcactgacccctgctttgtcttttccctaagtctagttcctctttcaagttatgcctgggaacatttcttggagacacagcagtcgtagctctgggatatctacaaaggaggaacctagggacagctctctggttggaaggaagtgaggccaggccacatgtctctgtttcattttcatgcaatgtataccatgttatagatcaatagattcagctgtgttttccaaatatggttttatgcccatcaggctcacaggagatggagtaaatatcagttgtctgtactaccgaaacatgactatttaaaaacaattgggctacttcaggggagtggggcaaagtcatgcctgggagattgtggtcttcaagggacaattgcaaaagcaaggagtcttatttttcaaagttaggaacatctcactttctgtgacatgtgttcttaccaaaaaaaaaaaatgacatttggagtaatttctgcatgtgaatcctgcttatctgaccccttcctcatggcaggactttggctgctgagctaccagcttcgtcccagaaggaaggtttgggactctgagggcctgagacttatgcatggagttctgctctagacaacagggaacatggaaaggcaaaaaaaaacaaacaaaaaaaccctcaaaatctgcagggaaacctgaatttcaaatccaggaaaactgtccatggatgacagctgtggtggggatcaaggggtctcagagccaaggtgtattggctagtgtctccatagactgccaaaattacacgggcatcctgggtgagaacctctacaccagccaggccttgcacctggattttatgaatgcatgtgggaaagactatggtatggtctagggcattcttttctcgttattttaatttcttaaattttagagacagggtcttgctctgtcacccaggctggagtgcaaaggcgtgactgtacctcactgcagcctcaaactcctgggctcaagtcatcctcctgccgcagtctatagtgtagttgggactgcagatgctcaccaccacacctggctagtttttaaaattttcttgtagagatagagtctcactttattgcccaggctggtctccagctccttgcctgaagcaatcctcctgtatcatcctcccaaagtgctgggattacaggtaggagccatcacacccagtcttttctagggcattcttcatatgatagatgagattgcccaaaatcccactggcccaaactcctcccatctttttattttattttatttattattttttttaattggagacagagtctcattctgttgcccaggctggagtgcagtggtgccacctcggatcactgcagcctccatctcccaggttcaagtgattgtcctgcctcagcctcctgagcagctgggattatggatgcccaccaccatgcctggctaatttttttgtttttagtagagccatagtttcaccatgttagccaggatgatctcaaactcctgacctcaggtgatcctgctacctaggcctcccaaagtgctgggattacaggtgtgagccactgtgcccggccctaggctcctcccatcttgacctgggtgtttgcgatggtgtctggtgctacacggtgcattttaggttctccatctgggactgcttttgttctttcattccttcttcttgtagagtataatgcattcattcattcatctatttgctcaataaaaaatttgttaaactcttattatttgttgagttcagggtcatgatcataaatcccaacagaagctcttgcctctggaaggagctcagagattggtgggggacagaaacgtttatcacatccttaaactgatgagctcacaatgacaaagtgacatgcgtgctctgatggtagagagcacggtgttgggagaaggtggttggagtggagatatggtgtatataggagtccggtaagtgaaggcacagcagaggagggaaggtgttctggcttcaggaaagggtggggtatgtgaaggttctaaggtggaaggccaatgactgcaaggaagtcattgttgctgaagagaagggataggtaatggtgtaaaagaaagttctggagtcccaaagatctgagttcaaatgatggctctgctgtgtcaccgtgtgcaagttatttaaactttataaccctcaaattcctcatttgtgaattaacagtattcctgtggcctaggactggtcacggaaaaaccttcgacacattaaattacacagagtttaactgagcaaagaacgatttacaaaccgggcaacccctgaaccagaataggttcagagagactctgtcgcagctgcattgtggaagtagatttgtggacagaaaaaggaaaataacacacagaaaatggaagtgaggtatagaaacagcgtgattgggtacaaacgaagattgcttagcgcttgccttatttgaacatggttggaacacttgaccactgttgattggccaaaactcggtgactggcagaagagtaggtgaccatctgtttatacatccagttctgttacagctcactatggacagagaaaccttcagggtgaatttaaaatatgtaaggaggtagctttaggctaaacttaattgaataggatttagtaattccctcattctttgaagactgacatcagggaccagaggaaaatatgactttttcacacaattagagatattgttcactggattaaaatgttggtctcaagatatatagtacccttacatttaagattgtagtccaggccaggtgcagtggctcacgcctataatcccaacactttgggaggctgaggcggacggataacctgaggtcaggagttcaagaccagcctagccaacatggtgaaaccctgtctctactaaaaataaaaaacgtagccgtgcatggtggcagatgtccataatcccagctactcaggtggctgaggcatgagaatcacttgaacctgggaggcagaggctgcagtgagccaagatcacaccactgcactgcagcctagaagacagagcgagactccctctcaaaaaacaacaacaacaataaaagcaaacataaggttgtagtccagttagaaattaacagcaatgatacattataaaaggtaagagacacaatgtgtcttaaatacatatttaagttttggaggatgtttggttggtgggttggttcctggtatctcctgtggtacagaggagaaacagcagaagccaacttgaacggagcacttgaaatcgacaggtccttggcttcggtcatgcctcttcccagtgcttcctgtgtaaaggatgtttaggtctttccattactcatacacagacccagattcagaaaggaaaaactctttgtaaactgctcacttttagaaatgaaaagattgatccaagtggaaggagggagacgatgtgatataaaaactgcaacctaggcagggatttaaaatgaatcagaaaacgaacagaccagagaacgtgcttaattcaaagacacccaggggaccctcaagttctaaaaacaagtgactaggaatcaaagtcagctgtttgatttttgtattttagagagtgagggtgggtgttttgcatatgaataatattttgaatgctattggatttttttaatacagtgggatcattgcttttccctatgtccttttttaaaaactctttttcatgcaaattcattaaatttgagatgcagtaatatactggaatcttgcccatctgattccccaaaccacagttaatccttggcacattttgaaaagtatacatgtagttttaaaatggaattatgtgtgacccaaatgtgacggcagccctgtggacatcctttcttcttagcctgcattcttctaaaagtagagctcagcattttttttcctcttttttctgtttttgttttttttcttttccccagtgtctcactctattgtccaggctggagtgcagcaatgtgatcttggctgactgcaacttcaggctccaggctcaagtgattctctcatctcagcctcccaagtagctgggactacagacaggtgccaccatatccagctaatttttgtacttgtcgtagagaaagggtttccccatgttgcccaggctggtctccgaactgctggactcaggggatccgcctacttcagcctcccaaagtgctgagattacaggcaggagccactggacctggctgagctcagcattttttttttccaaaaaaaaaaaaaaacaaaaaaaaccaaaaaccatatttggctctacaaagcatattttgtgtaaaatagattctataggcaattaatgcaagagatcctagggaaggctgtgtcacaagccactgtaaaacttaacaaaattgcaatcacagacctaattctaccttccaaagtcctcatgggccactggttatcccctcctcctccttgtcctagatccttctcttctcctttttttatgctaagcaggttatctcttagctttttcagtctgaattctcaagctcagaatctcttttagcaaacaagagccttccagcaatccatcctttgcagttgaggattataaacaaccaagaccatttttttcccatcagagatatttgtttttcagtttgcatgtgtgtattggctgaatcctaatatttgcatttcatgattgtgttctgaactgggagaaaaataacccaaatttccctaagcaggtacattatcctgtctgccctcagaaagcctaatctgtgtctcatttttttttttttaatgtaggttgttatcttactcattttgggctgctgtaacaaaataacatataccgggtggcttataaacaacaaaaatttatttcccacagttctggaggctgggaagtccaacatcaaggtgctggcagattcagcatctggcaagggcccatttcccggttaatacatggccccttctccctgtatcatcacatagtggaaagagacaagagagctctctagggtcccttttctaaggcatggatcccactcatgagaactccatcctcatgacctcatcacttcccgaaggctccacctcctaaaaccattgagagaataacattggaggttagggtttcaacatgagagtttggaggggacacaaacatttagctcataatggttattgtggaagatgtttactgaacttctgaagcaaatgacaaagctagcttaatgagacattaaaagttatttagggctgggcgcggtggctcatgcctgtaatcctggcactttgggagaccaaggcaggctgatcaaatggtcaagaggtcaagaccatactggccaacatggtgaaaccccgtgtctactaaaataaaaaaattagctgggtgtgatggcgtgcgcctgtaatcccagctagtcgggaggcagaggcaggagaattgctggaacccaggaggcagaggtttcagtgagccgagatcgtgtcactgccctccagcctggggacagagtgagactttgtctcaaaaactaaactaaactaaactaaactaaaataaataaaaattaaaaagtcatttagtctggatatcatattataacagtgttgcacaatggaccctcagtccaaataatccttcttaaatgtaggaccttgtgacctttgttgaccaaaacaaaaacgaaaaccaaccccacaaagcccaaactgtgaagtcttgaaagaggtttcttctgagccaatatgagtgaccataacctggggaatgagaggtcccaagaaagtgtgcccaaggttgtcaggttacaggttggctttatacaatttatgagacaagaattgtaggtaaaatcatgaatcagtacatggaaagtatacattggctcagcgtaaagaggcaggatatcttgaagtgtgagggagttggggctggtatgaggccattggtgaattcaaagattttctgattgtcagttggttaaaagagttaagctttgtctaaagacttgaagtcagtagaaagaaatgcttgagttaagaaaaggggagctgtggagaccaaagttcttgttatgtagatgaagcctccaggtggcaggcttcagagagaatagatgttaaatatctcttttcggaccttaatttagtgtcagactcttagctaatcccttctagacctggtaaaggcctggttggtttaatagagattctctgcagatacacattttcctcagaaaagacagctttgcaaagccatttcaaaataagtcaaagcaatatattttggggtaaaacatttggatttccttcagggtctggcatgtgacactataccagagtcaggttgcaatttggtatcttactgccacagtgagtctgttttctcagtcttatgatctctattttaatgttaatgctggtcagttgtgcctaaactccaaaaggggtggggcataatgaggcttgtccatcctttcttctcttcatggccaggaatccaatgtttcaggtttctctggggtccttttggcccagaggggcttcattcagtcagtggggtggcctaggcttttatttttgccttacactttggacaagtctcctaacctgtcagggactcaattttataatctgtaaaatggggacaaatatcagtgcttattgttaccagaaaaagttcacgatccagatcccaagagagggttcttggatctcacaaaagaaagaattcggtgcaagtccaaggagtaaagtaaaagcaagtttattcagaaagtaaaggaataaagaatggctactccataggcagagtagcagtttgggctgctggactaaggatacttatagttatttcttgattatatgctaaacaaggtgtggattacttatgagttttccaggaaaggggtgggcaattcctggaactgagggtttctcctctctttagccatatagggtaacttctggatattgccatggcattcgtaaactgtcatggtgctggtgggcatgtctttagcatgctaatgcattatatttagcatataatgagctgtgaggatgaccagacgtcacttttgccaccatcttggttttcatggatttgggcaaggcttctttaccgcagcctgttttatcagcaaaattttttttgacctgtatcttgtgctcacctcccatctcatcctgtgactaagaatgcctcacttcctggcaatgcagcccaataggtctcagccttattttacccagcccctattcaagatggagttgctctggtttggacgcccctgacattgtgtcacaggcttgttgtgagcatgaatgagttactatcagtaaagtctaacatccagaaaggtaaaattatgcctcaatataaaatgaaaatgaggaacatattttattcaacttattaattcatgggagaatcaataaggtgttaagtccagttcaaatgagaatttaacttacagaggtgtatattctccaccagaaaaaaaatcattacaagagtcatttgcggtgctgttagtttcctacaactttgcagctatccctacagcaatgggctgaaaaatgccttccacccaagatacccacattccaatcctagaacctgtgaatgttacttcatgtggcaaaaatacgactttacagttgtgattcattcactccacaacagtctccagatggggagattatactggattttccaggtggccctagaaggagagaggcagaggaagatttgacccagacaggagattagaaggtggtgtgaccacagagacagagactgaagggatgcagccgcaagccaaggaatgccggcagccaccagatgctggaagaggcaatgaatggcctctcccctggagcattcagagggaacatgatcctgctgacaccttgattttgttccccagtgaaactgatttcagacttcttgcctccagaatgtgagagaatcaatttctgttgctttaagccagtggtccccaaccatgttggcaccagggactggcttcatggaagatagtttttccacagaccaagggtgaggatgatttcgggatgattcaagcacattccattgattgtacactttgtttttattattattacattgtaatatataatgaaagaattatacaactcaccataatgtagaatcagggggagccctgagcttgttttcctgcaactaaacggtcccttctgggggtgatgggagacagtaacagatcatcaggcattagattctcataaggagcgtgcaacctagatccctcgcatgcacagttcacaatagggtttctgcgtccataagaatctaatgccgctgctgatctgacagcaggtggagctcaatcagtaatgggagtggtggggagcagctgtaaatgcagatgaagcttcgctggctcgcccaccactcacctcctgctatgtggccaggttcctaacaggctgcagaccagtacctgtctgcggccctggggttggggtcccctgctttaagccacctagtttgtagtcatttcttacagttgccacaggaaattgcctacaaagtcgcaaagagctttctcaacagaaagttaatcaaagatgcatactctatagaaacaggtatccccagtgagtctgctagatgatactcagcacctcacttaaaagacacccaggaatctcctacccattcctaagtttggacagtttttcctgacaattttagtctacaaaatgcttggaatatatataaagtaattcatagaaagtaagcattactatataaattttagtgatactactactcctcctactaattataataattatcatcatcatcatcatcaaccaccatcattattctcttttatcttcttggcttgttcttttcacttgatgggttgttttgagtgggaaccatgattctcttgactgacaggcttccagacccagtggaagagaataacgggattatgagtgggaactccttgggaacacccaggagttcaaggctgcagtgaaccatgattgtgccacagaggttggtgttttcactgttagctgtgagagtgcgaaggcacaagatgttagcagtggaagaccaaggtgtcagtgataggcttggggttaccctgcccttccagctggatatcttgagctgctgtggagatgcaaacagcataaaggacaattgaatggaaagatgtgtggttttcagtgaacgaatatcccggagagcgtgatgagggtgaaaaaatacttactcacaaatcccctgaacaggggaagcaaaggtggtattgccaagtgaaaatattttgtttaaaaaaaaaaaaaaagagtgaagtgaagaaaacctataggttgactaattgttgaaggtatggagtgtggcattcagcagcattttaagttaatctaggccagtggttttcaagggggtaggtggattttgtcatccaggggatatgtggcaagtctggagacatttttggtcatcgcagcggggagtgctattgatgtctagttggtagagagcaggactgccactaaagatcttaacaatgcacagggcagtttcttacaacaaagaattatctggccccaggtgtcactaatgctgaggccaggaaactcagctttagggtgagaattccagactcacagaatcagagtcctgtaagggaccttagcaagtgtgaggttctgtgattttcaaaggacatctttcagatcccacagggtagggggaggcgccaggagcccagggaccagagaggcagtggagggtgtggagggtggatctcgtggtgttaccacatcaccggcatctctctcctctgcaatgggtgttggtgcaaggatgagtatttctgctgacagaaatatataaagtaactattcatagtaagcattactatgtaagttttagtgatactactactactaataattaattatcatcatcatcattatcatcaatcaccatcatcattcccttttatgtacttggctggttctcttaacttggtgggttgtgttgagtgggaaccaatgattatcttgactgacaggcttccctgcccagtggaagagaataatgggattatgagtgggaactcctcagaacatccaggagttcaaggcagtgagccatgattgtgccacggaggttggtgttttcaccgttagctgtgagagtgcaaaggcataagatgttagcagtggaagaccaaggtgtcactgatcgtttcgaggttaccctacccctccagctggctgtcttcagcagttgaggagacgcaaactgcacagaggacaatgaaatggaaaaatgtgtggttttcaatgagcaaatatcatggagggcagtacctagagccgggcatagtgactggcacctacagtctcagctactcaagaggattgctggagcccagacgttcgaggctgcagtgagctatgatcgcatcactgcactccggcctgggcaacaggccaagatcctgtatctaaaaaaacaaaaaaaaaggttgaaaataactagtgtgtttttattttgtgttgaggaataaaaaattaacagatgtggtcactaatagtaccgggaatcctggctgcctctggtgcctaagcccacccttcccaatgtctattcagaccttgttagaaaaacctatggggtttccaaccccatttctgcaaatcttgccgacatgcgacatgagctggtttaatttctgaccataaaaacacattaaacaggatacaataaaaagagtcctttctttgttaagaatcttattgatacaatttactaaggcatttaccgtgtctaccctgtacatggctgtgaacatttagagggtgtaggatttagggctaaaattatcccatctccgatatatattctggacactggagttttagataaatccgtaacttatgtttacgtctcttctaaacatagatggtgggaactggaaccagcgtgcttgtagctgggggagaaaaataaaggcacactggctgtgggaacatttatccttcctggtggctatggcaaacctgtgatcctatgatcactctccttatgtttggaggagtttccaccctctgagccccacctttgtttgttttgggttttttgttctgagacagtgtctcactctgttacccgagctagagtgcagtgtggcatgatcatggctcactgcagcctggaactcacaggctcaagcaatcctcccccctcagcctcccaagtagctggaaccataggcgtgccccaccatgcccggctaatttttgaatttttctatagcaatggggtctccctatggttgcccaagctggtctcaaactcctgggctcaacctatcctcccacctcaacctcccaaagtgctgggttatcaggggtgagccaccgcacccagcctgagtcctgcctttccaagatcaaagtaaaaaccagcttcactgcctcccttgtagctagaccatgtcctgggagccaggcttctccagtcagacccacaggaagggtggcttcacagacaaaggtctgtgaagataggggtaggaggaggatgaaaatgtatcatgcaaaacccatcctgatgacaagaaggagagacatttaactttgaaaggcaaaaattgtaccagtgttaatggcggcatctcatttcctgtgtggacaaagtggcagctggatttaggaaccctcttttgataaatcccttttctctgaaactagctcaatttggttctggagaccataagtaaaatcactgcctgatacagcaggagaaatgttactgtggaaatatctcagagaccaaatcacttggcacttcgcagttttgtgaaatactaactgtcaccatcagacaaaccttcactgctcccacctcctcagcattgcctgccctaattaggtgggttttggaagaactcactagcaaccataacctttaaatagaccagaaattgtcttttacagtggattcagaatcagtagctttataagaagggctttgctcagttcatgatgactctatgcatgattgactccatctctgtacctgaattacaaaaaaaaaaaatgtggcaagtaaagaaaaggcaaaatgttatttttttccccactcagttttgcactggggctcagcacgtatggtttcaggtaggctctgccttaacatattcctggaataagcttcagaaaagaggctgtgacaggtggagacagcttccttgattatagctcagcatggttcaaaggacactctggtagttaattgattcaggcaagataatttgtgggcaataaacagcacagaccttttattttcaactggtcagttagaacgaagtttctctaattcagtcttagagaatgactttttttttttcctgtgctggaactcattcatttgcatatagaaagatgtttaaacctctgtagaaatgcccagagattgtaaaatctaacattatgtttgcaaagatggcatcaagctccttcctcctcagacataagaaaattgcatttgaacaggccgggtcttgaaaaccagctgatggtgtctgagtcaaagatggagctgatattctcaggcaatgggtccactttggggccactccagctgtttttctaggaaatcttccaaagcaaacaccacagtggtgctattcctgtgaaatggtggcacgtcttcttctgtgatcatggccagagacaacttctttctttgaaatacatgcaaaaggttttgctcagcctctggagtaaaccccatctcaacagagcagctctatcctttgagaatatgattttgacatctgatggactcccaatatttgatgcttgttttcaaggccacactaaccccagttgggctgagattaaaatgaggtccatagtaacagtcacgggtccacagctcttggagaccccctctttttttggagtcttttttttttttttttttttttttttttgagacagaggctctctctgtcactcaggctggagtgcaatggtgcaatctcagctcacttcaacttctgcctcctgggttcaagcgattctcctgtctcagcctcccgagtaactgtgattataggtgtgccccaccacacctggctaatgccctctgcggactcttgcacagtcctggccatgcctctcctgggcagggtctctgcagtcagtcctcttgtccaccagcttcatgctttccattttcctctcctactcatacgtggcatcctctgcaatgcctcgaacagccagtgcagtgcatggtgacttggtgacacattactgaccagagacactactgagctctgtcgctcatgtcacccaggctggagtgcaatggcacgatcttggctcactgcaacctctgccttccaggttcaagcgattcacctgcctcagcctcccgagtagctgggattacaggcatgtaccaccacacccagcaaatttttatatttttaatagagaaagggtttcaacatgttggccgggctggtctcgaactcctggcctcaagtgatccacccacctgggcctcccaaagcactgggattacaggcatgagccaccatgcccagctaaagccactgatttctgaagtcaaggatgttgtctttcatcattgccaaagtggctggtgccaaccccatggaggccttgtgctttcaaacctactagagattttcttgaatgagccctttcatgacagcccaggcaacacagagctacagagggagggaacctctgccaccagcctgtgaccataataagacaaacagaccacatcctgcactggctggcacctctcttctctaagtctggtccctggctttgccccaaactggtgcatttttcccaggaggcagcttggaatcccttacaaaaggccatttgacaagtcctctggaaagactgaccttagatgaaagctgggtgtgggccgggcacagtggctcacgcctgtaatcccagtactttgggaggctgaggcaggcagatcacttgaggtcaggaattcgagaccagcctggccaacatggtgaaacctcatctctagtcaaaaaaatacaaaaattagtcaggggtggtgggtgcacatgtgtaatcccaactactggggaggctgaggcaggagaatcgcttgaacccgggaggcagagctgcagtgagcggagatcgcaccactgcactccagcctgggcgacagagcgagacactgtctcaaaaaaaagaaaaaggctgcatgtggtgggtggcctggccatatgtgtgctgggcctggctgaactacacttcccagaattctcttccttgtgtgttttccagtagagtggactgcaagagggatacctatgggagatgtggaaggtgcagggggaaacagcagccgctttgtagctcacccacattactgctcatctgctgcctccacttgttggctgggcctgctgcaactccacctgcccctggagcccctccaggttctcccacagctggactttgtgtggctgttggctccaccgtgaagggccctggcttctgcctgacacgaaacccaaggtcagaggcaataaggcacttcgacaagtttcattcgtactcctgggctccagcttaagtttgtgggtttcagcttgttcttgcttgcttaggttatagccgtcatttccccttcctggctgtcttccctgtggactgcagctgccagcatcagaaggaaaggaaagaaggaaagacaaagtcagttctagagactgcttaaccagctcccacagttgcatgaggtcaaatccttgcaaaaagtcataaaagtgatatatatgtgcattgatgtataggtatacatatatgtatatgtgtgtgtgtgtgtgtgtgtgtgtgtgtgtgtatgtatggtcatgcattgcataatgacaaggatacatttttttttttttttttgagacggagtctcgctctgtcacccggtctggagtgcagtggtgcgatctcggctcactgcaacctctgcctcccgggttcaagtgattctcctgcctcagcctccagagtagctgggattacaggcacctgccaccacgccaggtgattttttgtatttttagtagacacagggttttgccatgttggccaggctggcctccaacgcctgacctcatgtgatctgcctgcctcggcctcacaaagtactgggattacaggtgtgagccactgcacctgccgacagggatacattcaaagaaatgcatcattaggcaatttcatcattgagcaaacattatagagtgcacttatacaaccctaagtggcctagcctattacactcctagcctgtatggtaaagcgtgttgctcctagaacaagaacctgtagagcacgttgctgtactgaatactgtaggcaattgtaacacaatgctaagtatttgtgtacctaagcatacctaaacatagacagggtacagtgaaaacatggtataaagcagcagcccccaatctttttagcactaggggccggttttgtgaaagtcagtttttccagggctgcagggaagggtggggaggtgtcaggatgaaactgttccaccttagatcatgaggcattacttagattatcagaaggagcatgcaccctagatcctgcacatgcgtagttcacaagagtgttcatgctcctatgagaatctaatgtcactgctgatctgacaggaggcagagctcggtgggtaaggcgagtgatggggagtggctgtaaatacagatgaagctttgctcgcctgcgggccgctcacctcctgctgtgcagcctggttcctgaaaggtcacagatcagtactggtccaaggcctgggggattggggacctctggtataaaagactaatcatgcacctgtctaaggcacttaccatgaatggagctcacagcactgaaagttgctctgggtgagtcagtgagtgagtggtgagaaaatgagtggttcatgcctgtaatcccagcactttgggaggccaaggcaggcggatcacctgaggtcaggagttcaagaccagcctgggcagcgtggccaaactctgtctctattaaaaataaaaaatcagcctggcgtggtggcaggtgcctgtaatcccagctactctggaggctgaggcaggagaattgcttgaacccgggaggtggaggttgcagtgagctgagattgtaccactgcactccagcctgggcaacagagtgagactccttccaaaaataaaaaaggaaagaaagaaaatgtgaaggcctagaacattactgcacactactggaggtagactttgtaaacactgtatggttaggctacgctattttttttgagacattgtctcactctgtcacccaggctagagtgcagtggcattatctgctcactgcaacctccacctcctgggttcaagcaattcttatactaatttattctttttaaaatcccttcttcagtgacaaattaacctttgcttactgtaactttgtaactttataaaggttctaattttttgtaaatttttggacactctgacaataatcacttagcttaaaacacattgtacagctgtacaaaaatattttctttctttatagctttaatctataaactttttccaactaatttttttttctctttactccctaaaaacgaagacacgaacacacacattagcctaggcctacacagggtcaggatcgtcaatatcaccatcttccaccttcttgtcttgtcccactggtaggtcttcaggggcaataacacacgcatggagctgtcatctcctatgataacaatgtatttttcttgaatccctcctgaaggacttgcctgaggctgttttacagttactttttgtataaatagaaggaacacactctaaaataatgatgaaagtatagtgtagtaaatacagaaaccattaggtcttttactatgattgtcaagtattatataccgggccagatgcggtggctcatgcctataatcccaacactttgggagactgaggcgggcggatcacttgaggtcaggagttcaagaccagcctgggcaacatggcgaaacctcgtctctactaaaaatgcaaaaattagctgggtgtggtggcatgcacctgtaatcccagctactcgggtggctgaggcaggagaatggcttgaactcaggaggcagaggctgcagtgagatgagatcgtactactgcactccagtctgggtgacagagtgagactctgcctcaaaaaaaactagtatgtattggacataattgtatgtgtgatacttttatgactggctgatgagtagcatcaccagcattgccacaaacatgtgagtaatgcattgtgctatgatgttatggcagctacgacatcattaggtgataggcattcttcagctacattataatcctgtgggcccactgtcctacatgcaatctgtcattaacccaaacttcattatgtggtgcatgactgcatatataggtttcctattggttttatttctcaggttgaacccagactgatacactgggaacccagcatcaggattttttttttttttttttttgacagagtcttactcttgttgctcaggctggagtgcaatggtgcaatctcggctcactgcaacctccacctcctgggttcaagcagttctcctacctcaacctcccaagtagctgggattacaggcatgggccaccacacctggcttttttttttttttttttttttttttagtagaggcaaggtttcaccatgttggtcaagctggtcttgaactcttgacctcaggtgatccacccacttcagcttcccaaagtgctgggattacaggtgtgagccaccatgcccagccaggatttttttttttaagacaggatcttgctctgttgctcaggctggagtgcagtggcaccatcatagctcactgcagcttcaacctcctgggctcaagcgatcctcctgcctcagcctcccaaatagctggaactacaggcatgcaacaccatgcccagctaatttttgcagagatggggttttgctgtgttgcccaggctggtcttgaactcttgggctcaagcaatcatcccgccttggcgtcccaaagtgctgggattacaggtgtgagccaccacacttggcattgtcaggcatttttgttcttctagtcttaggtcttacttggcctgtgctttcgattctatcccaggagtgccagtcctagcttctgactgcccatcctggctcagagttcattctttagaaagtgtctcatggcaggtccttgacctgtggtgccatcactgagagatcacctggccacctttcacccagacactcccacagcttagtgcagatggttttgaggatatccactgtatctattccaattttctgctcaagaaatacctcttattctacacagttaaggagcaagacagctaagacatggtttatggccttgtcattcgccatcattgtagcgccctcagacctcctgtgggttctgacatttaaaaaattcagttgtaatccatcctctgaaatccatcagtctgaaaaggctggatgaatattttctttgtcaaccagaaattgtgtaagctatatagtcagatacaaggaggcagtgcccttttcttaaggaattcataatctaattgttacgtttctctgattggagcaaaatggtgttttactgacccagattttatgttattcaaacaaataaagctccagctaccaatttcaaaagagccactggacttaatgggcatttaatatatttcctcggccaggcacagtggctcatgcctataatcccagcactttgggagactggggcagggcggattacttgaggtcaggagttcaagaccaacctgggcaacatggcaaaatcccatttctactaaaaatgcaaaaatttgccgggcgtggtggcacatgcctgtaatcccagctacttgggaggctgatgaggcaggagaatcacttgaacctgggaggtggagtttgcagtgagctgtgatcacaccactgcactcccagcctgagtgacagggcaagagcctgtctgaaaataataataataataataataataataataataataataataataataataatagtaaataatatatttcctccctggtcttgacttcatttgcagtgacagattctcatgacttcctggattgttgagactttcccatgtgaaccatagttcattgcttctcacaacagcagacagctcttggtgctccacagtgctgtaggggcgctgtgacacatgccgaagagcctctctcttctggaccaaggtactcaggccaggcatgatggttcacacctacaatcaaaaggcaggcggattgcttgagcccagcagttcaagaccagcctgggcaacatagtgagatcccatctctacaataagtcaattaaaaaaaaaaaagccaagcatggtgatatgtgcctgtaagtccacctactcaggaggctgaggtgggaggattcccgaagcccaggaggtcgaggctgcagtgagctgtaatggtgccattgcacttcaacctgggcaacagggtaagaccctgtccaaaaaaaaaaaacaaaaaaaaacgcacttcttgctcctgctggtggattgttgcctgttgacagctcacagccaagttcctccctaagtattgagatgactgcagggtgctgccctgcctgggatgatgcacttcccaattatgtccctcctcccttgacttttcagtgtgggacacgaagcttcagcaaccctgcctgattcaggacatctctgcagggcagctgtgcgtcagagctccccgaggaactggctgaggcatctgttggaattgcatcatttttcagtgtctcctctgatcagtctgcttccctcactccctgtacccaaatctccatttcagagcttgctgccagggatggggcctatgacaagtgtctccatgagggtagtgatgtttctcctcctttgttatttcccagggttttgctaagttgtctggaggaggaaaaacatgggtttgttcttaatccttcctcggcttacttgatatagaatggagaagaccaggagcaactggaagctggaaacaagagcagatgagtcagaagtttggagacaggcaccaaaaagtccatccagcgtccagggaatagttgagagttaaacaccaagaagagtcaagccaagcctggatgagtcaggtcatgcctataatccctgcactttgggaggccatggtgggaagattgcatgaacccaggagtttgagaccagtgtgggcaacatagtgagaccccatctctataaaagaattaaaaataaaaattagctgggtgtggtagtgcatacctgcagtctcagctactcaggaggctgagacgggaagcagaatattacagaattatagtagtattaaaaataatggcaaaacccacagttacttttgcaccaacctaatagtagtgataacagggtcaggaagtgagagaagccagaaccatatgacatcctggtccaggtactggcctagttgtgaaattgccccacatataggtggccagccatcaagatcccagttttggagccgggcatggtagctcacacctataattccagtgattcaggaggctggggcaggaggatcacttgaggccaggagtttgagaccagcctagacaacatagcaagagaccctgtctgtataacaagtttaaaaattaactgggcgtggtggtgcatgatggtagtcccagctactcgggagaccaaggcggaaggatcgcttgagtccagattccaagctgcagtgagctatgattttgtcactacactccagcctgggcaacagagcaagaccctatctcttaaaaaaaaaaaaaaaaaaaacagccaaggtaagaggcaagccttagacagtgcgcccaagaaccaatgagataaggagcccagggatagacttggtggagattatgggatgtctgggcaggcaagctaatgagggctcatagcagagagcaaggcccagcatcccatctgcctggagtacagcgtagtccttccagtctttgctgtggggaattgtcaaggaacttcctggacaaaaatcaccttctgcacagtgagcagaatgggaccccgttgctcattagaaacacaacctggagtggagtttcttaaatgggaatggcatcaggattgtctggagggcttctaacacaatcccagctccacccccagatattcccactgggcaagccaggacttgcccttcttttttttttttttttttttttggagacagagttttactgtattgcccaagctggagtgcagtggcaggatcttggctcactgcaacctctgcctcctaggttcaagcaattctcttgcctcagcctgtgagtagcttgggactacaggcgagcaccaccacaccccgctaatttttttgtatttttagtagagacggggtttcactatgttggccaggctggtctcgaattcctggcctcaagtgatccacctgcctcaacctcccaaagtgctgggattacaggcatgagccaccgcgcccagccaggtttccttttttttttttttttttttttttgagacagtcttgctttgttgcccaggccagagtgtagtggtaagaccttagctcactgcagtctctgcctcccagattcaagcgattctcctgcctcagcctcccaagtacctgggactacaggcgagcaccaccacacctcgcaaatttttgtatttttaggagagacagggtttcactatgttggtcaggctggtcttgaactcctggcctcaagtgatctgcctgcctcgacctcccaaagtgttgggattacaggcatgagccactgcacccaaccaggtttgtctcataatcaaattctcaagtagtgcagatactgtggctctaggggccacactctaagaaccttcagatgggtcagccggacacctacacctgactatcgtcttaaaatgcttcattcacacccagctcttataggggaggacagatttaggcctggaaacctgagagaagatcaggagattcagacacaacacaaattgataatgatcaacaggctttggcctcagctatttgccatggtaagtgacttaactgttctgagcctgtgtcttcatctgtaaaaagaggataagaaagctatcacataggattgttgtaaggattggataagagatcaagtgtggaaggtgttagctgatgtgagactgttgtgctgaacccctattaacctcagaagggagagccccaggctcaagagcctgaaggagagacccagcaccagccaacgagacatgggattttactagaggcttacatacaggggagagagtccattggcggcgggctgggcaggaaaactgcaaccgcctgcaaacatcatgtagcttatacagcattttcacttaacacccttccctcaatgacctccacctgacaacgttcatttaaccccaaattcagggcctcaatctcctgtatggctgggggctcagatgttcatcatagataaggaatgaatctctgcattggccacgctgtgtaatcccagcactttgggaggccaaggcgggaggatcttttgagactaggagtccaagaccagcctgtgcaacatggtgagactccatctctactactgcaatcccagcactttgggaggccgaggcgggcagatcacgaggtcaggagtttgagaccagcctggccaacatggtgaaatgccatctctactaaaaatacaaaaaaatttagctgggcgtggtggcggcacctgtaatcccagctactcggaggctgaggcaggagaatcatttgaacctgggaggcagaggttgcagtgagctgagattgagccattgcactctagcctgggtgatagggcgagactctgtctcaaaaaaaaaaaaaagaagcatgatctggaacagtactcatggcctggtgatctctgtgcctgttttcgtctctttcttcaccccggctctgaacatagattcaggtgcatctgccatacagggtcattcttagggtatgctcaagttattcctatcaggggcatttagcctacagagacccccttaagtgtttgttgtgcatggtggggacacacacaggcagtggggaacagctctagcaagtgaggccagactagttggtgttctctgggcaagggcactttgggaggctgaggcagaagggtcccttgaggcctgggcaacatagccagatgccatctctacaaaatataaacaaattagccaggcaaggtggcatgtgcctatactcacagtacttcgggaggctgaggcaggagaatcccttgaggccaggagtttgagaccagcctgggcaatacagcaagcccccatctctacaaaatataaacaaattagccaggcaaggtggcatgtgcctgtactcccagtactttggaaggctgaggcaggaggatctcttgagcccaggagttcgaggcagcagtgagctatgatcgcaccactgcactccagcctaggtagcagaccctgtctctttaaaaaaaggaaaaatgactgggcgtggtggctcatgcctgtaatcccagcactttgggaggccgaggcaggcggatcacctgaggttgggaattcgagaccagcctgaccaatatggagaaacccccgtctctactaaaaatacaaaattagccgggtagggtggcacatgcccgtaatcccagctactagggaggctgaggcaggagaatcacttgaacccaggaggcagaggttgcagtgagccgagattgtaccattgcactccagcctgggcaacaagagcgaaaatccgtctcagaaaaaaacaaaaaaaagaaaagaaaaacacaacattttgcccttctggtgctctgggttctgtctcctgctcatgctccctgggtcttcatggcactattgagtagctggcagtgacggggtaggagtggtggtaccagcagccttcattttttcctagacaggaatgtaagaagcaggcacgacgccttctctccaacagttgcattttacagcttatgatttatagcgaggtccatcatggcagggaagcacacaccattatttatgtgtttgtaccctgccttgttccaaggaagatttaaggcagctgcagaccccggtaaattaatccactatctgtgcagtggagagaggcagggttcccatatcagcccggataggttagcttgctgaagtggccttagcggcagactccagtccatcctgatgcaatcagaagagaatttggatctaaaccagctgttctcaaacttaagtgagcattggagtgacctggggaacttgttcagcacagattggtcagtttctgattccctaggtcaggagcaggcctgagaatctgcatttctagcaagtaccaggtggtgctgatgctgctggcctgggagtctcactttgagatgcactgtcctacggaaattcatgctgtgattgtccttctggaagcgtgaacttgggccaggctcagtggctcacacctgtaatcccagcactttggaggccaaggtgggaggatcgcttgagcccaggaattcaagaccagcctgggtaacatggcgagagtccatctcaaataaaataggctgggcacagtggttcacacctgtaatcccagcactttgggaggccaaggtgggcagatcatgaggtcaggagatcgagaccatcctggccaacatggtgaaaccccgtctctactaaaaatacaaaattagtcgggcgtggtggcacatgcctgtaatcccagctactcgggaggctgagataggagaatcacttgaaccagggagtcggaggttgcagtgagccgagatcacgccactgccctccagcctggagacagagcaagactccgtctcaaaataaataaataaattaattaaattaaatatgaataaaatggaggcatgatttggaatagtgttcatgtgttcatgcccagtgatctctgtgcctgttttaggttctctcttcacccctagagctgctaggagcctctcacttacacccaccttcctgagatgcatcctgtgctagaatgtgccagacttggcacccatggaaatgctcttttctttggctgtcactctcatggtcttgcaaggagccactatcctcattcaaccataatctaactaaggcatctaatgggtggctttccctggtggaggagaagagagaagcttaggtggcaggtggacttgagttcaaaagtaaattggccaaagtactcatgtgaaagtgagcacgtcactccagttctctcagtttattaatctgtcaaatggagacagtacactttcgtagaaccgttgtgagaatgcagttggacaatagagtgtttgacgtatcgctgttctccatcattattcccttttcctttcgaaatacattctcatggatccttgtcttgaaggagtgacctggatggagagtttgggggtggattatgatggaccagagaagtagctgtggaagatttgggggccaggggatccgctatttagcattctttaattcacatgctatgaatggtccctctcagcccttagatttctacttgtattcaaataaattgcacagctaaaataaagaactattttagtcaaaatggtcagttttcagaataaatagttttgatgtatgctacagctcatgcataaattcagacaggtagtagactgtcaggctggggacacagagatgaatggagcatcaccttgtctttgaagagctcacagtctaatgctcaaatccagccagtgcctttcaaggctctcctgggtttttcctccaggacagtgagtgtaggcatgggctcctctacccagcgtggttctgccaggcatctgtgatgttgccccagttatctggatgttcttgactgggccccagttcaccttcatattgaagaatcacgctccctggtaaagagaaggaaatgagttttgattggtgcctgtgttagtccattttcacactgctgacaaagacatacttaagactgggtaatttataaagaaaaagaagtttaatggactcacagttctacgtggctggagaggcctcacaatcacggtggaaggtgaaaggcacgtcttacagggcagcagacaagagagaatgggagccacatgaaagggaaaccccttatacaaccatcagatcttgtgagacttgttcactatcatgagaacagtatggggaaaccacccctatgatccaatgatctcccccagggatggtccctcccacaacatgtgagaatgatgggagcttcaattcaagatgagatttgggtagaaatgcagccagaccctatcagtgccttttcttcccttctgtcccctccacttctccatccttctcctcatcatcccatctccttgcctgtctttacctgtcctctctgaacaatgcaaatatttccatttaaatctattatatgttctctttctctctctaataaacatactttactgttgatgggattgatagatgtttcaggttacttacttgcagagaagaaggaagtctatcagcttttataaagtttttttttaagaggcagggtgtattagtccattttcacactactctaaagaaatacccgagactgggtaacttgcaaaggaaagaggtttaattgactcacagttccacttggctggggaggcctcaggaaacttatgatcatggcagaaggtgaaggggaagcaaacttgggacttctcagatggtgggaggagagacagtatgtgtgtgaaggagaaactgtcaaactcttagaaaaccatcatatcacatgaaactgtcacaagaactgcataggggaaatcaccccatgatccaatcacctcccaccaggcccctccatcaacacgtggggattatggggattataattcgataagagatttgggtggagacacagagccaagtcatatcacagggtcttgctctgtcacccaggctggagtgcagtggtgtgatcatagctcactgcagcctcaacctctgtggttcatacgatcctcctgcctcagcctcccaagtagctgggactacaggtgtgcactagcacacctggctaatttttgtattttttgtttgtttgttttgtagaaatggggcctcactgtattacccagtctggtcttgaattcctgggctcaagtaactctcctgccttggcctcccaaactattgggagtacaggtctgagctactgtgcctcacttgtcagctttgtgataaagcagagagaagctgtattagtctgttctcatactgctaataaagacatacctgagactgggcaatttataaaggaaagaggtttaattgactcagttccacgtggctggggaggcctcacaatcacggctgaaggcaaatgagcaaagtcacgtcttacatggcagcaggcaggaaagcttgtgcgggggaactcccgtttatacaaccatcagatcgcgtgagacttactcactaccacaagaacagtatggaggcaactgcccccatgattcaattgtctccacctggtacaaatcaaggtgagatttggggccaggtgcagtggctcatgcctgtaatcccatcactttgggagactgaggcaggtagatcacctgaggtcaggaatttgagaccagcctggctaacacatagtgaaaccctgtctctactaaaaaaaatacagaaactagctgggcatggtggtgcacacctgtagtcccagctacttgggaagctgaggcaggagaaatgcttgaacccaggaggcagaggctgcagtgagctgagactgtgccactgcactccagcctgggtgacagagcaagacaccatctcaaaaaaaaaagaaaagaaaaggtgaggtttgggtggggacacagccaagccatatcagaagacaagcaaagacactgtactccatattctgtgataatagcaatgacaaccatagcagttttcttttttgagcacttaatgtgtgccaggcattgtgctgctaacatctgtctatggattagtaacataattaatcaaaataacctcggtggggaggcattattattatcattatttttattttacaagtcaggcagaaagaggttaagatagcatgcccaggactagtaggcaacagagctgaatttaagtgcagggccgaggtctgatccccagtggccaggcccctaatgactgatctcctgacccggcctggaatgggagcactataccttggctcattcccagtaactggaggatgcttgatggtcacatgtagaggctgatcattcctctgcttgaattgggcatcgtaataatgcctttcctacatatcatggccactttcccttcctgtctccaattgtatagggaattgcagggtagggaagagaggactccaggagtatctgattttggtctagagactgataaaaatgggaagtccagggatcagcaggtgccaccagggcagatgtaaatgatgtccttgagaagcaaagaatattgagagtccagcctgccaaggttcgtgatgtccgctgctgcccacccctgctgttgctgatattgaatggcaaggccagaaggcatgggaacaccatctgtgggggctccagcaggaagagaaagcactgggaacccatgtgctcttttcgtcctacagatggtcgagacttagagagacaagaacagccccaatgtactattattttagttgccctgtcttagttgcacagggaagaggacttcagcagctcccaggacttgaatgtgaaggaccctgcagtggggaggccgggggatcaagggaatccccaggtggcagaaggggccagcagctgggagccaggccccagagtttgtgctggctcaaagcatcagtgggccagttggagaccgggctgtcttactctggtgggggtggggagacatctttagcatttgaggggagcatctttctagagaaacagcagggcataggacctgtttggtggacctcacgtattggtgaggtcactagccacaggttgaaccaaaggaagtcaaaatgaggacagagacccctctccgcacagacatcgtccagtgacatagaaatgatctccgccttcctttccacctgccctccttccccgaagcccaacctgaaaggagtggaggagagagaccatgagggagggtgaggaggaaggcactacagaaacagacagcaccctctttcctgtcctaagcccccagctgccctgaggaagcataagagccatgaaaacagagtgagttcagtgttctcaattgaaccggcctaaatatcaatcactgaaaatgacctgggccggatggggtggggtggggagcggggggcggagcacttacacctgtaatcctagcactttgggcggccaaggcaggaggattgctcgaggccaggagtctgagaccagcctgggcaaagtagcgagaccatgtctatacaaaaattaaaaaaaaaaaataaccaagtatgatggcatgcacctgtagtcccagctactcaggaggctgaggcaggaggatcacttgagcccaggactttgaggctgcagtgagctatgatcaagccactggtgacacagtgagaccctgaatctctctctctaaaagaagaaaatgatctgaaagttaggaaaatgatctgaaagttaggaaatttgtctagggagggagatgtgggtcctcatcctctaactgggagccaggactggatacatttgacatttgtatctgcaatgagctgaccttcttctgtgcactaatccactaatgctgccataacacacattgtgcaaactgtgtgccatagcatagattaagtggtttaaacaagaaacatttattttttcacaactctggaggccagaaatccgagatgagcatgcaagcagcgttggttctttctgaggcctctctccttggcttgtcgaaggctgtcttctctctggggcctcacagtctttcctcagtcacattctgggtgtgtctctgtccatttcctcttcttttaaggacagtgagcacaccgaattacggcccactctaataccctcattttaacttaattatctttttaaagaccctttctccaaatacaatcacattccagggtactgggggttaggatgtcaacatatgaatgtggttacaggggacaggatttagcccatgacagtccattaaatgtaagtccactgtgtgcttacatggggaagtgtgctattttcctggagcacatgctgcgtgcagcctgccaaggttcatgacgtccactgctgcccactcctgctgttgttgctgatattgaatggcaaggccagaaggcatgggaacaccatctgtgggggctccagcaggaacaggaagcactgggaacccaggtgctctttttgtcttacagatggctgaaacttagagaaacaagaacatccacaatgtactattattccatgaaaagggcagtttgcaaaaccgaaagtacagcatgattggattttaaaagaatgtttttcaaaaaagaaaaagaatatgtgtatgcacatgcgtgtgggatcatgccttttctctgtgcaagcagagaattcagacgtgaatgtccgcagtggggtagcagaggttattcctgaaggcgggaagatgggtgactaccattttaacaatttattgtatttgctacatttgctacaatgaatttgttacttttgtgatataaaagagagaaagagggctgggcacagtgtctcatacctgtaatcccagcactttggtaggctgaggtgggcggatcacttgagatcaggagttagagaccagcctgggcaacatggtgagacccccgtctctactaaaaatacaaaaattagccgggtctggcggttcacgtctgtaatcccagctgcttgggaggctgaggtaggagaatcacttgagcctggtggaggttgcagtgagctgagatcataccactccacaacagagtgagactctgtctcaaaaaaataaataaaagcaacaacgaaagagagaaagggctatgtaatattggaaagaaacaggaggtgaatgtttagcgtcatagttggagtcagtgaatggaatttggatttctgagccaggatttaaaatgtcagattcatgggtttgggagtactgaagagaatcaagtgtacaaggaggagatgaacatttgcccagagtcaagatggctggaatcagaagatctgaatatgactggggactggggagtagaggacgctttgttgtgtctgtgaagcatcacattaagagcaactgggctgcctctgaaaaccctggagaagaatgttcttgcagaagccagataactccatcaaagagatgaatagggttgaaatagatgacatttaaggtccttcctaactctgagattctgtggttttgtgaaaatgtagaagctctgagttaagctacctttgaggacatggtgacatttaatgctaaaagcatctgttgatgttttctttgaaatctgcattgtgccaactccacctgtaaggatgacctgcaggacattggaatattttgtgaatctccatagcaactctttcagcagaagtattttctttggatgatctgaagacacaggacagcgaagcatttttttttttaaatctccatacctcatgtccaagttaactgctatttaattgaatggcatttcattctcagaccgtcatccccttacctgaatgttaatattcttacctgcaacaaggcccctattggggcagggttggggagtggagtggagtcatgatttactggtattttgcatgaaccaataacatttccaaatcccatcactttgagaggctgagatgggaggatcatatcacttgaggccaggagttccagaccagcctgggcaacatagcgagacctccatgtctacaaaaagtaaaaataaaatcacatttctaatctcagatgatgttgatttgtagacattattgtaagtgggagagactcagtgtaacctgaacctagtacagtaaagtgtaggctcagatcacagtgagaggaaataccacatatagcagcattttcattaatgatacgattgttttataatgagtgctccaaagattccagggaaatgcttccttacactcagaatgtgttgcaaagaagactgttttctctggcctccatctgcctgaaatgcactcccgatttctcttcatctatacagattttacctgctcctccggagccatttctaatccacattcttcctccatcaagccaacactgactcactgatatggtttggctgtgtccccccacaaatctcatcttaaattgtagttcccatgatccctacatatcctgggagggacccagtgggagataattggatcatgggggtggttacccccatgctgctgttctcatgatagtgagttatcacgaaatctgatggttttataaggagcttttcctccttttgcttagcacttctcctgctatcctgtgaagaagaatgtgtttgcttctccttctaccatcattgtaagtttcctgaagcctctccagccatgcggagctgtgagtcaattaaacctctttcctttgtaaattacccagtctcaggcagtcctttatagcagtgtaagaatggactaatacactcgtccatcccaattgattgcttttgcctataaatttcctagagcaattattgacaattaattgcaccgccttgccctgtctcccttattacagtcttgaatgactattaatgtctattctgtatgtttgtgtcctcccatagtgtttagcgaagggctccaaaaacagcaggcactcaataaaggttctctgatttattcagaagaccactgtttgttgactgcacgatgattttgaactcagctgaggcagaccctattcgtggtcctccttgatcctccacctaccaccatcatgagtgactttggtgtctacaaagatgttccttctaacacactggtctccccaggtctcaacttcctcctctctgttggcctcctgcatttgttctcagccatccaatcttatggctacacctccagagcttgtcattacctgcaaagcagtaactcagacactcaccccctgccacttccttgcttgtcccactggctgtcctccaagcatcctttgctggcatcagaacctgcagcacattactactctttcttccagggctctttcctttcatcactttccccttatcttttagattccggggaccctcactgcagggaagatgggctctgatcaccaaccccaagtggccgttcaccatgtggccatggttaagacaattcctaccaccatagtaagagccgtagtttagccactcctccaaacccctgtcctctcttctccccctttaccatatcgatctagtttagattccagggctcatcatttcaatcattcctgtgctcaatgctcttgttccactgtctttttagtttatttatttatttttttgagacagattcttactccattacccaggctggagtgcagtggtgtgatcttagctcactgcaacttctgcctcctggattcaagcgattcccctgcctcagcctcctgagtagctgggattacacgcgctaccaccatgctcagctaatttttgtatttttagtagaggcagggttttctcatgttggccaggctggtcttgaactcctggcctcaaatgatccatcctcctcagcctcccaaagtactgggattacaggtgtgagccaccgcgcccagcctagtttaattttttgagacagggtctctttctgtcatccatgctggagtgcagtgctgtgaccatggctcactgcagcctcaaactcctggcctcaagtgatcctccagcctcagcctcccgagtagctgggactacaggcatctgccaccatgcctggctaactttaaaaaaaagatgtgtgcagatggggttttgctatgttgcccaggctggtctcaaatttctggcctcaagtgatcctccggccataaccttccaaagtggtgggatgagaggtgtgcaccatcatggcttccctcctctgtctttttgttgtatacaaatggcaggatctcaaccctagatgggtcttctctggccaaaacccatgtcctgagtgttgatagggactcttagtgcagggcagacaggctctgatcaacaccccaagcagccctgccctccactctggccatggttaaggaaatgtttacagtcatatagagtgtcacacagttttgctactcccccaaacatctgtccttccttctccctctttctcacaacaaatggctgcatcttccattgcacagaggaagcaggagccatctctcaggaatctgcttgtcctcagggtggcaaagacaaacttaaagattaccatcctccccttcttccctcccatttcactagagaagccctgtctcctcctaagcccgacccttcagctgcactcagattccattccatgtctttgtagttttgcactgtttatggataatcccttaactctcctgtttattcaacctttccctctcaaatgaatctctcccactggcctttcaacatacgcaggctcttgcattaaaatcaaagcaaaaagaagcaaattaatttcatatttgccagcatctactctcttgccccttatgaccaatcttcacaacctgtgctgtgtctattcctcaccacccattgatttttgcagcaaattcttttccaaagttaatcacattagtatatcccatctttcacagtcttgttacgtgtgatgttgacactttctccactgagagatggggtcacattcatcggaattgggagaatctttgttatctcagccaatggaatatggtggaatgaggtggttgctgcctgaccttctgggtttaggtcatcctttaacatctgtcagatatgtccttcttcacatgatggcaggaaggagaagcactgagcaatacggtgtgtgtatgtctctctctccctccatgcatcttgggagccttgagccaacatgtatgaaggatggcttcctcaaagccaccatgctgggaagaccatgtgaacaggaactatagacacagaaaatgatgcccaaggagctcctggtgtttcaccctcactgtttcaatcttcccagtgtcaaccacggatgtgaagaataccttagatgatgccagcacccagccttggagtcacccatctcagactgagtagaacagagacaaccatccttactgagcttgacccccaattgtagatttgtgaacaaatatattgttttcataaactaagtttacaataatgtgttccacagcatgaagttgccgaaacagcctctgacttcaccccaggatatcagtttgccccatcaagtgcttgagatggctcttaataggcacaccgtgttactaagtcagacattgttgaaatgtctgctttcttggtcattagccccctgcactgttgatcacccaccctgaaatactgattccttggtatccactgtattaccctcatctggactttttcagcattcttcttacttgttgggctacttttttccccatgattctgtccacagctattaaatgctgaaatccttcaagactcacacctagacttccttgtcttctcactccaagctttctccctaggcaattccctacacgatcacatgtcaatgatcacttctatgcatgagtcataatttacatcacttttctgagccagggtctcgctctgtcacccaggctggagtgcagtggcgtgatctcagctcactgcaacctctgcctcccaggttcaagctattctcctgcctcagcctcccgagtagctgggactacaggcacacaccaccatgcctaatttttgtatttttagtagagacagggctttgacatgttgaccaggctggtcttgaactactgacctcaagcgatctgcccaccccggcctcccaaagtgctagaattacaggcatgaaccagtgtgcctggcctatatcacttttctgagctcctgacccatagatccagtttcctactgggaattatctcttgggaatgtcaaaggtacctgaaattcaatgtagccaagatttcagtactgtattcctctttctacctggtctgccttgcaggttcatgagagtgtgttattgtccaggggtaattctacccagtgttttagtgagacagatgatgttcctgccttcctggagcttttattctaggtacttagaacagatagtcaaaatacataaatacgttaataagggctgggcaccgtggctcacgcttgtaatcccagcactttgagaggctgaggcgggcagatcacgaggtcaggagtttgagaccagcctggccaatacagtgaaaccccgtctctactaaaaatacaaaaaatggccaggcgcggtggctcacgcctataatcccagcactttgggaggccgaggcgggcggatcatgaggttaggagattgagcccatcctggctaacacagtaaaaccccatctctaccaaaaatacaaaaaattatccgggcatggtggcgggaacctgtagtcccagctactcgggaggctgaggcaggagaatggtgtgaacccaggaggcggagctgcagtgagccgagattgtgccactgcactccagcctgggtgacagagcgagactccatctcaaaaaaaaaaaaaaaaattagctgggcttggtggcagacgtctgtaatcccagctactctcgggaggctgaggcaggagaattgcttgaacctgggttgcggaggttgcagtgagccgagatcgtaccgctgcaccctgggcgacagagctagactccgtctcaataaataaataaataaataaataaataagtgaactaaaagagggtgacaaacagcagacagtgaattagacaaaggtaatttgtcaaatttgctgtctgctatttatcactctcttttggtttacttatttacatattttacatagtttacttgcatattttaattagtttacttatttacatattttgcagtttatttacatttttttacctagtttacttatttacatattttgcatagtttacttatttacatagtttacttatttacctagtttacttatttacatattttacttatttacaaattacctttgtcaaatttgctgtctggtatttttcagtctttcagtttacttattgggcctggcatggattcagggcagtgtcagaaaataccctgaattctgccctctctctgtggcccgtcacctctcaatgctacgtcctgaatagctctcagatctctctatgcacctctgctgcagctacccgaggtcataccattgtcatctctcccctgggtctctctgctgtagcctttgaactggtttgctttcatcccctcctgacattctccagcatatatcccacactgcaatcttagggcaagttggatcacaccccacacgctgttgtgtgcatacactgcatcatgtagtggcccctccttgctttataggattaaaagtctgatctcttacttgacccacagaacccagtgtgctctggtcttttctttctctttatccccaatttgaacagtttcgcttctcttccacctcgtggccttcctcctcttcttcctgccacatcttccccaggccacaggacctttgcacgtgctagtcccactgttggcatctcatatcttccctctcctgccagtgaattacttctcatccctcagaagtcagctctcctggggccaggcacagtggctcacacctgtaattctaataccttgggtggctaaggtgggaggatcacttgaggccaagagttcaagaccagcctgagcaacatagtgagaccccatctctacaaaaaaatataaacattagccatatggggtggcacatacttgttgtcccagctacttacgaggctgaagtgggaggattgcttgagcctgggagttcagggctgcagtgagccatgatcttgccactgctctccagcctgggtgacagcgtgagattctgtctcagaaaaagaagtcagctctcctggagaacctcctcggcattcctgaagaggtcccattaccccattatgtgctcttggaaggccatgtgcttctcctgccatgtccagcttcagtgattctgctgttaactatgtgaatatttgagtatattttccccttcaacacaagcccttggcaggctctttataagtgcctcccctcagagaacttatttaaaaaggtgagaacagaaagagaagtaattacttctgcttttggggcaccaagcatttagctctctgattgtccagcccaacatttctcttagctccataataagcttcatatacacttgagattcagaagccacaggccccattgtgttgatctctctttctctgcctcttggctacagcaaaaccaagactcaaaaccaagggagaagtatttctttgatacacaagtttctttcctttggataaatacctagtagtagtggcattggtgggtggtatggtagttctgaccattacaccttctatgcatgtaacaaaatatcactaggactccatatgtatttgcaaatattatgtatccataaaaaataaaattggaattcacagttctaaaatcaaacaggaggacactagctggggcatagaaggaatttttattttattttattttattttatttatttattttgagatggagtcttgctctgtcgcccaggctggagtgcagtggtgcaatcttggctcactgcagcctccgccttctgggttcaagagattctcctgcctcagcctcccgagtagctgggattacaggcacctgcccccacgccagtctaatttttgtatttttagtagagactgggtttcaccatattggccaggctggtctcaaacacctaacctcaggtgatctgcccacctcggcctcccaaagtgctgggattacaggcgtgagctaccctacctggacttaggaatattaattttttacatataattttatgttttaattaacaaataataattgtatatatgtatggggtacatagagatgtttcaatacatgcaatatgtagtaatcaaatcagggtagttagcgtgtctatcatctcaaacatttgtcatttctttgtgttgtactggtacatgcaatattttccttccagctatttgagactatatattattgttccctgtagtcatcttccagtgctatagaacactagaacttattcttcccatctgttaggttggtggcaaagtaattgccattgaaagtaatggcaaaaccgcagttacttttgcagcaacctaatagttgtaatttcaaaggaaggatttttaaaagcacattcaggccaggtgcagaggctcacgcctataatcccagcgttttgggaggctgaggtgggacgatcgcttgaggccaggagttccaggccagcctggacaacatagtgagaccccatatttacaaaacaactaaaaattagctgggcatagtggtgcacacctgtactcccagttacttggaagctgaggcaagaggatcactggagcccaggaggtcgaggctgcagtgagccatgattacaccacagcactccagccaggatgacaagagtaaaaccctgtctctaaataaataaataagtaaataaaataaaaggcacattcaacgcaccaaaaagtctactgttaagccttcagcctgcttcatccctcccttgtcttgacatacagttttgagcctgaagttatttggcaatttatttttttatatacaatgaaaattaaattcagctaaaatgaggaaaacacttggtatgtatctatacaatctaggtgatttctgatttctggagaaaaccttgtcacaggtccagaataattaggagatagttctgctggaacagctgcctggcagtcagcactcaccctgggtccgcctttgaccccttgagtttgaatttttttggccagccttggcacactaagaaaattaaacctgcctgtgtctatagacgccactgggccctgagccaatgcgttggttaatcttcgagccgtgtccctttaatgcagcatgaatttgcatcttctgattacctgtttattacctgtcaggtaaaagagtgatctagaacactgcacacttgcccagagttgggaaggaactgggaggtgtttgcatgcaggatgaagaaggaagctcctctctcaaatgataagcctaattgttttaagcaggaggatttcaagttccccacgcctcagatcagcatgcagctcacaggctttgttaagcttgtgtgacagaataatctcctttgttcaatgcccgaggaggatattttctgcattattagacaagtcaatgaagataaaacaaaatattaagtattttaagctgcgccagtccaccccgaagaaattaagccccctcattctaattgtgcctagtttccttgccgtaatgagatggaggctgagctgctggaatgaggggcttcctgcaggcctgcatgccccccagtcattggagtgaacctctcctttcctctgcttagtttctttccctgggggaatttttagagccagagacctggtctccaggcgaggcaagaaataaacgcaacctccaccgtaagcgtgtgacattgatcagcatatttttaaaaaggtttccatgtctgttgcaattacgtgaaaccagctaatcctggatctaagctttggcagcttggaaatattagagcaatttggcatccagattccatcatgcaaagatttgtggtcttgtgtttgtatctgtgacactgtataatttccaattggcttttaagagacagaaacctggatgccgttggctaaacagtgagagcatttgcctgcctttctgcctccttggaagctagagcagtcattaaaaactagagaagtgagcacacgcagcaccccccggcccatgggtggttagcagactctcggggtgttactggagctgctatcattgtgggtgtaggagatgattgcaggtcctcgccggcaccagctctgaggaacccaggtgctccaagtccccagccttcatgcccgggctgtgggggccaaagggaccctggagggcgttttactatctccctgcttcacttccctccagaaaactgtgttccttccccagtgacagacttcacacccaggagctccctggttgtggggccgctggttttgcagtttgcttagagtcttttgccaggttctggagcttcagaagttcccaggaaggtaccctggacacgttcttgtgcgtgcgctcgtgtgcatgtgtctgtgtgtgtatgcgtgtgcatgcccgttcccgtgtgtctgcgtacatacagcctctcacctgctttctcttccagccactccaccataaaaacagtttccgacttaaaaattgtttgccttacgatggttcgacttaacgattttcccactttgcaagggtgtgaaagcaatacacattcagtagaatccgtacttcgagtacccatccaaccatttctgtttttcgctttcaatacagtattcaataaattacatgagatatgcaacactttattataaaatagtctgtgttagatgattttccccgacagccggctaatgtaagtgttctgagcacatgtaatatagcctaggctaagctgtgatattctggagattaagtacaggaagtgcattttccacttaggtgttccaagtccccacccttcagcttaggatgggtgtatggggatgtaaccccaagcataagtggaggagtgtctgtatactcaagctaacccctatctctgttaatacttgtgctcagccccattctgggtatttataatttgctatctcatttaatcctcacaagtatgttgaccaagtgggtataattatctctgttgtgtagctagggaaacacttggctttcctgagccttaaacttgcccgtagtcacatagctcataagtttgtcacaggagctaggattcaaactagagcctgtatcttttttgggatgctcccaaagagcctgaggctaggatctgggcatgcaattcctttgggagctgatcccagaaagcactgtcaggggaagggaggcaggacatgggaacagagagatggaggcttaattgggtcactgctatgggcagctggggttcaacctgccggagatccccagagaaacgggatgcagcatccttcaacactgccccaagagagaagaggacactgggggtcttttgtttttcttaattagctttattgagatataatgtacatgacatgcaattctccatttaaagtgtacaattttttttttctttagacaggttctctgtctctcattcaacctggagtacagtggtgcaatcatagctcactgcagccttgaactcctgggctcaagcaatcctcctgccttggtctcccgagtagctggggctacaggtgtgcaccactgcgcctggctaatgttttttaatattttgtagagatggggccttgctctattgcccaggctggtctcaaactcctggcctcaagtgatcctcccactttggcctcccaaagtgttgggattacaggcatgagccactgcacctggcccctgaaatgtaaaatgtaatggcttttagaatattcacagaattgtgtgtccatcaacacaatccattttagaccattttcattacctcagaaagagaccccatacttcttagctatcatctctcagcccctccatccctcccagccctagacaatcactaatgtactgcctgtctgtagatttgctgaggtttttgtccacccaaattttgtcctccatcagttgggtcatgcctgggtgctaatttcctgccacttccaacttgcctcagagtgcagactcataggccaaggtcataatcgctgggagaacacggaatccacccagatcaaaaggccctggaagccaagggcttcagcaggtgtagggagacctcagggatgcaggccaggtcctgacagtgtctccttaccaggcttcctctccattcttctcattcaggggtctcttttgcatccttctctttaaattgtgccttttattcttaagctccagggaggctgttatgaaaagcctgtcctcatgatgttcattctattgattgcatcctcttcccaggtaggaagggaatgttggtttggagaagaaggtcagggtatgcctgtctgaactgagacctgcaagatgaggttggaccagccgaggctggatgcagtgcctcacacctgtaatcctagtactttgggaggccgaggcagaaggatcccttgaagccaggagttccagatcagcctgggcaacatagtaagaccccatcttcacaaataataataataatgatagaattagccaggcatggtggtgcacacctgtagtcccagctactcaggaggctgaggcaggaggatcacttgatcccgggaggtcaaggctgccgtgagccatgatcatgcaccatactccagcctgggtgacagaggaagaccctgtctctaaaaaagagagagagatggacccagcttagcaggacagggccgagcatctcaagcagtgggttcgaatgcacagacaaggaagtgggaatgggcttggatttggcaaggatcagataggaaaccagggtgcctggagtgtgggtaataggggttgaggggcagaatgaggttaggggagagcgtgagagcagcagatcctgcaagcaaccctcgtggccctaggcaattttattgcaacagcaatgggaagccttttgaagactttcacgcagtggcacagcctgatctgatttcctgttgagacctagttcatttgcctaggacttcatccctttagcaatggattcctgcaaggcttctccagccccatgtggcccttgtccagccattaaactccagtcctaggacatgggccctgtcactagcacccctgctagcctaagtatcactttatgcaaattaggcaaaagtaccctttttgaagaccctttcctgccatctactggaaaaccatcatcattaataaataagtctaccatagtgccccctatagttgggcagtgcacaacctccacaaccttaggtggcagtcctgcatatcacccacaacagacatctctgatgctgttgcttggattgcccaggggtcccttctcttgtcatatttcccagagttgtgcttctgctagacatttctggtagtcactgccatgtaccacagtactcttaggacacatgtcccatctgccaggatcaaaaggaatttttccttctatctgcagttaagtctcaacactaaccctatgtcaatgtactaatttgggttccagcctttttttttttttttttgagacagagtttcactcttgttaacccaggctgatgtactgactcactgcaacatcctcctcccaggtgtaagcgattctcccgcctcagcctcccaagtagcagggactacaggtgtgtgccaccatgcctcctagctaattttgtatttttagtagagacagggtttcaccttgttacgcaggctggtctcaaactcctgacctcaagtgatccgcccgcctcactcctcccaaagtgctgggattataagtatgagccactgtgcccggccctgggttgcagccttctgacatcatggaagttccccttctttgctctctgtgtcgtgacacgtgacagtgagaggtagcccagggtagctgttcttctgtctgggtggacatgccctgacttccagctccttaggaaagcctagctgtctctgactcataaaagacctccaagtcgtccaccagccttctgggaagatgttctttgaaaaaccgcttcagtcagcttgggccatgagcagaaatgttcaagacggcaacgttgcttctcagctctttctgtttctctgctctgatgccccttcagagatgaacgtgagagaccattgaggctggagctatttttcagggctctctggtccaccccctgggaagtggcccactttggctgtgccccagttattctggtaatgaactgtgcccaggtactgccctaggcattgttccctctctctgttctgacaaccaggcacaaacttgtctccttgtatgcaaggggaaggcagtggtggagtggggagaatgaggagaatcaggcctgaggcccaggtcggctgtcaagggaaacatttcatgattgtcaaatgggccaagattcctttagctccaacctggcctcctcttttttgagcactgaaatttctcaaaatggcaaatggaaactgaaacactacattaaatagcatttctgtgcaattaaaacacattaaaatggcaattaagtttcacaaacagccttttctgtgttctcgggttgattaagctgtttgtgttgtttttcagggatggttgttgtaactaaaggctgagctgtcttttatggattgggccgttccctaggagtcaaggaaccctgaattccaacttttattcctctcttggcaatttcactttattttcatttgcagctctttattagtctgtgagaacagactaatacaccactccacgattggaaaatttacacatatacaaaagtagagagaaaaatataacaaacttccctgcacccatcacccagcttgaacgattatcaactcatggccaatcttcccttggtgtttttttttgtttttttgtttttttgttttttggtttttgagactgagtcctgctgtgtcgcccaggctggagtgcagtggcaccatcttggctcactgcaacctccgcctccccagttcaagcgattctcctgcctcagcctcccgagtagctgtgactacaggcatgctccaccatgcctggctaagttttgtattttgagtagagacagagtttcaccatgttggccaggctcgtctctaactcctggcctcaagtgattcgcccacttcggcctcccaaagtgctgagtctacaggtgtgagccactgctcccggccccttggctatttttttttttaatcctttaaggtactagttaacttttcctaggagaaaaagtatgtaggaaaatttagtaagagaaattgacatggaagaaaggctttctgtatcctgggactgtgggttcaatgataattgagacaaatggcactgctgctctgtagagtgtaaggtctggttgggaaaacagatgagtcaattacaggaattcacagtggagagctgggcatggtggcttatgccggtcatcccagcactttgcagggccgaggcaggaggatcatttgagaccaggagtttgagaccagcctgggcaatacagcaagactgtctctacaaaagcaaaatttaaaaatttagccgggcatggtggcatgtatctgtagtcctagcaattcaggaggctgaagcaggaggattgcttgagcccaggaggtcaaggatgcagtgagctatgatcatgctaccacactccagcctaggtgatagagcaagaccctatctcaaaaagcaacaccaccaacaaaaaactgcatgatggggtaggtgatatgactctaagaggcattatgggagcacactggcgcagctgggaacgatcaaggatggcactgtggtctaacctgacccaaagaggtagacgctagccaggtgaaaggtaaggtacccttaccaggtgaaaggtaaatgaaccctattgagctcataaacagtggggggtggagggccctttttgggacctggggtactgctgtccccagtgccttccttgagatgtaggcactgagtcctgatggatctactattgtaaatctctaccatctgtctttcttttctccagcccatcctcatccaatacccatctcatcatccatctcttttggtaaaaatctcctaacgggccccaggacctccatgcctgtctagcctgtcactggaaatctagtttgtctttctgaaatgtgttctaatcttaattccttgctcagcctgactctgtctctaatggcttcatttctctaaggtatacattcaaacttcttggtttgcagttgccaaaattactgtcttgctttgatcagtttcagttgggcagtgaatcatccctcaccagagcctgaccacctgatatggtttggctgtgtccccacccaaatctcatcttgaattgtagctcccgtaattcccacgtgttgtgggagggacctggtgggagataattcaatcatggaggcagtttctcccatactgttcttgtgatagtgcataaatctcacgagatctgatggttttataaggggtttcccttttcgcttggctttcattctctcttgcctcctgccatgtaagatgtgcctttgctcctccttcaccttttgctgtgattgtgaggctaccccagccatgtggaactgtgagtccgttaaacctctttttctttataaattacccagttttaggtatgtccttatagcagtgttagaacagactaatacaccactccatgattggttcacaaaggatacaaagagagagaaatgccttaggagctggggagaggctcgggttggcattgcatttctgggactacacatctccctcaaccctgagtccactggactgtgcgtctgccaggagattcctgctagtggaatgcagctggaaggggatggaggggacagtcctgtgtctacattactagtcttgtactgaagcttcttaattatgtaacaagctacatcacctaagtttctctctgtcttttactttctcctgagtgggctttgtggtcaagaaaggacttcatcagacgcagtgatagtgtctttcgaggttgggcttctaaggagcactccctgaggttctgattagaccctggatagcacccgcactccctactcatggatacaggccctctttaaattggctcatctttctttaaatctctgttcctttccccatggggagaggagaattatcaccttcctcattcagataattgaggaatttagtacttgcttatgtaaaccaaaaagtatctgagacaggtctcaatcaatttagaggtttattttgccaagggtgaggatgcgcccagataaaaagagacaaaaattacagtaggatctgggacctgtgttttttccaaagagggttttgaggacttcaatatttgaaggggaaagagcggcagggtgggaaggaggaaagagaaagaaagggaaggtaggtagtgagataagtagtcactttctcgtgaggctttcattagcactcactggatccacgtgttgcatatcaaaggagggaggggatagaggagcagccgattatgcatttatcttgcaatcggtcaactgcattttgcataagatgaacatatggtagaggaagaagtgagatacgcattggactcttggtggacagagggatgatttctagttttgtctttctccagaatctgtaaaggtaggattttaatttatgttgtcagggtgaaggaggccatttggggagataagtaacctatcttgcagctttccatttaggaaaaaaaaagggaggcagtttttgcatgattcactttccaagcttaactttcccctttggcatagtgagaatgtattttcctttcccgctcagaatctaccatgattagtagcagacaaagattaggacttgagtcacactttttcggaggagtgatggagcagcccttggtacgtgatgatgggatcagcagtagaaccccttaattccagaactggagtggaggagttgattgcagtacacctggacatctaagggatagagaaatagcccttcttctatgctttctctcctgtctcctgggtagcttgctgtagatcttagggtctacttcagaatgcaggaggggtgcaggtatacatcttgtgctctgcaggtgtatagggttccttgaagaaaataggaacttgcaggggtgatttgagtgacttgagatcagcccaagggctgggcaggtgcttttcttccagagcagctctgcctaccaagcctgtgccatggatgctctccatttctccccattctgcccatgctccctgtcacctggagcagcatctctgctctaactcaagatttctacctccaagataactacttttatccttcgtggctaaacttcctatgtttgacctaccaagaaaacaattacagcctcccagggtcatgcttggtttctctgcactcagagcacacaacaccctcagtggaatctcctgagccacctgggataaatgtcttcctggccaacatttatattctatttcttgtcgccattgctcagagcttgaagtcaccccaggggctcctttacagtaatgtggggatgtcaaagttctcatgtcttagcttaggcgaccgtaacaaaaataccatggactaggcagcttaaacaacagacatttatttctcacagttctgaggctgggacattcaaggtcagggcaccagcatggtcattttctgatggcgctctcttcttggtttgcagcagcataccttctggctgtgtcctcacatggtgggaagagggagggctccagtcctttcttcttcttacaggatactaatttcatcattggggccccactcacatcaccactttgaaacctaatcacctcccaaagtcctgacctgccactaccattatactgggtgttagcacttcaatataggaattttggagcacacaaacactcactccataacatctttgggagagggccagtgtttcccctgctgttttagcccaccttaccttgattttactgtgtagctttttaaaatataggaatgacagaactttggagtgtccttctagccagcattttttaaatttaatttgcaatcatatggtggttgcttttcctattagattagacatcactactatataagactccaagaaggatataggataatggagttcaagcatttaataaaaaatattcactgactgtcagctctttgccaggggctgttctaggtttagagaaattggtggtgatcaatacagggaataaccttttttccatggcacttacacactacagtagggagatagacatggaagcatctaactcccaagtaaacaaaaacagaaaacctgagcctgtgatgaaagttatgcagaaagttggatatggtgtcataagtgtgacacatggggaccactgcaggtgcaaatgacaggaacaatgagctgtggggaacaggtttgggtgacgaattcttatctcagagggagcagctcatgaaaggcccctgggggagacagcatatgtccctggtctgggaactagatgccatccagggtggctggagcaagtgagaggagaagaaaaagaggacagggccaggtcatgcattccttccttgccaggacatggaagcagcattttattcttagctcaagggagacatcttcagagggttttaagcaggagcatggcatgatctgatctaatttataaaaatagaaataccgtgtgagaatgctcatcagtaatttctacctcaggcatcttctttcttattttctactgagtctgtacatttcctgtttcccttggtttctaaagaaaacaattatcttcatatcatcatttctacttgttctttcctttgggatccaggatctaatctgaaaattgctttccccaaggaactctggatggctgatgtaccatcacttcaagccatcagtatgtgctatgctttgactgtggtgtttcttagagtcctggataaactgtgcgatttaagcaggatgccattaatcacgcaagagacacgagtccagcagcagttactaaaatcaatatggcttgagattgtgatttccagaatatctcctcacttagtgagtcactaggaaacttcagaatagccgtatagattttaaagcagctttctctaaacaggatttggatatactcccacatttctccttgggcggagggagaaaggatggatgttctgaacaacacatgttttaaaaaacccactgccaggcaagattaaaacctttgcctggaagggagtcggaagattctctgggttccagtaaatggtctcatgcctatttttcccagtctcttgcttggattaggtaaagggtttaatcagtaagaattggccaattaatttctcccttctcacattcattcattttgtaaccagacattctgccagctgtcctggaaggtagtgagaggagaaagacgtcatttcttccttccagaaagccacaggatacatcagtgtcatggttgaggattatttaggcatatttccattttccaagttaatgtgttaccctcaggcttgggtggcttcagagcagaaaagaacaggtgagaccaggtacaagtccagctggctcagggactgtgacaaggagagaagtgtgatctggaactgggctcagcagtgttccaagtaggcatgtgtaactaccagataaacacagggatgcaggattcgagaggggtagggaggagagagagcagaaaggaacagggtccattatcttatggaagtcagcagcagtattcattaattcatccaatcattcatttattgaacacttatttctatctaactgtaatctctcttcagtcctttcacctacaccacaagtatcatttcctttgccttactagttactaaattctgtacgtctgtcccttcctccaatctctgagctctactgcatttttcctttagaatttttttggttttttgagatggagtctcattctgtcacccaggctggagtgcagtggcatgatctcagctcactgcaacctccacctcccaggttcaagtgattcttgtgcctcaccctcccgagtagctgagactacaggtgtgcaccaccacgcccaggtaatttttgcatttttagtagagatgagattttaccgtattggccaggctggtctcaaactcctgacctcagatgacgcacctgcctcggcctcccaaagtgctgggattacaggtgtgagccaccgtgcccagcctagtattttaagttagacttttgtcctccctttttgtgtccagtcagtattgcacctagaaggcattcagtccattgttgttttaataattacgatcgttaatgtagctattcaataaaatgaatgaatgaagttaattcaggatatatgaaaacgtctccaataaaataataagagagaaagaaggtctaaagaaatcagcatgatatataaaaatcatgcagaaaaaccattatactgattacttactatgtgctgagcttcacagaggctctgagaaaccagcaagaggcagtcccagccctcaaagagctcacagtctatgaaggagacctccatacagatatgtaattgtaacacagtgggttagaatagcccattgtatgtatggcgtctcatgggggcctagagttggagacttctgatctttcgtgggctctccaaggatgcttcctaaataaaatgtgctagaattctatgttaaaaaggtgggctcatgcctgtaattccagcactttgggaggccgaggtgagcggatcacctgaggtcaggagtttgagactagcctggccaagatagtgaaaccttgtctctactaaaaacacaaaattagctgggtgtggtggtgcagacctgtaatcccagctactcaggaggcagaggcaggagaattgcttgaacccaggaggcggaggttgtagtgagctgagatcgcgccactgcactccagcctgggcaacagagtgagactccgtctcaaaaaaaaaagaaaaaacagaaggtggaatgagacctctgggcagagagaccagcatgggcaggcaaaggaggtaggaagctgcatggtgtgtgtggaggttggaaaacatacttccatggatgatggcaaaggcagtagatggaggggccatcctgcctggccctggaatcccggcaaactctttattctccatcagtgtggtcgttggaaagattactaggcttgaggtgggagggcagatgggtttaggaggcgggagcaagcatatggcaggaggggatggggccacgagatgcatagacccagcaaaagcactatcaggaggagagactaggagaggagggacaggagtaaccaggggctaaacttggcttgagttttattgagtggcaaatgatgtcactcccttctgattcacctgtagtagaatttgataagggatcagttcagtcttcagacactgtcagaagtgcaaagctgatctccaggtaggcgagggaggagaatgaaagctgcccatggaagatgccatgtgggtcctgggagccacagaaaattctggatgtgtgtgccatgtattttcattgaacacgtgtgtgcacatgcacatatgtttggtattggatgctgcaattccagcttggcatgtacacttctttgtagctcagaagggctaaggcatggatgctcagatagatcccaaatctttttttttttttccccaaatcaggttctagggctgtgtgctggtgagttaggccaagaccaggcttagcacatctgtccccaggtggacacagcagccaggtctgcccaatctaaaggccaccttacctttgaccacctcctttcccagcaggaagacgccctttccttcatctaccattcgtgtccatctgtcctggactacaaaagatttgcagaacctgcctggagacacgtctttgtattaactattgcaattcacaccttctctgttgaagggcttggagcctccttgtgctaatgtggcagcctttctgcctcctgtgggtaaggactgcagtgaaatcagatcaccgtgactgaacgcagttctgagccagctgtcgacttacactgctcagttctgttttttcttcctggccttctcacgcccaggccctgagcccagtggatttcaccatgctgggttgctcataaaaaatggtttcttcctgatgcttttggtggcagactgaatatcatcaatcatgctgcaagaaggaaacacagattcccagctgatggcattgtcatgtttatgacacatccgaaacagtaacagatggtctgtattaaaagtgtaactggtgagtgagtgctttcataatcatagagatattttttattcccctaaagttttggttctagaaggagtcacagaacgttagatcataagggcccctggaaagcttcttgtccacatgtctcatttttacaaacaaaaatatcaaagtacagtgagattaagggatttgccaaggtcattgagctaattagcgatgagaccgagaacaaaacccaggcccctaatgttccatctaatgctctttgtgcaatactgtggagcctgcggatccacactttgtcttctcttggagaagaaaacagaccgtgctggaaacgcacagggcttctgtgagttccttggcatggtgtcaatgttggatgcagagagtcctcaaaccctcttgagcatggttggcccttcctgagaaggtgcagaaaatgcaggtttttattctcagggcttctgttggtgtggacagactgtattagttcattttaatgctactgataaagacataccgaagactggacaatttacaaaagaaataggtttaattggacttaaagttccatgtggctggggaagcctcacaatcatggtggaagtcaaggaggagcaagtcacgttttacatggatggcagcaggcaaagagagaatgaatgccatgcaaaacaggtttccccttatcaaaccatcagatcttgtgagacttattcactaccatgagaacagtatgggaaagaccctcccccataattcagtcatctcccactgggtccctcccataacatgtgggaattatgggagctacaagatgagatttgggtggggacatagagccaaaccgcatcacagaccacatccaccagcgctgcaatgcaaggcttggttttcaagccagtgaggtggcaacagaaactggatctcttatctgatggaatccagtttcacctgggttcatttcttgattgatctgaggatgttcggatcagtaggaataaaccaactagccaatggttctcaaaatatgcttcctgaaccacagcagaagcatcccctgggaacttcttagaaatgcagattcttagttgggtgcaggagctcatggctgccatcccaggatgtcgggaggtggagacaggaggatcactagagcccaggagttcaagaccatcctgggcaatgtagcgagacctcgtctctatggtacataaaaagctaaaacttagccaaactggtggcacacacctgtagtcccacacaattctgtgaacattctaaaagccattaaattttacattttaggagccaggtgcagtggctcatgcgtgtaatcccaacactttgggaggccaaggtgggagaatagttgaggccaagaatttgagaccagcctgggcaacatagcaagaccccatctctacaaaataatttttaaaaatttagtcaggcgtggtggcgcacgcctgtggccccagctactcaggaagctgaggtgggagaattgcttgagcccaggaggcagaggctgtggtgagctgagactgtgccactgcactccagcatgggtgacagagcgagaccctgtctcaaaaaagagaaaagaacagagaaagaaatgcagattcttggccaggcacagtgagtgggctcatgcctgaaatcccagctgtttgggaggctgaggcaggcagataacttgaggccaggagtttgagatcagcctggacatgataacaagatcacgtctccacaaaaactttaaaaattagtggggtgcggtggcccccactatttgagaagctgaaggaggaggatctcttgaactcaggagttcaagcctgcagagagctatgattgtgccactgcaatccagccttggcaacagagcaagaccctgtctcaaaaaataaataaataaataaataaataaataaataaataaataataaagaaaagaaagaaatacacatcctcagcccccagattaagaaactctgggctgggtgctgtggctcatgcctgtaatcccagcactttggaaggccgaggtgggcagatcacgaggtcaggagatcgagaccatcctggccaacatggtgaaaccccatctctactaaaaattcaaaaactagccagatgtggtggcacaggcctgtaatcccagctactcgggaggctgaggcaggagaatcgcttgaacccaggagtcagaggttgcagtgagctgagatcacaccattgcgcttcagcctggtgacagagcgagaatgtgtctcaaagaaaaagaaaaagaaagaaactctgggcataaggccaagttgtttaatagttttagttctattactattaactagtaatagtaactagttattaactattattatattatattatatatataataataatatatattatattatatataattatatattatcatattagtatattgatattaactattactataactagtactattaactagtaatattattattaaatagtaatatactattactattaaatagttttacttctattttttgtgtgtgtctgttttcccgcgttccccagttggttctgatgctactcaagtttgaaaaccactgatctaaactgtccccagtacatcaaactctgacaaaactctacccaaagcctacacatggcttcagtcttgaactggttgaatcgatggccacggtatgccagaagcattccctaaaacatttggaaattgtctttgaaggaggatgttcaagaaagtgaagtcactgttcttgagagtataacttttctgtgttagttttataaaaagtggtgagaatgacttactgtaggtctctgatttttataggtgtagcaagtgctgaatttcatcttcctgaaattaacatggccttattttcttagtgtttgcttttgcccatctttttaacctttctgtgtcattttgatttgagtgtgttgcttgtgagaagtatgtggatggattctgtttttaaactcagttttggagtcttcacattgtagcatagaagcctgaactgtgttaactgtgttcattgtcagagctaataaccactgtcctcactccagtcctagtttacatctcctatttgcatccttccttgccccttgttttgtttttctccgatacttcttttattggtttttatcttctctggtgatttggaaaagatacattttattaagttggtgcaaaagtgactgtggcttttaccattaaaagtcatggcaaaaactgcaattacttttgcaccaactcaatagttttagttctattacttttgtgtgtgtgtgttttgtttgtttgtttgtttcgagatggagtctcgttttgtctcccaagctggagagcgcactggtgtgatcgctgctcactgcaacctccgcctcccgggttcaagtgattctcctgcctcagcctcccaaatagctgggactacaggctgtacaggcccgccaccatgcccggctaatttttttgtttgtttttgtttttgttttttgtatttttagtagagacggggtttcactgtgttagccaggatggtctccatctcccaacctcatgatctgccctcctcggcctcccaaagtgctgggattacaagcgtgagccaccgcacccggccaactgttcttgtggtaatgagtaagtctcatgagatctgatggttttatgaggggcttctcctttcgtttagttctcattctctctcttgtctgccaccatgtaagatgtgccttttgccttctgtcataatcatgaggtctccccagtcatgtggaactgtgagtccattaaatgccttttttttttttaataaattactgaaattactcagtcttgggtatgtcttttctttttttttttttttttttttgagatggtgtcttgctctatcgcccaggctggagtgcagtggcatgatcttggctcactgcagcctccaccttccaggttcaagtgattctcctgcctcatcttcctgactgcttgggactacaggtgtgcaccaccacacccacttaatttttgtatttttagtagaaacaggattttgccatgttggccaggctcatcttgaactcctgacctcaagtgatccacctgcctcggcctcccaaagtgctgggattacaggtgccagccaccacgcccggcctcgagtatgtcgttatcagcagcatgaaaacagaccaatgcacacacctataatgattattagacttaactgttagagatttttagtgccagccacaagttctttttagtcaaaaatgttctcacttatctttcttcattttcattcttggtaggatgttagacttttttcctggaagagagttgatgtgactgccgcttacgcacaggaccaggaatagaaacagtacctaggctatttccatttccttttctctgtcaaaaaccaatttcttttccagaatccacagccaattcctcacaaagtggttgagcctagtcgcaaaatcagacaagacttctcacactgaaatgcgaaatatattcttttgcaaaacggcaccgtcccatgctctctgcatttccagacgccagtctacttctgtggctttactgacatggttacatggaatttttattttttattttttattttttatttattgatttatttattttggagacagagtctctctctgtcgcccaggctggagtgcagtggcacgatcttggcacactgcaacctttgcctcctgggttcaagcaattctcctgtcttagcctcccaagtagctgggattacaggcatgtgcccccacgcctgactgattgttgtatttttagtagagacagggtttcaccatgttggccagtctagtcttgaacgcctgtgtgatccacctgccttggcctcctgaagtgttgtgattacagacatgacccactgcacctggccaattacgtgtgatttaaatcccctccctgactgccagtgtccagatacagcctcagcccctctcagtgccaactcctccaggaagtccaccttcatttctatggagctgtaatctctccacagtccattcgtctgcatcacaactatcatttcctttgccttactagttactaaattctatatctctatcactttcaccagtctctgagctctcttgaattcttttttagaattttaagttagaatcttgtcctctctttttgtgtctggtctgtattgcatctagaaggcattcaggctgtttttgttttcataattgtgattgttgatgtagctattcaataaaatgaatgaatgaagttaattcaggatatatgaaaacatcacccataaaataataaaagagaaaggtctacagatagttcagcatgatatataaaaatcttgtagaaaaaccattatatactggccattaggcaatacaaattcagagaagagaaaaattaggacaaagtcattgcataacaccgccgtttaaatgtgaagaactgcaattttcccccgattatgtgagatcagtcctctgaggatgtcattaaggtttctggtatgtaattgaaaggagccctgagcctagagattccaagtcttcaactgcatgaagacctatttctcctcatttctggcctgattatcatcctatcctctgcaggctggcacggaaggctcacttcactctcgacttcaagacttgtgtaaacttttaactgtcttttctcactgtgctcatttcagagttggtttgttaataaatatttgccatctgtagcaaatcttaaaatgtaccaaaatcttaaaatgtctgcaataaaaagcaagacaagaaacttggcagtttctaagaagagacctttattttatacttaaacactggcacgtgtgtgtatgcgcacgcgtgcatgcatgtacacacccacacagcacacacgcatatacacaccatacacacacagtacacacacactgcgctctgtcatagagacacaccctgcacatttgcactcgcttcactacaatccttctgtatttatctatcttttctctactttggaaatacaactattgcaccaaggttttttttaaccaaaattccctccagttttgtccaagttatcaaggctgtcgtgtcaacccaaagggtcttggcaagcaagctacaaaatagagagcttgaaacttagccattccaggacagggagcttgtactttgcaatctatggtacagaattatcgaatgcctttggttttgttgttgctgtttttgatatcatcttgttttgttactatctaaaaagcagacaaaatgggctgggaattccctagttttcacaactgttttcttagctagaaggcttttagaccaacatagcacacctgcatctctgactttatcttccactgtgatgtcctgtgggctgctcccatctgggagtctgccattagatatggccagggctccaattttgtcataattacatcagcaacagcaaaattgagaagactgcatttgctccactgtgtggcataaccagtgaccccaaatcatggtggcctccccagcgtaaggtcatggttgcccatgttccatgtcatctacaggctacagacaacatcttgaggcagtaggctgtctgctccatgtgtcttctcatcctgggacccaggccaaagagtagtacctatggggtccatgctgttcttagggaaggggcaggagtaatcagagccaagccacaaaagtgtgcctgaagatcttgtttgaatgtggtctacatcacattcatcatatccagttggcccatgaaagttacatgaccaaaacgggtgcaccaaagtctcagaaatcaccactaaagaacttatctatataaccaaaaaccacctgtttctcaaaaatgattgaaataaagtaaaaacagagaaagcttagggagaagatgaataaaacatttttacagtggttaaaaaaaacaaaagttgaccgggtgtggtggctcatacctgtaatcccagcacttcgggaggccgaggagggaagatcacctgaggtcaggagttggagaccaacctggccaacatggtgaaagcccgtctctactaaaaatacaaaaattagccaggcagggtggcgagtgcctgtagacccagctactaaggaggctgaattgggagaatcacttgaacccgggaggcagaggttgcagtgagctgagatcacaccactgcactccagcctgggtgacagaccaagactctgtctcaattaaaaataaataaataaataaataatgaaaaaattacattaccaagctgaaggtcagtaggataggaaataacccaggaaagcaaggttgcaacaggaaggggatgaataattgtgttgaattaataccatctctctatgtttacaactccaatatcttcaagggatgggggggcaattagaaattctagtgaaattaggtaccaaatggtagcttccacacatagtaaggaagaaaatttggcccgatgggcgtatggataaattcatattcacctatttgtaaaaaaaaatcgaagagacttacagtcaaatcacagatgtataagatttaaaccatgtgacataattaaatgtacaataaaatgcagagttatttataaagtagatatataaagcttcagccatggaaacgacccacgtagccgtccaggtaaagggaaatgggataccaagcttccatttggtggcagtgaaatgtgtacagacatattaagagagacggcttttcccagctctgagcttcaagtagcattctttattttttctttgcataaagggattgatactttcagtagcagatgaggcatgcatgccgcatgccacatgtaactactctgtaagagaaggttgagtatgtactgttactgcacaactaggtaattaataacctgtgaattttagttatgtttacttcagcatttgctaagctaattgttcaatcaagaattcattgttacaaaagagttgtttaagtttgactcctgggcttttctagggaaagcttttaaagtctaaatacctagaaaatgtaaacatacttttgtttaaaaatagagattaattatgataatcaaagtggaagcatttaatgaaacaatgggctttatgattagaaaggtaaacaagaacacataattagttagttgattacttttccattttaaccaaggcagtgtctggctactcatccttttttccacttacctggtcaactgttgcctagtggacaaagttctggacccagggggcaagtcctgggtccctgctgtccctctagcacagttcatatgctcctaagtatctggattgactgaggttttgttttgagttgggtttatgtctaacctttttgatgtctattttgctggttaattgtgaattcatagtattcgtgtatgtctgtgcaacgcaacaacacacacacacacgcacacacacacatttacttctcctaaagacttttaaaggacgaatgttaggagataagtactcattttctatctcagttattcttaacgtgtagtctaggaacacctacatcagcagcctgggagggactggttgtcaacaccgattgcacaaaccttctaaatcagtgtcttttggagaggtacaagaatttatttatttatttatttatttatttatttatttatttatttatttatttttgagacagagtctcgctctgtcgcccaggctggagtgcagtggcgccatcttggctgcctcctgcctcctgggttcacaccattctcctgcctcagcctcccaaatagctgggactacaggcgcccgcctacaggcctggctaattttttctattttttagtagagacggggtttcactgtgttagccaggatggtctcgatctcctgaccttgtgatccgtccgcctcggcctcccaaagcgctgggattacaggcgtgagccaccatgcccggccaagaattttatttttaacaagctctccagttaattcttaagcacacaatgatctaggtcagcattgtccaacagaactttctgtgatgatggaaacacttcatataggcattgtccaatatggtagatacatgtggctgcatgaacacttgaaatatagccagcacaactcactgaatctttattttaattactttatatcaaaatgtatttttattaaaatatttttaaaccattttattgtgatataattgacatataaaaagtagtacacgtatgcaaattaatgggtttgaagataagtatatactcacaaaactaacaccacaatcaatgctataaacctatcacctccattatgcatcaattaaaaataatagtaaaagcaaaaaaaaagtatttacctgctccaaaagttttctccaccctcttttattattattattttgtgatgagaacacttaacataagatctacccccttagcaaatattcaattatacatacaatattattaactataggcgctatgttgtagctacatgtggctagtggctaccatattggatagtgcagagctagatgataattcagcagcagctgcacacatactagtagtagtaacaatagtgaaaacttgtatgtggcttgactcaggctttttaaacttactatgtgcctgacactattctaagtacttcctagatataaactcatttaaatctcacaaacttttaggatgagattatatttttgagacagggtctcactgtgttgaccattgtgttgcccagactcactgcagcctcaacctcccaggctcaagcgatcttcccacctcagcctcccaagtagctgggactacaggcatgtaccaccacttctggtttaaggcatttcttaaagatagtagatcagcggggtccggtcaggaagacagaagccaagctaggcatttcaaacagagcggaatgcatataggatattgattggttacactggcattgaaaggctgaaagagaaaaaggaatactgaggtaaccaagaacaataatgtaggaagcagcttccaatccctagggctggggagctgaggaaacagaaggaagttgaacacgggagggacctggaccaccaaggggtgttaatggcaaatgctcagtgcatggggaagccagtgtggttggtgccaggaacttcatgagttcccaagtactgggagcaccagaagctggagattagagttcttgtcttccttcacctcttgagagatgtagacttgagctgaagatgggaaacaagccctgtttccttctcctgactttgagtctcctgcttgtgcctcccattggcagaatctaattttatggcacacaacacccgcatagctcaatctaatcagaagctaatcacaaatctaatcagaatatataatcaggcacaagggtctggaaaatgtgtttggggacttcttgccccagtatcacagttcaaggtgtagaaagatgggcttggagctgaggagaagagacagatcatttgcacgaaattttttgataagcactttgtttaaagtaccatatgtctaaatgtattaatgatatcatcactttctgggctaaatagcatatgtcaggcagttcttagggagatgacacggatgtaagtgaccaaatcttgattaattgtcaattactgcagtcaccccagctaggttctatgcatagttatgcatgcatatggggacttcctccctactttgctaattggtctctttcctcatttgctatgaggcgctcccatacagttggcttgaagcattagaggctacactacgggatctgcttcttgccctttctctgagttcactcccatctgcagacctccaaatccttctactctcatgtggggaggaacaaaggaattaaaaaagtagatgctagaggagttatctcttgctgctcctgtttacaatttctgagcttctcccagtaaaagccccattgccttcctaggaccaccatttctcctcattttggtgtggattatacaaagttcttcatttttggagatggactggggagagtgtgtgccccacctccacctacaaaccctgcatgaggtcggagagtaataaatgctcatgtttctctttgactaaacactcagacgaagaaatttagaaatatattccttgataaaactgtgaattatctaagagaattgatcttcaccacatggcttaaaagtcctcctatggaggagaagctgaggacttgaggcaggaaccaacacaagttagtaatatggtgactagcttgtgcatttgttaaactataagggaacaaaaatatgttcattttccctgccagaatccataaaacaaacatgatgtataataaattaggaaaggaatcagagaagactatgagacgatgtattcttgcgtcttgcagttgataacaaccaaaacatttcctaaatttctggtttctgtagcaaatcatttcagagctaaaatctttccttgagatttcaggaagtaattctctttcccttgctttgcggtatctttccacagactctcatcctcaggagagatgctgagcaacatagttgattatcttaggattgagttgctggtgagagcctgttttccactttaacagctggggggcagaacaatatgcacagatcacaagtatgctcctggaagcttccttcatggaataaggcggcattatctctgtaccccattcccaaaggtctctaaggtgctataggttcgctttgcatgcttgttttgggtttctttgcatgtgctgctgaatacctagaggtttggcctagatctggttgctcacggaaagccaatcactgaaacaataagtattgccagggaagacagctgtaacacaggtgatgtcagctgggagatggaaggctgctcccaaatccatctccctaaccaactaaagtcaggggtttacatagcgaagaattagagaggggtacaggaagaggagctggtcaacagtcagcaggtggtcagatgaggggtctggcgtctctttaaatcatgtgtggcaaaacaggaattcggagtaaggaattgattaacaggcagttgtccagatgcggtaatctggtaagtttcaattccctgataccgtctgggaggcctgatggttggttttctgagaaagaaactcagataaaacaaatgtaaggtgttcgtctgttctcatgctactaataaagacatactcaagactgggtaatttataaaggaaagaggcttaattgacccgcagttcagcatggctggggaggcctcgggaaacttacaatcatggcagaaggagaagcaaatgtgtccttctttacatgggggtagcatggagaagtgtaaagcaaagtgagagaaaagccccttataaaaccatcagattggccgggcacagtgtgtcacacctgtaatcccagcactttgggaggccgaggcgggcagatcacgaggtcaggagatcgagaccatcctggccaacaaggtgaaaccccgtctctactaaaaatacaaaaaattagctgggcatggtggcgggcgcctgtagtcccagctactcgggaggctgaggcaggagaatggtgtgaacccaggaggcagaatttgcagtgagccaagatcgtgccactgcactccagcctgggcaacagagcgagactccatctcaaaaaaaaaaaaaaaaaaaaatcagatctcatgagaactcattcactatcacaagaacagcatggaggtaactgctcccataatttaattacctcccactgggtccctcccacgacacgtggggatatgacaactacagttcaagatgagatttgagtggggacacagccagaccacatcaggaagtttcttaagcttcagttctatgcaaaaatcgggccaattttacatgcatcttaacgtattgactctcacaatctcaggcatgttgtaagtgctaccatctccctttcttgctcacttcggagaactacacttctgtgatacggtgtactaggttcccttctatcatattcccagctggttgtttctgggagtttcagggtcttaaattctgtacaaagagaggagaatagtacatacaaccctcgtcccccaaagtagtaggagccaacatgcctagttttgtattttcttttgtgcctgagcctttggaccaatgggaagatgtgaggaagggccacgtggcttccttgtcatccttcaagaggacaaaaatgttgtgttttaagagggaggccacagttgtgtttttccatccattcccattgaccgtggttactattaaatagctatttttttggcagagtctagcaataggttgcctgaatccaagccttgtgatgatgagaaattttattttcttctgcattttcatccgtcttagcacctgatgagaaggtggcactggggctgctagccagctgcatctgccttctggatctggcacatgcagccctttgtttgctgtctctttgttccatgatgtgacccaggttcatgctccctgtcgatgaggacacccagattaaatatgtacagaaaaaaagagggcagtggaataaaatcgagtacatttcctataatgtctatgtattctcacctgcaaagtaaatgtacataaaattcatgtttgaggaccattaagttctgcttatcaacacaaagattgtccaagcaataagtcaactcacaatgtgatgcttccctctaacatatggcctgataatgactctactttctttgtctctggagtttgcatcaaacatctgtgttaggaagagtggctaacatgaaatccttggtcatgatttctttgtacctgtttattaagaagacagatgccatttctgggccaagtgtcaagatccaacagagtcacttggcaatttgactattggttggtaaacattaagcattactgcacctgaggctgagttccccaaggccatttaatttgtagaaataaatgcatttaatttccaacagttagaatttttgactctgtgtactgtaacactggagcggtgtctatataacaccgcagccaggccattatcagagcttgtttagtaataaaaatcaatgaattcagcctagcaactcattttatgactcaactgactatttgagtctgttttggcatttagctttcaaagattaaagaccaaatatcagtgactgttcatagcaaaaagactgtttatctacttcggtgactgctcttgtctctaagctccttttcccagagatgatttggcaggctcgcatttacccaggctctgatgatgcccctgcctttgggaggctcctagatctgggtctcaccttttctccaggcacagccaaggcagcctggctcagagacccagaccctagacacagccatggcctgggcattgttcagggctctcagaaagcagcaaggaagacaggtcttcagctttcaggagctctgtattagtccattttcatgtggctgataaagacatatccaagactgggaaggaaaagaggcttaattggacttactgttccatattggttggggaggcctcagaatcatggcgggaggtgaaaggcacttcttacatggcgatggcaagagaaaatgaggaagatgcaaaagcagaaagccctgataaaaccatcagatctcatgagacttattcactaccatgagaacagtatgggggaagctgcccccatgattccaatgatctccaactgggtccctcccacaacacgtgggaattatgggagtgcaattcaagatgagatttgagtggggacacagagctaaactatatcaagctccttgtagaatgggaacgacagcaataaagataagttccaagtggcttgatgtttcctcttaaaaggttaagtgatggcaaatgcccggcaagatctgaacttggaagatcaagattcctcacgttctgatgccacatagttaaccctatctcctggaaacccttccccagcccctgcacagggacctgtccccttgagtcactctgtatgccctgaacataccatgcgcattcaaacctccgttcctgcctctgtgaacccatcatccttctactgcctgagatgtcatgttcatcccattgcatatttgtctgcctggtgatggcctagttatccttcaaggctcatcccaagtgcctccacttcttcagctttctcctaaattgatctctcggcttcaggagcattgtttccatccatcgattttgtttcattttgcattgtatatcatagtcatttgtttatgctatagagccaaccatgaaatgtttaatgaggagaagtgtggcttaaatctctttgtgtcctccatgcctggtataatatggtagggtgaatggtggcccctgcaaggatgtgttcacatcctgattcccaagcctgtgactgtgaacttgtttggaaagaggagggcttcgcagatctgattgtttggaagtgggtggcggacggttagggggtctttgcagatctgaaggtcttgagataatgagcatctgagattgtttatgtgggccctaagtcagacggcaagtctccttataagatagaagagaggccaggcactgtgacatgcctgtaatcccagcactttgggaggccgaggcaggcagatcacttgatgtcaggagttcaagaccagcctgaccaacatggcgaaaccctgtctgtgctaaaaatacaaaaattagccaggcgttggtggcacgtgcctgtagtcccagctgctcaggaggctgaggcaggagaatcacttgaacccaggaggcagaggctgcaatgagctgagatcaaggcactgcaatccagcctgaggaacagagtgagacactgtctcaaaaaaacgaaaacaaaaacaaaaagttgaagagaaaaagacacagagacagaggagaaggccatgagaggatggaggctgggtttgggattatgtgatcacagatcaaggaattcctgtggccaccagagactacaagagccaagagcagattattccctggagcccatggaggaaggacagcctgcctacgccttgattttggactttcagcctacagagaactctaagaggatgcatttcagatataagccatccagtttgtgctaagtggtaaaggcagcccttcggaaactaatatatataacaactggcacaaagaaagagctcagctgttaactgaacgaacattgataattttgtacttagaacacttcgagtggttaaagatatttaagatgaaagagaaaattctaaatgtgtcttctgctccaattatgtttttatgagtccacttgaaaccctggaaggcagagcttgccacggctatttcaagcacccctctcctccacgaaagaggaaataacctcttattccatcagcccataaaccagcggcacgtggacgcaacatcaccccctgcacttcttgtcttcagcaagaatgagggcacggagaactccacttcaagcttttcagtcaacccgacgggacgcgacagattacagagcaaagtgcaccaaagataccatcagttaacctaataaaattgatttaaaagcttttaaacttgagagtgagagttcagtgcctgcgaaagatctttcagtcccttgaagtgatgaaataaaatgatcaatcgcccttatcaacctccctttttttggtaatgtggtggcaggaacagcttttccactgtcaaattaaccctcttttaaaagtgggtttctgcagcttctgctccactctctctgagctcaggagctgagcccttggaactcttatgtcctctgttgctggtctcatcttctattgaagggaggaagggaaggaggaaggagggaaggacggacagttggacggagggagagagaaaggaaggagggagggatggtgggagagagggagggagggaaagagggacagagggagggagagggagactcaggatactcaatgtttttggggggtttttgtttgtttttgaggagtctcactctgtcgcccaggctggagtgcagtggcgccatttcaactcaccacaacctccacctcccaggttcaattgattctcctgcctcccgagtagctgggattccaggcgtgagccaccgtgctcaactaatttttgtattttttggcagagacaaagtttcaccatgttggccacgctagtctcaaactcctgacctcaagtgatctgcacctcttggcctcccaaagtgctggcattacaggcatgagccacaccgtgcccagcctcaggatactcattggtttttgatccttcatgctctctctgggcgcttggcatggggagcttttcttggaggttgcggttattaaaatgccttttgaatgataaaaatagaaatgtgtttattgttaaaaaaataaaataaaggaacctattgagaattaattatataagctcaaaaccccttatctcactctcttcctttgaacagcttggtgtagagccttccagcccctgttgcttatgcctttacaaagatgtgtgtgcgtgcacgtgtacaggtacatgcactcatgaatatacatggtgccttcgacatcaatccaacacacatatttttccagcaaatatttttatagcacctccgatgtgtcaaactttgagtatgtcatttaaattattctgtaacttgtttttttcactaaatgcatcagagacacatatggacacatatctatttcaggagtttagtcccacctttttttttttttttttttttttttgaggcacggtctggctttgttgcctgggcgcatgatcacagctcagcagcctctaactcctgggctcaagcggtcttcctgccccagccttccaagtagctgggactacagtctggagctactatggtagcacaagtaggtactccagacttccaagtagctggaactttctgccccaaccttccaagtagctggcacttccaagtagccaccactcctggctaatttttaagtttttctttgtagagacaagatcttgctgtgttgccgaggctggtcctaaactcctgggctcaatcagtcttcctgcctcaacctcccaaagtgctgtgattacagttgtgagccactgtgcctggcctttttttttttttttttttttttttttttttttttgatggagtctctctatgtcctccaggctggagtgcagtggtgggatcttggctcactgcaacctctgcctctctgcctcctgggttcaagtgactctcccatctcagcctcctgagtagctgggattacaggtgccagccactatgcccggctaatttttgtatttttaggagagactggatttcactatgttggccaggctggtctcgaactcctgacctcaagtgatccacccaccttcgcctcccaaagtgctgggattacaggtgtgagccactgtgtctggtccatgcctggcctttttaacagttaaatgtcatttcgttcatctagtaaacaactatgtagtaagcacctactgtgtgtccccgtggtgtgtaggtgctgggcttacagcagtgactcagcagaacaaaggcctccatctccctttgtagagtattttaatcaggacctactgatggacactagggttttgtgttgtttttttttccaacaaatgaagcaactaatagctttaaatgtatattttattacataggtatatttatgtaataaatgggccacctccctaggagtagaagtgttctatttaatcctagagcatgacagtgttatatgtatgtaattcacaagccagagcaggagattcaaactgcccctgatgacagcattcaccagtgggccattttcttagttaacacaggatcagttaactctcaacagctgctttaggtctgcttctccctgccttagattaacatctgtgcttgcctgccctggattctttaagacacatcgaagagttatgctaaagaaacgatggccagccgggcgcggtggctcatgcctggaatcccagcactttgggaggtcgaggtgggcagatcacttgaggccaggagtttgagaccagcctggccaatatggtgaaacctcgtctctactaaaaaaaaaatacaaaaattagctgggcgtggtggtgtatacctgtaatcccaactactcggtaggctaaggcaggagaatcacttgaaccctggaggcagaggttgcagtgagcagagatcgtgccactgcactccagctgggcaacaaagcgagacactgtctcaaaaaaaaaaaaaaatgctgcgtatgatgggtggcctggccttatgtgtgctgggcctggctgaactacacttcccgaagcaggtggatcacctgaggtcaggggttcaagatcagactggccaacatggtgaaatcccatctctactaaaaatacaaaaattagccagacatagcagcaggcacctgtaatcccagctattcgggtggctaaggcaggagaatcgcttgaacccaggaggcggaggttgcagtgagccgagatctcgccactgtattccggcctgggtgacacagcaagactctgtctcaaaaaaataaacaagaagagaaaaaaaagaaaaagaaacagtgatcactggttttcagtgtggagagagaattcctctgcccccggcttcacctcatttcctttcagagacccccttccacctgtgtcatgccactaagccaccctttccctgattcctaacaatgtaaggagattggaactgaggctgggatgccttgctgttaatcttccagagaacccgatgcaatcaagttgcacgtctaaaatgaaaaaggaaaggacaacctcattgtaaatattattaaatcaccattcagttacttgcacatcgtgtctttctgaattactgctgctctcctaggaatacacacacagggaggcccatttcagagacgacgtcttatttaagcagaacagttgctgaagaaagagtatgggaatcaggcccgttcattcattcatatagagcacttgctaagtgaaaaaaccttgtgttaaatgcaggcgatgatacaaaatggggaataaaacagggatacgtttttacagcaggggaaccggatcgtgcaggtgaataaccgcaatagaaagtcaaatggaataaatgcctgagatgtggggaacaggcttgcttggagttcagagaagcagctgcaaacctccttttctgatttgcaaattaaatacatgtaacactgtcatgctctataattaaacagaacacttctaggaaggtggcccataaatatacttgtgtaataaaacatacatttaaagtattaactgttgcatttattggaatttaaaaaaaaaacctagaaaatccacttgctttgctgctgatttttctgcaactctaggagaagtcactcttcactaaaagataatgataatcgctgggcacagtaaccccagcactttgggaggccgaggcgggcagatcacgaggtcaggagatcaagaccttcctggctaacatggtgaaaccctgtctctactaaaaatacaaaaaattagccaggtgtggtggcacgtgcctgtagtcccagctactctggaggctgagacaggagaatcgcttgaaccggggaggtgggggttgcagtgagccgagatggcatcactgtactccagcctgagcgacagagtgagactccctgtcaaaaaaaaaaaaaaaagataacgataatctggaagcagtgatggaaattgtcagatgtggttggagtgggatacagggatttgcattctactttccttgtccctttgagaattaaaatatacagcagatattttgcaagcagatttaccccgactccttcagccgaggttaatcaatccacaacctcatcagatttaagatcccacctggcagatgtgttgggggtcccgataacttttaaatctgagctgtaagactgtagaaatcaaacctgtttggtgtgggagggcttctcaggaatagggagcttgagtaactttagtgtttagtttgacctttgttaaaaaaaaaaaaaaaagcccacacaccaaaagaattttattttttcttgtctttgatcagagaatttcagtaacccatgtttgagttatggtttcatttcatggctgtgaatatgtttctcatcttgtgccctgcctgtgaaattgaccctgacatagttcccatccaagttatttttccctaaaatatgtaggaaatgaataatgcattgttgattattctgttaccaaacaaaagggtcttgcttcccaatgtgctagaagccaatattatgacactaggtttttgagaaaaggacagctttttattgctagtcgactaaccaggagacaggagtccagctcaaatctgtctctctgtgctggctttaaggcaggaattttatcagaaaacgtttagcatctggattccgagatttgcaggtgattggtggaaggaaaagagagatctggaaagtcctcggacacatacagttatctcttcatgcctcctcatgggtctcgtgcaaattcagggggagttagtatgaaacatgcctggaaatccaggctgtgatatccacaagctcattctgtgcaaaatcctgttggccatattgagtctaactgatttcagccagttttgttatcttacaagcagagggagttgcagcgtttcagcaggttttttttttttttcttatctgctgtcctgcaaactcaagaatttctgagagttactggcttctttaactttttctttcttcctttctttcttttctttcttttttttttgagatggagtcttgttctgttgcccaggctagagtgcagtggcatgatctaggctcactgcagcctctgcctcacagattcaagagattcttctgcctcagcctcttgagtagctgggattacaggcgcatgccactgcacccagctaatttttgtatttttggtagagacggagtttcaccatgttggccaggctggtctcgaactcctgacctcagatgttccacccgcctcagccccccaaagggccaggattacagatgtcagccacctcacccagccttttaactctttgaggcttgatttcttttttctttttttttttttttttttttttgagatggagtctcgctctgttgcccaggctctggagtgcagtgatgcaatctcagctcactgcaagctccgcctcctgggttcatgccattctcctgcctcagcctcccgagtagctgggactacaggtgcccaccaccacgcccggctattttttttttttttttttgtatttttagtagagacggggtttcactgtgttagccaggatggtctcaatctcctgacctcgtgatccacctgcctcagcctcccaaagtgctgggattacaggcgtgagccaccacacccggccaaggcatgatttcacgcctaccctaaaggataaagtctgcaataataggggttagttctgagaactggctgcagctagcaatctattcttttggaacccagtcttttgcctttcatcctctgcaagtgcagactcaatcaacctaagcagatagaggaggctctccaaagcccaggatagaaaatagctttcttgcctggggggagtagttgacttcacacttcaaaaaatttctagaagtttttagcatcgcagttggcatctctctttcatcaaggtgaatatccatcaagaagggatgcagtagagaggaaactcttggattctgaagattccatctcattttcagcttcatcatggatgagctgtatcattttgtgcaagtttcttacatctttctgagctttagtttttttttttttcatctgtaagataagtaatttaatacctgcacccccatcacatcgggatttttctggggatcaaatgcgttagataaattaaacttgaaagctttctttacaaattatttgaatgtagggcatttagtaattctcactactgttggcaacagggagaaattggcaagtttctagtggctggctggctagggtttgcatatcagaatccaactttcatattttatatcgttttcatattttccatctctttaatgcactaaagggtaatctcattgaacttatctctcgtcccctctgtttttctcctcgtatgtataacctatttgattgcttgctgtgttgtaagctctaaagactcttcatttctagaagtttcacttggctatttttcacatctctctgtttatttttcacaaggttttgttcttatggtttttgactcctatttttaggtttttactcgttttgttgttgtttcggttttttggtttgcttgtttgtttgtttttgacaaagtcttgctctgtcacccaggctggagtgcaatggcatgatcttggctcactgcaacctctgcctctggattcaagtgattctcatgcttcagcctcctgagtagctgggattacaggcacgtgccaccacgcctggctaatttttatatttttagtagagatggggtttcaccatattggctaggctagtctcaaactcctggcttctagcgatccacctgctttggcctcccaaagtgctgggattataggcatgagccaccacagccagcctgatttttactcattttgaacattcgtattttatggtgtctgtctaatggttctattatgtcaagttcttgagagttctaatcttactgtatttgctgagtcttacttacagtggattgtttcctcatgtgtttataatatctattaagagctcatctttgatggagcttcagctatgaaattctgggttgtatgtggatttctccggtaagttttctcatttgcttttgctcatcactcctaggtgtcatcttctgaggctactgtgcatgtacatttctaggcttgctgtttcctgactatgtacctaatgtaaattgaaatctggccaggcacagaggctgatgcctgtaatcccagtactttgggaggccaaggcaggaggattgcttgagcccaggagtttaagaccagcgtgggtaacatagcaagaccctgtctcaacaacaacaacaacaacagaaatctcaaaccctcagggacaggtcattatgaattcttgagggacactttttttttttttttttgagatagcatctcaccctgtcacctaggctgaagtgcaatggcacaatcatggctcactgcagcctcagcctccctggctgaagcaatgctcccatctcagcctcctgagtagctgggactacaggtgtgcaccaccactcctggctaatttttataatttttagtagagatggggttttgtcatattgcccaggctggtctcaaactcctgggttcaagtgatccttccaccttggcctcccaaaatgctgagattataggcccaagccactgcgcccagctgacaactttcttttatgcccagcgctcaagaagagacagacaggtttccttgtgatttatgattagagtagattttctgaatgcaagcagcctgtgtgatcaccatctgaacgtcaaagggattcaggtttgcattttcatagctgtgttagaacaaggtactcaacctttctgaacttcagtgtttccaactctcaaaagcagatactcttactcacctaaaagcattgctgtgagaatgaaatgggatcctacatatatatgaagttcatggccttggacctgcggtaaagggaatggtccataaatggtagctgttcttggtcttcccatttcagagatgagaaatctcagaccctggaagtcatggtaccactgggcaagggcaccatggttaggccattagcctcctctcagaaactcttttatgggtccacttacccactttcctgccttgaaacaatagaagaactaagggttttatctttatcttggttttttatttcttaaattctgtttctttggttttcttttttcttttttttcttgagacagagtctcactctgtcgcccaggctggagtgcagtggtgtgatcctggctcactgcaacctctgcctcctggtttcaagtgattctcgtgcctcagcctcctgagtagctggaattacaggcatgcaacaccacacccagtcttattattattattattattatttttgagaaggagtttcattgtgtcacccaggctggagtgcagtggcgcgatcttggctcactgcaacctctccctcccgagttcaagcagttctcctgcctcagcctcccgagtacctgggattacaggcccctgtcaccacacctggctaatttttgtattttaattgagacggggtttcaccaggctgatctcaaactcctgacctcagtgatctgcctgccttggcctcccaaagtgctgagattataggtgtgagccactgcgcccggcccagctaatttttagtagaaatagggtttcaccatgttggccaggcgggtctggaactccctgagctcaggtgatctgcctgcctttccctctcaaagtgctaggattacaggtgtgaggcaccgcacccagccttaaattctgtttcaaacttaagcccggcctctggtttcagcctgcagcaggagtgaaacccgcactgagagaggagagactgtcactattttcattgataatgaaagcagttttctaatgatagaggaagcacaataaaagctatctcataaatggcttttattacccattgtctagtctttcctaaacaataggttattagccatatgtaatagggattgaagctaattgttttccttatttttcagataaagaaatgagttgtacacagtgatttttttaaggacacttatagcactaatattgtgtgaatcgatttagttgagagccatgtgagagagttaaaagttcatagaggagttgggtgcggtggctcttgcctgtaatcctagcactctgggagggcaaggcgggtggattgcttgaagtcaggagttcaaaaccagcctgaccaacatggtgaaaccctgtctttaccaaaaataaaaaatttttttttttaaaaattagctggtgtagtggcgtgcacctgtaatcccagctacttgggaggctgaggcaggaaaatcacttgaatcaggaaggtagaggttgcaatgagccaaaatcgcaccattccactccagcctgggcaacagagcaggagtctgtctcaaaaaaaaaaaaaaaagttaatagaaactgggtgctttgttcatctctttgttttcttgagtggttgagatgcattcctgtcacactgtgcccccaaatgacaaggacagcaatctttttttatgctttcttgcccatgggttacaggggtttggccttgtggccatgggccacaccatcttttcttttgttgggaggagggaggaaactggctggccttagagttcaacattgacaatctggtagaaggtaattgaatcatggtggtaggtttctcccatgctgttctcttgatagtgaataagtctcatgagatctgatggtcttataaagggcagttcccctgcatacactctcttgcctgccaccatgtaagacatgtctttgctcctccttcaccttctgccacgatcgtgaggcctccccagccatgtggaactgtgagtccattaaacctctttgtctttataaattattcagtctcaggtatttcttcataggagtgtgaaaatggactaatacagtgtcctgtctcttcttcctcagagcggacacctccagaaaggaatgctttcattaaggaaaaaggcagccaaaatcctgtttccatagagtcttgtttaattctttgtgttacatctccatgtcattatcaatgaatcagcctccagtgaaataactgactgcacttgtggtttacgtcactgagccaggaagccagggagtggggtgtgtgggagaaacagctttgcttctgagcctctgggggttatggataggaatgccccttgccagctactggacctggtactgtggtggcctctgtgtatatccctcagtgtgctgtgatcttcaggagggaagggatgatagagtccacgtttcagctggcctttctattactcgagcagagtcgccagtctttctggatatatgttcctttgttgacttgtttctggaatggaattccataggcttttagacctatatggcttgaagaggtgataaaagaaggcatctacaagaccattagaaaagatcttggctgggcacggtggctcattcctgtattcctagcactttgggaggcctaaggtgggaagcttgcttgagcctaggagtttgagaccagcttaggctacatagtaagactctgtctctacaaaaagtacatgagttagcctggcatggtggtgcatgcctgtagtcccagctacttaggaggctgaggccggaggattgaggattgcttgagcctaaggagtttgatgctgcagtgagctacgatcatgccattgcattccagcctgggcaacagagcgagactctttctcataaatagataaataggtagatgaataaatatattacaatatacattaagacttcatgtaagtttcattataccgaaagagtaattgtttttttctccttgagttgtgttagaaaaagttcttttctgttatcacagcttagtatatgccaggcccaggagggaatggggtcataccaagcccctggaagaattttggaggaaaaagaatcttgttctgtttcatgggtcttctgggaatgcagaagaggaggatccgagggaaaggaggttctgagagaaagtagattctctccgtaaaagcatccagagaaagcgtgtggctttctcagctatattctgaccctgctcaagtaataaccatgtttcaacctaaaaccgtctcctgcttgtctttcaatgcacagagctcaacatactttaaagacagaataattagaatgtactatgtacaaaataactactagctcagatgagtcctgccccaatttaaaattgagaacagtgagtgctagtgttatgtttttaaatgaaactaagcaaaaccacttcttttctgattataaaagtcaacaggttcattgtaaaggcatgggaaaaaatttaaagaagaaaataaaagtatcccacaaccttacaacctagaaataatgataggtaactggtttagcatattaccttttattgacctgtatataaataaatattgggtcatacatagctatgattgtgttttgactttataactagcattattacatgagctttttattatatcattcagttgttttttgtttttttgtgtgtgttttttttgttcttttgagatggagtctcgctctgtcccccaggctggagtgcagtggcgtgattttggatcactgcaacctctgcctcccgggttcaagcaattctcctgcctcagcctcttgagtagctgggactacaggcctgtgccactatgcccagctaatttttttgtatttaatagagacaggattttgccatattggccaggctagtcttgaacacctgaacttaagtgatccacccacctcggcctcccaaagtgctggtgggattacagacgtgagccaccatgcccagccttcattcagtattctttatatgatgttttaatagctgcattcattttatcatggactgtgccaaaatatacttaattatatcccaattgatataaatttagaagattttaattttttcattatgatcgataatattttgatttaaagttttgtacaaaaactttttttaaatctctgattttttttatttcctcttctggctttttacaagattttgcctttgtttttaaatttcccattatgatgtatctaaggatagatttctttttatttgttctgcttgagatttgttgagctttgaatatatgtgttcatttccttcctcaattatgggacattcttatctattatatcttctaatatttcttctgccctgtttactgtcctctgggatttcacaaactggtgtcagatcttatcattgtattatttatgttgcctaccctcttttatttattcttcatctttttctccctctgtgcttcattcttcatagtttcttctgtcttagcctctagttcattaatgctctcttcagctgtgtctaatctgctgataaatgatccactgagttcttaatttttgaactttttgattttagatttttctctttttcctttttcaaatatgttgtgctactttttgtgatttccagtttcctgccaaaaattttaagcttgctttttaattttcttaagcacagtaaacatagatgttttccaataagtctgatagttccagtatctggaagtcctgtgcctctcttttgttgtctgttattttcatgcaagtctaacttttggcctcttgattcctaatgcttttgattgtctttgattaggtgttagagatgttagctactgtgtttgaaaaagttatgtatagcctgggcaacatagtgaaatactgtctcttaaaaaaaatacaaaaagaaattagccaggtgcatggcacagacctgtagtcctagctacttggaaggctaatgcactggagcctgggaggttgacggtacattgagctatgatcacaccactgcactccagcctaggggacagagtgagaccctgtctcaaaaaaaaaaaaaaaagagagagagagagagcgggaaagcaagagttatttgtcaagttaatttgtaaccgaggacggtgttacctgcctctagtgagaatttttgtttacttctgccaagagcacaggagtgctcacagcctctgattcccttaatggaaatgcaaggtgtgagattttctgggcttcccagaggaaatgaagtgagcttgcagtttgggagagaggccaggttgactttcaggttgctctttttatttatttatttatttatttatttatttatttatttatttatttattttgagtcagggtgttggtttgtcacccaggctggagtacagtggtgtgatcttgggccactgcaacctccacctcctgggttcaagcaattctcatgcctcagcctcttgcatagctgggactacaggagcatgccaccacacttgtctaatttttgtatttttagtagagacggggtttggccatgttggccaggctggtcttgaactcctggcctcaaacaatccacccaccttggcctcccacagtgctaggattacaggcgtgagctgctgtgcctggcatatagcacttgttatatgctaggaaggcactttacaaattctgatacttttagttctcctaagaaccttatacagtaggtaccgtgcctggctgtgactcttttttttttttttgagatggagtctcactctgttgcccaggctggagtgcagtggtgtaatctcggctcattacagtctctgcctcccagggtcaagtaattctcctgtctcagcccccctcgtagctaggactacaggcccgtgccaccacacccggttaatttcttgtatgtttagtagagacagggtttcaccatgttgtccaggctggtctcaaactcctgaccttaggtgatccgtccgcctcggcctcccaaagtgctgggattacaggagtgagccactgtgcccggcccaccaggttactcttaagggcagactttttgtattttagccaaaaatgaagggtggtttaccaggttgcccattattagtgggcactgaaacccaactctcggctttctggccttttgaggtggctagaagtgcaacccagcctctcagtcccgctttatggactggaacacacctcaaggtagaaggaaacccagttgctgggcatctgtctcccttttctagtctcggccagagttcaacctaataattttcattttgttcatctacagtggttttattaagatcaaaaaattttatccaggctggtgtggtggctcatgcctgtaatcctagcactttgggaggccaaggtgggcggattgcctgagctcagaagtctgagaccaccctgggcaacatagcaagactttctctcttaaaaaaaaatgcaaaaattatctgagtgtagtggtatgtgcctgtagtcccggctactttgggggctgaggtgggaggattgcttgagcccaggaggttgagactacagtaggctatgttcgcaccacctccctccagcctgggggacagagcaagaccttgtctctttaaaaaaaaaaaaattttccagcttttttagtttttttaggctatagagttggtccaaattacatcatctgacagtctcagaggcagaagtcattattatcctttatgataaattcctaagagtagaatttctaggtctaagacatgtttatttttaagacttacgagacagactgccaaattactttccagaaaagttgtttttcatattgaatccttgttctttttcttcccttctcctaagtatctgttggtgtctcaaagttctgttcattcttctacagtaatttaaaacctgtaacacaatttaaattttagttgcaagtcagatgtaagaaagggtgactttatttttccaaataagaattcaacttgctctccagccctcgtgttcactgatgatggaaaagaaaactaatctttttgtttcaaggtaactcagtttcttcccattgaaaactccatctctttcaggacaattgctccattaaatcaagattttgacaggctgttatttgttaagggtcgctcttcccccttgaaagttctccctctcccagctttcctcttaaatagtgcctggaagcaaggggagctggtgctgccttggggcaacgagagaggtgtctgggctgcgcctgtcttctgggacctttctggcttctgttgacacctcccaatcttgagttttgtcccttctgtattcatagccgatgcccttggccctgcttctgaacttcaggcaagatatccacccagtgggtaccctcctgtcccctgactccctttgtgaaccaacctgtctagttctttgcttcctgatatggtttggttctgtccccacccaaatctcatcttgaattgtacctcctgtgtgtcgtgggagggacccagtgggaggtagttgaatcctggggacgggtttttcccatgctgttctcatgatagtggataaatctcgtgagatctgatgggtttatgaagggcagtttccctgcacactctctgttgcctgccaccatgtaagacgtgactttgttcctcctttgcctttcgccatgatggtgaggcctcccaagccatgtggactgtgagtccattaaacctctttcctttataacttacccagtcttggggtatatctgtattagcagtgtgagaactgactaatacacctccccttcgcctggggtactcaggaacttcaggatttcctacaggccaggagctggctgtgggcatttagagcattattttaggtcctctctctgcctaaacatcactccaccattcctgccccactgcccatagcacgctgcaagacaattgcctcccgccagagtgctaggcaggaagcaaaacatccatctctttgccttcccatcctcaaacccatttgcagatttctgtacccactccctgaattccaacgtgagcagtagggtgaggctgaaactcccccaggagagaccttctcttatgtctgtctcttctgtctccagacttattccccagcccagggagaattagcttctgtgtgtgtctgttttgcattgctctaaaagaatatctgaggctggataatttataaagaaaagagggttatttggcttacggttctgcaggttgtacaagaagcatggtgccaacatctgcttggcttctggtgaaggcttcagacatcttcagtcatagtggaaggggaagggggagccagcattacgtggtgagagagggagcaagagagacaagggaggtcctagagtcttcgttaacaaccagatcttgctgaactcattaccacagggaaggcaccaaaccattcatgaggggtctgccctcatgacccaaacaggtcccatcaggccccacccacaactctggtgatcacatttcatcatgagatttggaagggactgacatccaaattatatcagtcttttggggcactggaactttcccatatgtcagtacttctcaaccctgattgtgctttagaatcaaatatggatgtcgaccaatcaaaccagtgtctgggagtgtgcctgaacagaggtcatttttcaagattccccaggtgatcctaaagtgagccagcagtgagcccagcagctttgtcttactgaactcattaccatggggagaacgccaaaccattcatgaggggtctgccctcatgacccaaacaggtcccatcaggccccacctataacactggtgatcacatttcaacatgagatttggaagggagaaacatccaaattatatcagccttttttggcattggaactatcccatatgtcagtgattctcaaccctggttgtgctttagaatcaaatatggatgtagacccatcatcaaaccagtgtctgggagtgcacctcaacacaggcaagttttcaagattccctcgttgatcctaaggtgagccagcagtgagccccacggctttgtcacaaccgccatcctctggcttcaccggtctgctgtccttaatatctaaagggaggcttttggaatttagcaaatgctttctgtctctgatgcacggctcgtgcgcttgaaatccgggcttagggactattgcttcagcagttaacgtcaggaatctattttatagtcacaacagaaaattaacatctcctttgcttttctttctatctcagctctgacagtcttcccctagatcaaggctaatgactgcctctggatgagatggcaagtccagcatagaaaaagcccattcataagtttcaaaataaattattatactcttttatttgactactttcttacaactattttgctgctactgtagcccttaaatacgcaaggccatcagaaagctgtcttcttacctgaatctcatttggttccgagaacaattgctgtcacctgactgtccttgggtaaacatcataggccaatgctgagaagtgttttaaaaatcagatttgtggagcttattgtatttgctgaagtggtgttaaggagacttggttaaggagaccaagtcactcagtagagaaatttctcttgggtcttagtgatcaagtaactatctttctcttattaaaaatcttttagacactgcagatccagccaacggttctgtctacagtggggatgaaagagcttggagctgagtttgtggcccactgttattaaatatgtaatatgtcagagcctgcattttgtctgctaaactcaccctcggcatcatcttttttatttttttattttttgagacagagtcttacttcatcacccagggtagagtgcagtggcgctctgctctcggctcactgcagcctctgcctcctgggctcaagtgattctcctacctcagcctcccgagtatctgggactacaagctcgagccaccacacccagctattttgttttgttttgttttgtttagagacagggtttcaccatgttggccaggctggtcttgaactcctgatctcaggtgatccacccaccttggcctcccaaagtgctgggattacaggcataagccactgcgcctggcccccttgacataatcttattttgctctttgtcctctaattcccaattaattatttttatttttaacctttttaaagtgaccggttctttctctgtggcccaggctgtagactcctgggctcaagcaatcctccctcctcagcctccagagtagctgggattacaggtgcacaccaccaaacccagctaattttttttttttttttttggggagagatagggtctctctatgttgcctcactggtctcaaattcctggcctgaagcagtccttctacctcagcctcccaaagctctaggattacaggcgtgaaccaccacatctggtattaattactttcttttcattttgttttatcccatagtgcctgcattgatataggatgtcctaaaacattctcagaaaacttctccaccatgcaaaaatctcaatactctttctttctttttggaaccctgtcagtgttgctagcctgatgccattctcgaatgtacatcctaaagcttttatcaaagttgttcttgcatcagccctggaagttgaagagggattattgccctccttttacagatgaagaggaggctgatccatctttcaagactttctcttcacatgagtccccattcattctttcaaagttaccttcctagctgggtgcagtggctcatgcctgtgatctagcaatttgagaggctgaggtaggtggatcacctgaggtcaggagttcgagaccagcctggccaacatgatgaaaccctgtctctaataaaaaataaaattagccaggcccggtggcgtgtgcctgtaatcccagatactcgggaggctgaggcaggagaatcgcttgaacccgggaaatgaaagttgcagtgaaccgagatcgcgccactgcactccagcctgggtgacagaatgaaactcttaaatacccgggcgcagtggctcacatctgtaatcccagcactttgggaggccaaagcaggcggatcacttgaggtcaggagatcgagaccatcctggctaacatggtgaaaccccatctctactaaaaataacaaaaattagccgagcatcgtggtgggtgcctgtaatgtcagccactcaggaggctgaggcaggagaatggtttgaacccaggaggcagagattgcagtgagctgagatcacgccactgcactccagcctgggccacagagcgagactctgtctcaaaaacaaaacaaaacaaaaacacaatcacctttctgccagtctctcccagtccagagactgtactctcctccacggcttcatcttctagcacagaggttggtgaaatttttctctgattggctggatagtaaatccaggcaaaatcaaggatattatgtgggtacttataaacaaagtgcaaaacctgatttctacaaatattttattgacaaaatccaaaatgtaacattaatgagtctaggttttttttttggtaatctgggtctactaatgagaacatttgaattttcgtgtgtacaggtgacatgttgctttgtttaggttcaaagttagtgttcccatcatcatcatcaaatcagttataagtgttcatctgttaaaaaaaatccttaattctctggccagacaaaaacaggcagtgtagtttgctgatgatgcctgttctagacctttctctttttcttttccccaaatgttcactcaaccatgtctcatctcacaagatagctaaccagacactttaaaatatatatacacagtatatataaagtgtcgatggctgacaacagcttaatgtgtcaccacttcttaagaagcatagtgcatttacaaaaacactcttccaaggcttatttgcaaatcagtttctcaaagcttcaaggaaatatgattaccaaaaagtaaaagtattatcccgagaaaattgcttatagggaatatcttactagggagtttcgatgtggatctttgttttaataaaacaagcccagacagaaatcagtcagccaaggaaatgagttttgagactggcaacttcagtcaccactggcgtttttttctgcatctgtgaaaattcacaccccacagagatgaggcttcctttatcctacaaaaggaaatgctcttaattccttgacagttccctttccaatctgaaggaagttgttgtttcagcatgaattatcttttcagcaacaaaggtgaaagtgctacttccacttaaaggcaaagcactggcctttgggtcctattttcttgtgagattatttgtgagctggatgcagtgtttgattgttttaaaaggcagccgacttgtccttttggtatttatatgtatagcagaggcaattggaactctgggcattaaattaccgtaatgtgccagttgagaattctattcaagccagccaactccttcctcaaaattatatttttagtgtttagcagctgcaagttcccagaaatcttcaaagtgggatcacttatttcacccagtgcaagagctcttagctgctgccagtgtgagatgatctggtctgggaggcagttgggtacctgggaggggcgagagatcagaggccccctgggttgcccttagttctgcacttatttgcatatgcttccccttggtcaggttactgaacctctgagcctcagttggaaaatggggctaataatatctaccaaatggagctgctttgaggattcaaaataattatgaatcaaccaggcgcagtggctcacagctttaatcccaccattctgagaggccatggtgtaaggatcgcttgaggccaggagtcggagaccagcctgggcaacagagtgggaccttgtttctaccaaaaggaaacaattcgcagggcatggtggtgtgtgcctatagtcccagctatttgagaagctgaagtgggaggattgcttgagccgggagatcgaggctgcagtgagccgagattgcactactgcactccagcttggagtgcaggttcttttttctgtcttatgtattaaaaagaaacacattttcaacattaaaaacaaaaaaaaaaaaatcagccaggcgcggtagctcacgcctgtaaatcccagcactttgagaggctgcagcgggcaaatcgcgaggtcaggagttcgagaccagcctagccaagatggtgaaacctcatctctacaaaaatacaaaaaattagctgggtgtagtggtaggtgcctgtaatcccagctactcgggaggctgaggcaggagaatcgcttgaatccgggaggcggaggttgcagtgagccaagatcatgccactgcggtccagcccaggggacagagtgagactccatctcaaaaaaaaaaaaaaaaaaaaaaagaaagaatcacaaattgtcctaaggtagcagcagatgcattgagatgcccagtaaagggtgctgttggtctcagtgatgtgctcctatctcattctcctcctccttccctgcctggtcttttggccaccgtggcttaccgttatccccgcaaaacaggatccatttgcttggggagtaacaagcaactccccatgagaacacaggctttgatcaatagggaattgatcacttgtcacaaggaaggagagcatgggagtatcctccaaagcagtgtctcccgtgggaaagtgacaggagggttttatggaatgatggagaggggagagggtgtgtcatcacatgcagaggaggggtcctagtggcgcaggcacagggagccatcatgccttcgtgccagcacccaggttgcatgtgatggtaacggagctgtagctctctttagcaccgtcatgagaaagttcacttgagttcatctataaatcgctgggggaggtctgtcaggaggcggtgttaaccaactaggtgaccatatagggtttaggaagaaacaggcttcagggcaggagcctgtaaaacaggctgattgctcaaattgagcacattcctataatccctggagaccctgcctgtttgcttacaatactggtgcctgtgccagtgggtatagattggatgtgtgatacaaccaaagaagggcaacatctgcattggacatttattctactgtattaggagatggtgtaaaagaattcaccgttgctgatgtaacaaaatgcactgaaatgagtgaatttgtttttgtttttgttttttgagacagagtctcgctctgtcggccaggctggagtgcagtggcatgatcttggctcactgcaacctccacctcccgggttcaagcgattcgcctgactcagcctcccgagtagctgggaccacaggcacgcaccaccatgcctggctaatttttgtatttttagcagacacagggttttgccatgttgcccgagctggtcttgaactctgacctcaggtgatccgcccacctcggcctcccaaagtgctgggattacaggcatgagccactgcacccagcctgaaatgagtgaatttgcattaaccaacctactgattgccaaagaagttggcggtactacgaaaacactcagtactgattataccttgagggttggatttgcagacattcataccaggacaactccaggggtgaggatgagtgttttgcacgtgggaccttggaatgagaaagtgcttagcaaacagctgaagcagaactaagaccaaagaaaacggcagcctgtttgagtctgaggtcagagaaaagcagcaagtcccagcaggccagtgggaatcaggaaatagaaaatagagtcagcccctgatccctgggtcaggaaccatcatcatgatagaatttggagatatggctgccagagaacagagaccaacgggtggctggggtctaagagaatgtcaagagatgacaggtgtcagggaaaagcaagggtaagacatgacaccaccaggacttgtgcccaacaggtgactgagacagcgagccacatggtgacaagcaggcatccaagcgggagaatgtcaccaaacaggggaatgaggggtgggtggaagacactggtccaaaggggctgccttctggtacattctggagatagacactcccctgatttacaggctatggatcagcagattttgttttgttttttgtctttttttttttgagatggggtctcgctctgtcacccaggctggagtgcagtggtgcgatcatagcacactacagtgtccaactcccaggctcaagtgattctccagcctcagcctcccaagtaactgggaatacaggtgcgcaccaccatgcctggttatttttttaaaaaattatttttggtagaaatacatagtctcactatgctgcccggtctgttctcaaactcctggactcaagcaatcctctagccttggcctcccaagtgcaaggattacaggtgtgcaccactgcatctggttcacagtctctggtttctagctccttcttttctctccaccactggagcctgctcttcccatacctacagcctcactcattgatgtacaacacagggacacaagccttcaaccagaaatcattattattacattgtaatatataatgaaatagttctacaactcaccatcatgtagaatcagtgggagccctgagcttgttcctgcaactagagggtcccatctgggggtgatgggagacggtgacagatcatcaggcattagattctcataagcagctctcagcctagatcccttgaatgcacagttcacaacagggtgtgcacacctatgagaatctaatgccgctgctgctctgacaggaggcagagctcaggcggtaatgcgagtgatgggaaacctcatctgtcagtacagatgaagctttactcacttgcctgccactcacctcctgatgggcaacttggttcctaacaggccatcaactggtgctggtccatggcctgggggttgaggacccctggtatagagtagccaggcgaaaggatctatagggttgatggctggaaaggaattaagagaggcagagatgccaaggaagaacttgtacttaattcagaagggaatagtgagccactgaaggctttagaggaggggaagcatctagaatgaagatgagtcctttttcacctatgaaaagaaaacacaatgagctcaagaaagctgtatatgtcttggtgcaaatatcgggctgccaccctcttctcactgtctattccttttctgtcattcagttggaactgttgtgtgtgttgcatatatttctgtaacagcaccaataagtgattatttttaatttctgttcttctcttctgtaatggagctattaggctttggcagatcccttaatatgattatcatttttgaatgattttgaattgaagtgtttgcactcatggtcgtaatcgcagttgactttgaaggatgaggctggagactcacgttctctgatctcttcagcccgcaagtggtatcaactgcagcttccacagctgggtaggtggtggggacaccttggaagggaagcagcagccgtgctttgctcctgattgtcaggatgaagtggctggcctgccactcacgaggcaggtgccagatgggatgggtggtagcttcctgttggaggactgcccctccccagtcagaggacaaggacagctcctcgtttatcagtccaggcaggtagctccagaatacaaagcaggtgcccactgagctcgccagcaacgctgactggcctgtccatgggcagatatgtcttttttttttctttttaaatttgttttgagacagggtctcactctgtcacccaggctggagtacagtggtgcaattgcagcctcaacctcccaggttcaaatgatcctcccaacttaggctcccaagtagctgggactataggcacatgccgccacacctgactaattttttatttttcatagagacagggtctcgctatgttgcccaggctggcctcaaactccttagctcaagcagtcctcccaccttgacctctttaaagtgctgggattacaggtgtgagccaccatacttggctaattttttaattttgtgtagtgatagagatttttgtactttttgctttgttgcctgagctggtctcaaactcctgagctaaagcgatcctcctgtctcggccttccaaagtatgaggattacaggcatgagccaccctgccagggtgatatgtcctttcattatttaatgtcctccacaatgatccagttagacattagccacgtggcaggggtcttgccagctcccagcactatagggaagacttggtgtttgcagaacagaggctttctgcttctgcttccagggagggtcacctgctggggccagttccagcctctcctttccagcctctgtcaggctctgtaagcagattttgatcgtgacgggcaattttctttctttttttttcttttcttttcttttttttttttttttttttttttgagatggagtctcactctgtcacccaggctggagtgcagtgtggcatgatctctgctcactacaacctcctcctcccaggttcaagtgattttcctgcctcagcctcccaagtagctgggattacaggtgcctactaccacgcccggctcatttttgtattttcagtagagatggggtttcacatgttggccaggctggcctcaaattcctgacctgaagtgatctgcccacctcagcctcccaaagtgctgggattacaggtgtgagccactgcacccagccagttaggacaattttcctgtgacaccaacagcgaccatcgtcacacattcattccacatccccgctgcactgggcttacctcctgcccattcatctgtgggttctgatgaggcccgcctgggacacaggtggaggtctggtttcccacagcctcctgggcacctctgggctgctgacctgccctggcctggtttgaaggaagacataccaaatggagacctcaccactttgttgtgagaaatcccaggactcagagaaccctgtcatgtgtgctgagcagagctgtttccagcacagaggggactccgggcaagtcatgctgcgaagctttctctcattaccacacacagccacagacaccatccagataaaacccagttacattaaagtatcaggctgggccgggcacggtggctcatgcctgtaatcccagcactttcagaggctgaagcaggtgaataacttgagatcaggagttcgagaccagcctggccaacatggtgcaaccctgtctctactaaacatacaaaaattagccgggcatggtgctgggtgcctgtaatcccagctacttgggatgctgaggcaggagaatcgcttgaacccaggaggcggagactgcagtgagctgagatggcaccgctgcaccctagcctaagcaacagggtgagactccatctcaagaaaaaaaaaatcaggctcctgacggggaaagatgttgcccaaagggtaactgagagggatctgaagaagagggagcctgtctactcccctcctcagtgaaggtgatgtgatgagcttctgatccctctgtctgctcccctctttcctctctcctttcctctccccttctctactgtcctctccttcctctctctagcacttcatcctgctctcccttctccatctttcatccctccctcccacccctagttagagcacactcccctgatacccagttggtccctgaggcatcatggtgctcttccctaccaggagtcctccccagatctgttctgcacattcattcactcaacagtatttggtgagtgctctagctgctggaaataccatgagaaatgacaggcataacttctctgctctcagggagatacctgaacatctggtggggtagaaggctccacagccacagcatggtcccacagatacaaacacaaatctctgagtcccatctctggacccagtccatagttctggaccagacccaagaagctgcatttttttttctcttctcttttcttttttttttttttttgaaacggagtctcgctctttcccccaggttggagtgcagtggtgtgatctcggctcactgcaacctctgcctcctgggttcaagcgattctcttgcctcagcctcccgagtagctaggattacaggtgcgtgctactaggcctggctaattttgtgggttttgtttgtttgtttgtttgtttgtttgtttgtagtagagacagggattttcccatgttggccaggctggtcttgaactcctgacctcaagtgatctgcccaccttggcctcccaaagtgccgggattacacgcatgagccacaccacacctggccagaagctgcattttctaaggagttattgggttgatgctgatgcagtcagcccctagactgacctctgggaaacaacttttctgcacacagggcaatgcccaaagccaccgctttgggagagtttgtggcctgggcgctttctgtgattttaactaccctgtttgcctctgagaggttagaaagcagagtcttagagcagggtcttcactacacactcttgtcaatgttgggtgttttcagactccaagcataggcttttggggagattttttgtaacttatcagaattgcttgatgtgctcagaaacaccctctagaaaatggagctaacgccgaggacatctcccagtcccctgcttctgtgctgatgccagcatacccagggacctgtggcactagcatatctccataactcgggcagactctgattccggctcttccagaaggaatcttccctgtagccttcctcttctagctgcgagataaagcttttttttttttttttttcctgctctggatcataagtaggaggggttagcgtaggtcatcatcaccgtttggttgcaaagaacggaaacttatctaacactgtttatgtggagaaggaccgattgcaaagacacaaaggaccctcctgtaacttaggggcggagagcagagccagggctctcagcagatggaaagccaggattcctgggtggccagtcacccccacgtccatgtagtctccattgtacatctgcctcctccttctgctcaatcatccgtgtgcatggagcccctcaggaactgctcacggtggcggcctgagccctgaacgcgtgtgagcctattgagttctagctcccagagttgtcttcatttccaaagccaccccttcaggagaaacctaattccaagcttcagaggaaacataatttgtcctggcttgggatcagtgctcattttctggtttggttaactgaggccagggaatgggctcatttgatgcttttccagactaaaggtcaggctgcttctctaaaaggcgccaagagctgggaggaaatgatgcacattagaagccatgctttcccctggcatagtccagggtgaacctgctacaccagcaggagcaaggtcccgtttgcataagtgtgattggcatgcgatttctgtaaacacacagaagggcacctcccagtaagaaggtgaaggcgcattacttattgagctcctgctctgtgcactgggcccattgcaggttttctcttgtttaatccacacaacaataccctgtagagatttttttgtttgtttgtttgtttgagacggagtctcgctctgtcacccaggctggagtgcagtggtgcgatcttggctcactgcagcctccgcctctcaggttcaagcgattctcctgccttagcctcctcaatagctggggttacaggtgcacaccaccacgcccagctaatttttgtatctttagtagagacggggtgtcaccatgttggtcaggctggtctcaaactcctgaccttgtgatccgcccacttcagcctcccaaagtgctggggttacaggtgtgagccaccgcacccagccccttgtagagatttaacaggaatctagagtgctccattgacttatgcaattatagtcttcggtggcagcaccagcgtttaactacacatttcatgcttgtgccaccactgaaggtgaatgaagaggctcatccactgctgcctcaccacatgggtaccaagtggctttccatggaatcagaaacctggatgtgaaggtcgaagtcaagttagaagtcataaccagccgatgagggtccgagactacagtccaccctttggctccaaagaattccacctaatagcttcctggtggccccagtggagtttcaatggacctcctgcgtgaggtgtctcttttgcccagggaagcaccttaacggtgtttctggcctttggcagtgggggcatttgccagttcctccatgaagccttttctaaagcgtgcagtaaagcaaaagggctaaaatcaagggctttgaaggcaggcagatgctgagttctattctgtgactcagggcaggtcacctaatctccgtgtgcctcagtcgttcagtggagatggttctgcctccttcagtggattgtggcagtgcatacacgagatgtgcgtggaaagtgctttgcatcttgtgcttgagacaggaaattgctaaataaatggttgcaataacaatactaatttttgtattattcttatattcactcttagttgctcggatgacagaggcatgtctgctattttcccatctgctacagcaccagcaaaatgccttaaacatctttatctccatgtgtacccaatgtttagctccaaattacaagtgagaacatgcggtctttggttttctgttcctgagttaatttgcttaggatagtggtctccagctgcatccgggatctagagtacatccagccatagcaaagggcatgatttggtagatgctgagcaaatatttactcaatgaatttattatgtaagggtgactataaagtctggaaacagaggcaaaaagatataataaattatctattgatactatactacaatgcacaatgtaatacaatacaatacttaatatttatcagtgtgatttttctaatttacaatgcatggtcccatgcatcatacaacattgcaatgaacgtggtagaataatgcagcattcctgtcaaccactgcacatatatgcatgtgtggtattgtctcacatgatttatcaattgattgattgattgattgatttttgagatggagcctcactctgttgcccaggctggagtgcagtggtgcgatctcagctcactgtaacctctacctcccaggttcaagtgattctcctgcctcagcctcccgagtagctgagactaaaggcacgcactacaatgcctggctaatttttttatctttagtagagacggggtttcaccatgttggccaggatggtctcgatctcctgaccttgtgatccccctgcctcggcctcccaaagttctgggattacaggcgtgagtcatcgtgcccggctctaacatgattttttaagaattttggatacaagaggtacacgtgcagatttgttacatgggtatattgagtgatgctgaagtttgggcatctgttgatcccatcacctaaattgtgaacagagtacccaataggtagtttttcaactctcccctctccctccctacctgcttttggagttccgaagtgactattgttaccatctttatgcctgtgtgtacccaatgtttaactctcacttacaagtgagagcgaatggtatttgattttctgttcctgcattaatttgtttgttagctcggccagaagatgcattgcattttcaaaggagctgttgggttgatgctgatgcagttggtccctggactgaactctggggaacaacttttccacactagtcttgaatggctgtgtccatgctgcagcaaagggcatgatatcgttcctttttatggctgcatagtattccatggtgtatatgcaccacatttttttttaatccagtctacaattgatgagcacatgggttgatttcatgattttgctattgtgaatattgctgcaatgaacgtaggaatacaggtgtctttttggtagaactatttattttcctttgggtagatacccattaatgggattgtttggttgaatggtagttctatttttagttctttgagaaatttccaaactgctttccacagggtctaaactattttacactgccaccaatggtgtgtaagtgttttcttttctccacaccttgccaacatctggtgggttttgtttttttggttgttttttttttttaactttttaataataattgttctgacaggtggcctcacatggttcttgtctctaattttcaataggtcaacttgtgcctttagccttccccagaagaaacaaccaaggggatgaatttatacaaaaataaaataatcctttgtcccgacttcatggttactctacacgtgctctctttgtctctcctgctgagacctcctctctgcgggctgaggtcatgcccttgccatttatgatggatacctttaggcactaggatgtgtttcctccctgagtcttctcccttctctaaagaccccaccctggtccactttcttccagcataacgtggaaattggagcccttgcttgcaatcttcctctctccagtttcccattgcactcctaacttgctcattctctttttcctggggtggggagtggtgcatcttgcttctcacctccaagcttctttgagactgcacaaggaccccccatcccatcactcagctgtcaacagagtgcagcagggaccgcttcctatgtgtgcagacgccatgggatacgggagaccagcccttaccccatctatgagggagtcacattatccctagatgcttttgaagctaaaagacagcctcacaggctgggcatggtgtttcatgcctgtaatcccagcactttgggacgctgaggtgggcagatcacctgaggtcaggagttcgagaccagcctgaccaacatggagaaaccccggctctactaaaaatacaaaattagctgtgcatggtggcgcatcctgtaatcccagctactcagggggttgaggcaggagaattgcttgaacctgggaggtggaggttgcggtgagccaagattgtatcattgcactccagcctgggcaagaagagcaaaactccgactcaaaacaaaaacaaaaacaaaaaacagccttacagagtaacagagagaggaggtgtgggaattgagggaagtgacttgatttgctaggctggaaccagtacatgctaggctggaacccagtacatgctaggctggaacccagtacatgctaggctggaacccagtacatgctaggctggaacccagtacatgctaggctggaaccagtacatgctagaccggaaccagtacatactaggacggtgcctatggaagggcttctggcactgacacctcaatgagcttcccttctttctccctccctcaggaccccagccatgataggctgctcgttcgtggtcaacaggaagttcttcggtgaaattggtcttctggatcctggcatggatgtatacggaggagaaaatattgaactgggaatcaaggtttgtgacatggtgtcccttcctcttggtgtgcccatgtttgtgagcagagcgtcttggtcatccgtggggtgtatttaaagctccttacagctgatgaatgacagattcatttactccaccttgttcctgggggatgcatgagctgcactgtcacccctccttatgtagggaaacctgggctttcccctgtctaaaagttggctgataggtttcatgccattgctacccactctgggcattagctggagagggtggttcccactcccattcagttttggtctctccttaaatttttcttaaatgatctccttaaattaatattttcaggccaggcacagtggcttatgcctgtaatcccaacactttgggaggccacggtggtgcgatcacttaagaccaggcattcaagacaagcctgggcaacagagcaagaccctgtctctacaaaaaataaaaaattagccaagcgtgatggtgcatgtctgtgtcccagctcctctggagactgaggtaggaggatggcttgagcccaggagttcgaggctgcagtgagctatgatggcatcactgcactctagcctgggcaacagagcaagagagaccctgtctctctcacaaaggcatttgtggtttagtttttacatccgcagatttatttttaacagttttattgagatgttattgacatatacagattttggtggctcacacctgtaatcccagtgacttgggaagccgagtcaggaggatcacatgagcccaggaattcaaaaccaggctgggcaaagtaggaagacgctgtctctatgaaaaataaaaaaaaaaaaagctcatatatataatcccagggacttcggaaaccaaatcaggggggtcacttgagcccaggagttcaaaaccagcctgggtgacataacaaaaccaccatctccacaaaagataaaaaattagccaggtgtgattgtgtgaacctgtagtcccagctactcaggaggctgaagcaagaagatcgcttgagcccaggagttcaaggcttcagtgagccatgattatgccattacactccagcccaggcaacagagcaagaccctgtctcattaaaaaaaaaaaaaaaaaaaaaaaaaactacatgtttaaggtgtacaggtgatgtttggatatacatatacattgtgaaatgagcaccacaatcaaactgagtgacacatccattacctccatctaattaccactgtgtgtggaggctggtgagaagatttaatttaagatctatcctcttagcaaattaaaagtctacaataccatatcattaactgtggccaccatgctgtacattagatctccagaaatgattcattttgctttgcagtgacgtggcaggaaaagtctgagtgtgaggctctgcaggcttggtggtgatggtggtaactgcttagcaggcaagactgtgtggctgtccccaatccctaaagcaaggaggggactcctgggtccttccccagcagcacagtcctgtccaccaacacccctgtacgaccagattgtgggatcatgtagattctcccttcactccctattttttgtttttttatttatttattttattttattttattttatttgagatgaagtcttgctttgttgcccaggctgggtgcagtggtgtgatcttggctcaccgcaacctccatctcccaggttcaaacgattctccggcctcagcttctcaagtagctgggattacaggcacgtgccactgcacctggctaattttttatatttttagtagagatgggatttcaccatgttgaccacactggtcttgaactcctgaccttagctgatcttcccgcctcggcctcccaaagtgctgggattacagacatgagctcccatgcctggcctttaattaattaattaatttatttatttatttattttttgagaagtagtcttgctctgtcgcccaggctggagtgcagtggcgcgatctcggctcactgcaagctccacctcctgggttcacgccattctcccacctcagcctcccaagtagctgggactacaggcgcctgccaccttgcccggctaattttgtttttgtctttttagtagaaatgggatttcactgtggtagccaggatggtctcaatctcctgaccttgtgatctgcccacctcagcctcccaaagtgctgggattacaggcgtgagccaccacacctggcctattttattttttatttttttcttttaactttcattttaggttcaggggttcatgtgcaggtttgttatataggtgaattgtgtattacctgtattgataattgacacctcaatgagcacagattggtgcacagattattacccaggtagtaagcatagtacctgataggtagttttgatcctcaccctcctcccaccctctgccctcaagtaggccccagtgtctgtggttcccttctttgtgatgatatgtgctcaatgttcagttcccacttatacatgaaaacatgcagtatttggttggatgttcctgcattaattcgattaggataatggcctccagctccatccgtgatctccttcttcttacagctgtgcagtattccattgcgtacatgtacaacactctctttacctgttctgccattgatgggtatttaagttgattccatgtctttgctattgtgaatagtgctgcaatgaacatacgtgtgcatgtgtctttatggtagaatgatttgtattcttttgggtctatacccagtagtaaatgagatactgggtcaaatggtaattctattttaagttctttcagccgttgtggaaggcagtttggggattcctcactccttgttgatgggctggaatgaatggtccctgcagagcccagtctgcccccaggcaatttctccctggctttgtctccatgacaattcagctcccccactgctcagggtaggtctttattaaagtgtcacttgcatcagggtcatagatgtcactccagagtgcaattacctgcctcttacagtacttcaaggcatctccagcttctggagatgggggaataattttgcctcttaactttccatagaccacatcatcctgcaggctgcaaggtgatcttgacataagccttggttttctgccagttcttaaagtgggattgagtgctgctggttgcagaaaggcaaaggtctgggtttggagtctacacagaattctctggttctcatgtttccagtcagaagcattcacctcacctgggaacttgttagaagtgaaaattcttgggccccatcccagacctactgaatcagaaactctggagtggcagggagtccagctccctgtgtttaccaagccctcctaccccaccaggtaacttagttatgggcccttgttggagagctactggtctacccctaggtttagccgacttcctggcaaatgcatgtcctttagcagaaaggagcccaggtgagaatccacctctttctagtcccttctccaggtgcccttccatggccacactggcccaaagtgagtcctttcttctcactccagcctacacagccagagtcctgtaggcaccaacatctactacctttttaacttcatgtacgggtgtctcgaccaggtgactacagggttcctgatgacagagctccgtttttcaaatgaaataatatacacaaggcacttctgagacaatactacttctcctttcattttgtgctattttgtactacttagggcttgaatgaattgcataataaatgcattcttaagaaatccatccccaccgcctgaataaagaagcagggctttatgtaaatatatatacatgcatatatataattttcatgtagtgtacacacatacatttacatatacaagcttacctgtaagtaatgacccaaaaccctatgctttcattcaatggaaaatttttaacatgagaacactattttcttgatttttttttttttttgagacagagtctcgctctgtcgctgaggctggaatgcagtgacgcgatcttggctcactgcaggctccgccctcgagttcacgccattctcctgcctcagcctcccgagtagctgggactacaggtgcctgccacctcacccggctaagtttttgtacttttagtagagacagggtttcaccgtgttagccaggatggtctcgatctcctgacctcgtgatccgcccgcctcggcctcccaaaatgctgggatgacaggagtgagccaccgtgcccggccattttttttttaaaccaagaaatggctcaatctgtgatctttctaactagtctttgaaattttgtgttactttttaattccatcctcagtaagtaaagatctgtcagaagaacacaagaatagaaagtcttactgtgaacaaaaatagcagttgactctagggctcttgcctgcatgaaaggcaacttgcctgtgactaaaacaatcaatacagaaaagaagtttttaaaaaagccagaattgagaaaataaatgagatggaaattgaaaggtttcatcttgttctgagtaatagtaatcagaaactattaacaaagggtattatagtagcatgtctaaatgttaagagaaaaaaaaattctccaaggacagaagaaaagataggttactttaaaatgatgtaaagtcattctctaatatatcagtccatttacgaagaaaaggcattctcttcttctgttctcttatataaaaacatggcacccaagactgctgcgtcctgctggggagtcctttctaaaggaagacaagggagacacactttcagatccccaaatgaccaaagactgtcttgactttatcacgaatcccaaggactgaataaaaggcagaattcttgtgtggatgcattgaattgtgaaaacacttgtgagaatgatttatttattttgggtgtatatccagtaatgggattgctgaattgaatggtagttctgttttaagttttttgagaaatctctgaactgctttccacagtggctgaagcaatttacattcccaccagcagtgtacaagtgttcctgttctctgcagccttgccagcatctgttgttttttaactttgtgtgtgtgtgtgtgtgtgtgtgtgtgtgtgtgtgttttgtttgtttgtttgttttttgagacagagtcttgctctgttgcccaggctggagtgcaatggcacgatctcagctcactgcaacctccgcctcccaggttcaagtgattcttctgccttagcctccagagtagctgggactacaggcacacaccatacttggctaagttttgtatttttagtagagacagggtttccccatgttgcccaggatggtctcaaacttctgacctcaagtgatctgcccgcttcggtctcccaaagtactaggactacaggcacgagccacgctcctggccttgaatttttaataatagccattctaccaaaaagacatctgcattcatatgttcatcacagtgctattcgcaatggcaaagacatagaatcaaccaggtgcctgtcaacagtggatgggataaagaaaatgtggtacgtagacaccacagaataccatgcaaccctaaaaaagattgaaatcatgtccgttgcagcaacatggatacagtgaaaggccattatcctaagtgaattaacacaagaacagaaaaccgaataccacatgttctcacttatacgtgggaactaaacattgggtacccatggacataaagatgggaatgacagacaccagggactactagagtggggagacagacagcagccaagggttgaaaaactacctattgggtactatgttcactacctgggtgatggcatcggttgttcctccaaagctcagcatcacacacaacacccatgtgagaaacttgcctatgtatcccctgaaactaaaacaaaagttgaagtttaaaaaattaatacaagaaatgagctctccattcccagacacacacaaacacacgcacacacacgcaaaattttgacaccagtaagccatcatggaggaaaggatataagagggtttgaggatgctcaagtgagataaccttcttgccgattccagcccagccctcagggcctttccatggttcagcccctgcaggggtcttcttgttgggttccctgttgctccataacagtcaccaggaagcgattcagactctgagtccgtgttggcttagatgagtcatgatgagtgatgggcaaagaacaagcgtattttaatttgcactcagggtaaacataacattcttaaaaagcagagtttaacccagatgccttaattgctggttgcatagctcaagatgtctctgagccattccatttctctgaggagttggagtgccactttcaggactcaggtggagacatggttagaactcctgccatcttgtctagctctgtccattcaagctgaaggcactgaagacctggggggtggttcgcagactcagggtttcatagtgtctgagccaactgagatcacatcagcagtgggttttgaaggcttgctccttcggaggggttgtttacatttatttatttatttatttatttatttatttatttatttatttattttgagatggagtttcactcttgttgcccaggctggagtgcagtggcgcagtctcggctcactgcaacctctgcctcctgggttccagcgattctcctgcctcagcctcccagctagctgggattacaggcacccaccaccacgcctggctaattttttgcgtttaatagagatggggtttcaccatgttggtcaggctggtctggaactcctgacctcaggtgatccacccacctcggcctcccaaagtgctgggattacaggcatgagccatcacacccggcctacaatttttatatatatagacaaattctcactgtcatctaagctggagtgcagttacaaaaattatagctcactgcagcctccaactcctagaatcaggtgatcctcctgtctcagcctcccaagtaggtgggactgcaggtgcacaccactacaaccagctaattgttgttttttggttcttttgtagagatgggggtctcactatgttgcccaggctgatgtcaaactcctgacctcaagggactgttccatctcagcctctcaacatgctgggaccacagccgtgagccactgtgcctggccttatatagaaattatgagccatctggaatagccaaagccccaggaacctgaatgaaaacagcatttcccactcccacaggtctctttgccctgtctcttgttcttagttttgcttccctcttgtctacagctagctcttgcaaggccttctgcctgccctcctgatccccgccctagccacttctctatggttttagggacccatccatccatgttaaccaagagagatttccccctgccttctctgagacctctggcatcaggaaccctgatgtcccaaagccttctgtggcctgtgttgtccatttggaactctcgagctcaaatttgctacatccattgaataatgtaatttgcatcatggtccatcccagagaggaccagatgatcagtccgttttcattttcatactttttagattgcatgagtctttgttctctcacctattggcactggtcaaggttggatccaaggcctggtgtgaaggaagtcatccttggctatgtgaatacctttgtagggcagagcccaagtttatctgtgatacagatcaaagcaaagttcctggtcttgtcccagtatagagtgagccttgagatttcacaaactggtctttcatggaggggaatgtatgactggtggccaacagttcaactgaatacttctgattaaatggaaacttggtgagtgccttctgtagcccagcaggcatttccactggagctaccacagtcaatacatggggtctctatctccatgaaatttatagtcagacagaaatactgttcatgaaataaataattagcactgtgatgagtgtgaaaaaacaagatagagcaatgctgtgggaaaatatagtaaggaaatatagcctagtctagggagttgggaggaaccttcttacggaaatgctgtttaagaattctaaagtgagtttaatatagataagcaaagaaggaggtgtgcaaggaagaatattctagacagaaaaacatctgcaaagatttggaattctgagagataaatgtgtcctgaggaccttgggagttcaggatggttagagcagagaaagggggaagaaaacctcttagatgcagcgacaaccatcaaggtggggcccagattatgaggattgataagcagaaagttggctttttcttaaggatcactgtagacattttagataggtaggttaggtagacaaatagataggtaggtaggaagaaagagagagagagggagagacagagacatgatagatacatagattagagagagaaagatgcatggatgatggatggatggatggatagatagagggatgatagagatagatgatagattaatgatagagatagtaggtaatagagatatagacgatagagatgatggatggatagatagagatgatggatagaatgatagattagatagatgaaatatataggtatggatagattgatagattatagattagattgataatagagataacagatagatggatagatgatatagatagatgagatataggttagatagagatgatggattcgatagatgattgatggatagatagagatgatagactgattatatagacagataaatagatgatagtttgatagattagatagatgatagataagatacatggatgatagatgtagatgatagatggatacaaagaagatagatatagatgatagattagacagatgatatataaatagatgatagataaattgatagatggatgatagatagatagatagatagatagatagatagatagatagatagatgagacatagatagtctcaagtacccattacttaccacccttgaggggatttaaaagaagtaagaggattagacttttctttttactaaaaagataatgatgacagccatgtggaaaatagatgataaagctgcgtacactcaggaaaagctggtgaggaggggcttgacctatatggttgtgacagtgggagaggaatggacaaattcaggaagtggaagagacaaggcctggagattgagtgtatgcaggggatgaagagaagtgggagtccaggctgagcaggtgggaaatagtgttgctgttctctaaggagcactgttggaggaggtttgggagaaggtggaaagattatatgataaatctcatgtttctgagacaccccaggccagcccagaggcatttgcatgtgtggggattaagccaaggagggagcactaagcctgagatagacttggatgtaccggtgccctttaggaggtgtgatagacagagagtggttgtattaatctgttcttacactgctataaagacatacctgagactgggtaatttataaacaaaagacagttaattgattcacagttgtgcatggctggggaggcctcaggaaacgtacaatcatggtggaaggggaaggagaatcaaggcatgttttagctggtggcaggagagagaccaagcaagggaggaagggctaaacacttttatgttttgttttgttttgattgagacatagtctctcgccctgtcacccaggctggagtacagtggctcaatctcagctcactataacctccatctcctgggctcaagtgattctcatgcctcagcctcccaagtagctgggattacagatgtgcactaccatgctcggctaatttttgtatttttagtagagatgaggtttcaccatgatggccaggctggtcttgaactcctggcctcatgtgatccacccgccttggcctcccaaagtgctaggattacagctgtgagccactgcgcccggccacgtttaaagcatcagatctcgtgagaactcactcactatcataagaacagcatgggggaaaccaacccccatgatccaatcacctcttaccaggtccctccttcaacgcgtggggattacaatttggattacaattcacgatgggatttgggtggggagacagaggcaaattatatcagtggtggtccactgaatgagaggagtgaatgagaagggattattaagggtatctcccaggcttcccagcaactgactgcaatcccctaaatagaggactctggtagggtaggtttgtcagtggggacatgagtagttccattttagaaatgctgagtttgaggagtagcagttctctctaacctgacagtgagatgtcaagggaacacaaggctgggaagggactctggccaagagtgggatttggcagaggggtgccaggacaagagttggctattctccattccaccctggagtctgcaaggccacagtgcttagggtgtgggctgacttagaggagcgaggacatagggattcctgctatggtttgagcgtgtgagttacagcaggtagtggccatatgtgttatacctggtgggaatgtaaactagaacaatcactatgaaaaacagtatggagattccttaaataactaaaagtagaactacgatttgatccagcagtcccactactgttatctacccagaggaaaagaagtcattttacaaaaaagatacttgcacacacatgtttgtagcagcacaattcgtaattgcaaaaatgtggaaccaacccaaatgcccatcaatcaaagagtggatggagaatctgtggtggccgggtgcagtgcctcacacctgtaatcgcagcactttgggaggtcaagacgggcagatcacgagatcaggagatggagatcatcctggccaacatggtgaaacactgtctctattaaaaatacaaaaaaaaaaaaaaatagctgggcatggtgacatgcgccttagacccagctactcgggaggctgaggaaggggaatctcttgaacctgggaggcggaggttgcagtgagctgagatcgtgccactgcactccagcctggtgacagagcaagactccgtctcaaaaaaagaaaaaaaagaatctgtggtatatatatacaatggaatactactcggccataaaaaggaatgaattaatggcatttgcagcaacatgaatgagattggagactattattctaagtgaagtaactcaggaatggaaaaccaaagatcgtgtgttcttgctcataagtgggagctaagctatgaggatgcaaaggaataagagtaacacaatggacttcggtgactcaggggaaagggtgggaagggggtgagggaaaaaagactacaaatagggtgcagggtatagtgcttgggtgatgggtgcatcaaaatctcacaaatcgccactaaagaacttactcaggtaaccaaacacccccgttccccaataacctatggaaataaaaaataaaacaaattgggaaagtaggattttaaaaaattgaagcctatcatctttttttcccctcccgaaataattttggggaaaattagtttttcaaaatgtttacaactttcacatctctgctccatactccaatttcaggccagtatgtgggtttctgaatttctcaactggagtgcagtagcaggatcgcgactcactgcaacctccgcctcccaggttcaagcgattctcctgcctcagcctcctgagtagctgggaccacaggggcacaccaccacgcccggctaattttttgtatttttagtagagatgggatttcaccgtgttagccaggatggtctcgatctcctgacctcatgatccgcccacctcggcctcccgaagtgctaggattacaggcctgagccaccacatctggccacctgtttgcctctatgtcacctgccaggaagagatagtcaggcccccgtagcccctccctagagctgcagatgatgagctgctcacctgtaagtttgtctctgcagtggcacctttttcttccagctttcactgttacacaacgtactcagcctcagtgcagaacgaagttttattggacatggaaaaaggggaaaaattaaacagattccctggcattagatagcagggccattttgctatctttattaaaatgtattgccatcctcttaaagaagagtaacaggctgatctatgtagaaagctataacatgcacatgcatgaacacacatgcacacacacacacacacacacacacacacacaccacacaccaaacagcccttcctcaagagaccttccaaacgatgtccaggaccgtgaagtcagttgtagactaaggtcctcctggctgggcgcggtggctcacgcctgtaatcccagcactttgggaggctgaggcaggtggatcacgaggtcaggagatggagactatcctggctaacatggtgaaaccccgtctctactgaaaaaaaaaaaatacaaaaaattagccgggcgtggtggcacgcgcctataatcccagctgctcgggaggctgaggcaggagaatcacttgaacctgggaggcagaagttgcagtgagccaaggttgcgccactgcactccagcctgggagacagagccagactgggtctcaaaacaaacaaacaaaaaagggcctccttcttagagtttcttaaattctgtaatgctaaattttatacagtctggaaattttcccccgagtggatgagaggtttagattattttgtctcactgtttttttcccttcaaaacaaactggaaaatgaagaattcagtcattacattttatgctaatttcttttattttaattcaacatttttgatggaaaacttgaaacatacacgaagatagcacagcataatgaatccaaatgtactgatcattcagctttaacaaatattaacattttgctgtttttttcagttactgctcattgactttttaaaaacaaatccccagacatcgtctcattccatctataaatactttacagtgcattgccaacatataaagactctttaaaaacatagtctcgacataaaattacacttaggaaaatccattacccagtccatgttttctcaaaaatatttctcaaaactcagttatattttctcaaaaaaatttgtttgatagtcagcttactcaaataagaatcccagcaaggtctacacactgcatttggctgatgtgtctctaaagtatctttcaatctgcaacatttcttctcacctttatttatttatttatttaatttatttattttgagacagagtctcgcgaagtgcagtggcgcgatctccactcactgcaagctctgcctctcgagttcacgccattctcctgcctcagcctccggagtagctgggactataggcgtccgccaccacgccaagctaattttttgtatttttagtagagacggggtcttctcacctttattaatttcatgtcattcatttgtcaaagaaaccaagtcatttgtcctatacaatttcacacaatctggatttagcagattgatgtttcttgatgtctttaacttgttcctttaatcttctttttatttttctaagctgtaattagatctacaaggttgattacttcttcctttattttttcctttctttctttttggcaagaacactttaagctctgctatgaacttcctagtgctgacattgggagatacataatgtctggttatctcactgtttctgatgttaggattcaacagcaggttcaggtgttgtcagcctgattgattcattataaagctccccatcaatctttcacttaattaatggttttagcagctaccaatgatcactgcctacacccattaattcattagggcctacggaatggtgatttttagactctacactcattctgcatttataagctgtaattcttccattaaaagtaacttttcctactcaactatttgtgtattctgaaatacaattcaaaccaggaaagcaggataaatgcttgatttcttctttttatttaaacatcttcagaataatgagttggtgtcatagcaccctcttaagatgaccaatgaggttttcttttttttcctcaataatatggactcaagggtttttttttaaataaatattttatatgtctaaatccattgtcattattcattttttgcccactgtatatttacttttattaaagcataatttaatacagtccaatgtacagattgccagtcttcagtctgatgaatttcacagtctgattaatatatacccctataatcacctctgaaaacctgacattggacatttctgttgcctgagaaagtccctttttcctatcagttctttcctcctccccaccccacacttcccgccccagcaagcatttcctgatttcttttttttttttttgagaaggagtcttgctctgtcacccaggctggagtgcagtggcacgatcttggctcattgcaacctctgcctcccaggttcaagcaattctgcttcagcctaccaagtagctgggactacaggcgcctgccaccacacctggctaatttttgtattttagtgtagacgaggtgtcaccacgttggccaggctagtcgcgaactcctgacctcaactgatccaccctcctcagcctcccaaagtgctgggattacaggcatgagccaccgcacccagccctgatttttatcaccatagattagttgtgtctgttccagaatatcacataaatggaatcacatcttatagtctctattgtatctgacttctttcaactaaaggaatgtttgtgagattctccatgttgcagttgtgtgtatctatcagcaacacagtctttgtcgtttactgagaagtattcctctgtgtcaatatatgacaatttgtttattcattgtcctactgaggaataattgggttgtttccaatttgggactggtatgagcattcatataaaagtcttttatgaacatttgtttagatttcgcttgggtagatacctaggatttgaatagttggaatatctagaagatgtgtgttcaacttttaaagaaactgtcaatcaggtatccaaaatgtgccattttccactgttccacctcttttgcagtatttggtattgtcagaatctattttaccaaacctagtagggttttttttttttaattgcatggcacactgaaaggattcttttatttatttatttttattgacacataatagatgtacatattttgggggtacatgtgataatttaatatgttcatataatttgtaaagatcaagtcagtgtaattgagatatttatagtcataaatatttgacttttttctaaaaacattcattctcttctagctgttttgaaatatataaaaggtaatggtatacaatattcaccctactgacctatcaaacactaggtcttatttcttctatccaactgtatgtttgtatccattaatcaagctctcttcctcctttctcctctctaccttttttgttttttgttttttcttttttgaaacaaagtcaatctgtcacccaggctggagtgccatggtgtgatctcagctcactgcaacctctgcctcctgggttcaagcgattctcctgcctcagccttctgagtagctgagactataggcgcacaccaccacaccaggctaatttttctatttttagtagacatggggtttcaccatgttggccaggctggtctcgaacttttggcctcaagtgatccgcctgcctcagcctccaaaagtgctgaaataacaggtgtgagccaccgcacccagccacctctttaccctttgaaggggggtacttcagtatggttttaatttactcttccttgaaggaggatgagcacctttttttgagcttatagttaatttgtgtatctccttttgcccatttttaaacatcatgttttttcattttgttgttgatttccaggggtctgtggtatgtattctgggtactattactttttcagtgatatgtactatgtgaatatttttctactgtctgtggcttgtctgttcattttcttatgtattttcttctagaaagtttatatggttctatctttcacacttaggtctatgatcataaaggccctgctgaaaacataagagagtatcttgctgtgggtaatacttttttgtactgaaaacattaaaaaaacactaataaagaaaaaatgataaatttgacttaaaatgtaaatttcagctcatctaaacaaagtattaaaaaatgaatagccaagccacatgccgggaaaaatactcataatgcctgtaactgatgaaggaatcttatgcagattatgtgtaataaatcctaaaagtcaaaattaaaatattgcaaaaaggcttaagcagccactttgcagaacatccttgctttctggcacaagaagaagttcctgtcctgtcttgttatttactgtcctagacctggaattggccatttctctaaggaatcccaatcccttccaatgggaaatggtatttagagaccgaagtcttgtcagtgagggtgctcattgccactaggttgccattgtttctaagccttttccatgaacaaagctagacaacactgatttttgtttttttagaaagagtaaggtaaatcattatttcatactaatgtcttctgttcaaatttgtaattaccaggtatttacttcttatattttatatttacttttcactgaaagtcttggttcttattgacatcatttcttatttgacttatcctacaatatataaataatagtttcaaaataagaatactaacaagttgattggatgaggtttaatatttctttatggtttgttttgtccctaggatatattccattatagatgtacaaccaatgtctttaaaattatttgacataattttctctgtgtgattataccacctccttgatatagactattagagctatatggcattgaacaattaagttcacttttgttttttcttttctaccgaggctacaagtcagttaactaaactcagttgacctaaaattttagcattctttaggtattgctgtgtagtcacagccacatgcaccaaacactctgcttttaggttgattctacccagcactctcttgggccttcagttctacaatgtcggacaacccatactcccagagaagctgccaatctggacttctgcttaacatggatttgttttgtgtggtaatttgtgccagtccaccatcactgtggctggtctcatgaatccagctggaagctcggtgattactattattgctacagcactggggaaaaatccaagaacttccagacataagaaaaaaaaaaatcctccaccctccctcccccaaattaccctattgattgtcaaagctaaactatatctttgcataccaaaactgagccagagaggacacatagcccacataagggtcaatacggggcccttaaaaagctaaacgtgggaagtgagtgtcaagaaacaccagcactgttattagtgtgtggaggtagcagagaacagaatggactgctcggagaaggaaagagaagccacaatgaggggaaaccatagactggtcttctttgtaattttcattgagaagcactttttgcaccacagttagtctgtattcagagtacttagcttactaaggcaagctggcaggtaccagttttgagaatgagttcacacaaatgttattacgttaaatgggacaaaggagaacttaaaagtaatacctagccaggcacagtggctcacacctgtaatctcagtgctttgagaggctaagacaggagaatcacttgagcccaggagttcaagaccagcctgggcaaaatagggagacccgtctctacaaaaaataattacccaggcatggtggtgtgcccttgtagtcacagctactcatgaggctgaggcaggaggatggcctgagcccatgagtttgaagctgcagtgagctataatcataacactacactccagcttgggtgacaaactgacaccttgtctctgaaaaaaaaaaaagaaaaaagtaatacctactgtggattgccactaacagtactccagacactgtagtaaacgctttataaacattacattattcagtgctcgtgagatttctgtgcgtttttcattattgaacctattttacagatgataatactgggattgacacaagtcaacttgtccaaggtcttacagctaataaatagaacagccggaactcaacccaaatctacataatttgagttctatgaggcttgcgacctcttgcttggaatttattcatccatataactttattcttccaccatctggataactgtgacaatattgcagatacacggtgacgcagtcatatggtaggtgctatggatgatgcttgtatataatgcatatcataaaacaattccatctgcaatagattatgttcataatctttatgtagacacacagataggaaccatgcccgtacatgtatttcatgtactacactatctcatatatagagaactgtagttatgtaataaacaaaaatgtgtttgaaacagcatgaaattggatttcctcatccataaattgtattatatttatgtcgaagttatagttcaagaaatagaactgcaatgttgatatttttataaatgatgtctaatgtatttctattaaggggagatagatttgctctgctgaaatgtattatcataatagccaaaccatttactctaccactggaaaatagtgtggtattctgtttggaatttcacttgcctgctcccagcctgccagatctattgtaaattattgtaggcatctgtgagttattttataggaagcatccatctatttttataactccaaaaagcctgtcactctcattcatctccttgggaataaagcaataatttgattctctataaatgtgaacctgaatttacaccatcctctccagttgggactttagtgatgtgggtgatttatggctctgggtttctggggcaaggccctaggagatgacatcctgatgtgcttgttgtcattttctactatttccacagaaaaagggaggggactcaacctgcccctattctatttagggcacaactatttgttccctgtccatgtagccatgttgaatagcactttctttttgttgttgttgtttgtttgtttgttttttgagatggagtttcactcttgttgcccaggctggagtgtagtggctcgatctcggctcactggaacctccgcctcctgagttcaagcgattctccagcctcagcctcccaagtagctggaattacaggtgcctgccaccaagcacaagtgggattacaggtgcccgccaccaagcacagctaattttttgtatttttagtacagacagggtttcgccatattggccaggctggtctcgaactcttgacctcaggtgatccacccacctaggcctcccaaagtactgggattacaggcatgagccaccgcgcctggccatttgtttggttttgagacggagtctcgctctgtctcccatgctggaatgcagcggcttcatctcggctcactgcaacctccacctcatgggttcaagcgattctcctgcctcaggcttctgagtagctgggattacaggcatgtgctatcatgccgactaatttttgtattttgagtagagacagggtttcaccatgttggccaggctggtcttgaactcttgacctcaggtgatctgcccacctcagcctcccagagtgctgggattacaggcgtgagccaccaccacgcctggctctaggcctgttgaatatcaaatcacaaggaacagctgtaagggtcccgaattgctccctgcagccctggatccagcagttgggtagatgtctgtgaaagagccatagggactgtgatgtgctcagccttccaggacctccactgcaatttcttacattttcagagcttccacaggaaattagtcgcatgtctgggaaactcctcaggtatttgcaaccaagttatctatctatggtttcccatcttttggctcattggaaatgggctcatctgagaaatgtcactgttgattgtttgtttgtttgttcgtttgtttgtttttgagacagagtcttgctctgttacccaggctggagtgcagtggcgtgatctcggctcactgcagcctctgcctcccagattccagcgattctcctgcctcagcctcctgggtagctgggattacaggcgcatgccaccacgcccagctaatttttgtatttttagtaaagacggggtttcaccatgttgcccaggctggtctcgaagtcctgacctcaggtgatccgcctgcctcggcctctcaaagtgctgagattacaggcatgagccacagcaccctgccgaaatgtcattgttttatttcctcttctcttgcaaagatgccaagggcgcagatggagctgtccgtctgtcagttgcctgtggtgctgtgggaccaatgctttttgtgcctggaactgtggatgcttccagggccagggaactgggcagtgggaagagtctgaattatcacttgaaggaggagatgccatgagcaggaaggaatcaaggctggagtgtgtaaaccaaagcactggagagccaggaagaccagaggaaaaatgatggaccaggccaagcgatgcagagactgggtccagaggagccacttgagacaggtcgggtctttctggcgcccacactgtctttcctatgcattttgcagcatgacgcttaggtgggctggctgccagctgtagtggcaagtgcctgtaatcccagctatgcgggaggctgaggcaggagaatcacttgaacttgggaggcagaggttgcagtgagctgagatcgtgccactgcactccggcctgggtgacaagagcgaaactccatttcaaaaataaaataaaataaaataaaataaaataaaataaaataaaataaaatagcatagcatagcatactaaaataaaataaaataaaataaaataaaataaaataaaataaataaagcatgcagagtgaggcaacccattcctcagcttcaggacccacagaggaacctggattcatgcataaaacgcctctgacatctctttatgattttctcagtctggatggtttctgctgggggctccccctgattggaaacatttgtccttgaacatcatttttgaagtattatataccagcctagctcagcaagaaaagtactcatgccagtgaccatcattattgtggaagctcttacttaaatcagttagggctgagcatagtggcacattgcctgtaatcccagtgctttgggagggagaggtgggagaattgcttgagcccaggagttcgagaccagcctgggcaacatagtgaaactcttgtctctacaaaagctttacaaaattagctgggtgtagtggtgcacacctgtagtcccagcaactcaggaggctgaagtgggaggattgcttgagcctcaggtggttgaggctgcagggagctatgattgcacccttgcactgcagtctaggcaacagaccaggaccttgttgcaataataataataataataataataataataaatttttaaaaacaattagttttgggacaagaagtctaaatggaaatttcatggatagatttaccaatatttttcttccttttttttttttttttttttttttgagacaggagtctcactctgttgccaggctggagtgcagtggcatgatctcggctcattacatcctccgcctcctgggttaaagctattctcctgcctcagcctctcgaatagctgggattacaggtgcgtgccacgacacccagctaatttttgtatttttggtagagacagggtttcaccatgttggctaggatggtcgctgtctcttgaccacgtgatctgcccatcttggcctcccaaagtgctgggattacaggcgtgagccaccacgcctggccccttgacaattttgactctcacccttgaagctactgtctgtagatatgcagaatgtcatggatgggaacttcttcaatggagacccatatgcaaccagtgtctgccttacaggaaacaaagtggtacccgtttcactattttctcatgaattcccttcccttttgaaaatctaaaaggagaatgaggagaatgcattgtgcgttggacaactccacaaattttaaagcattcaagtttagaaatacagctttgtgctttctccatgtgacagaaatggaaagaactaaaactacatatttttctaagcttgcttttagacttttctttttctaaactttctgggggcgcgttcagattccagctctcctacaagaacaaccacgcagggaaattacaaatgtccattctccagatgtaagaggccaaaggaatgtgcagatttcagtgaaaagctatcatttttttttaatgttttggctcttgttgacacacatcaagttctcctttttttgctcacccagaaaatcagccatctctttgggcttaaatggtgatgggaaatttggggctctttttggaacgttatcaaaggaaaattatgcgggagacacagggaccagctggggtggatggtctgagtctgagaacacctgggcaggtttggggtttgctctatgtgactggagggagctctaaaggtactcaaagtacctaaagaaccaggattatttatttatttttttaagacagagtctcgctctgtcacccaggctggagtgcagtggcacaatctcggctcactgcaacctccgcctcccgggttcaagtgattctcctgcctcagcctcctgagtagctgggaccgcaggtgtgcaccaccacacctggctaatgtttgtatttttagtagagatggggttttgccctgttgcccaggctggtctggaactcctgagctcaagtgatccgcccacctcagtctcccgaagtgttcatattatagggattagccactgtgcccagccagaaccaggatatcatgagaaactctagcaaagctgttaagataggaagagatctatgctcaggcagaaggggaggaggcaggcaggaattcttgtgaaccagacaagtaacacatgagatgagcttgaggaggttggtcgatattccagttctagctatgtagcaaatagcccaatagtaaatggtttaaaataactgtaatcattttattatctctcctgtgcaccaggaattcagataggaaatagtgtattatgggttgcattgtgtcctgcaaaaggcatgttgaagtccttacccctggtgcttgtggacatgaccttattgggacatagagactctgcagatgtaatctaggtaacatgaagtcattagggctggccctaatccagtgtgattcatgttgtgataaagagaggggaagacacagatacacaaggagaactctatgtgataacagagtcagaaattaggatgatgtagctccaagccaaggagccccaaagactgatggccaccaccaaaagctagaaaggagatgaggaagagggttggatgcagtggcccatgcctgtgatgctagcactttaggaagccgggacctgagaatcgctagaggttaggaaatcaagaccagcctggacgacaaggcaagaccctgtccatacaaaaaataaaaataataacagtttaactgggcatggtgtcacatgtctgtagtcatagctactaaggaggttgaggtggaaggatcacttgaagccaggaatttgaggctacagtgacctatgatggtgtcactgcattccagtctgggtaagacagagggagactctgtctcaaaaaaaaaaaaagatgcaaaggaaagtaaaaaaatccaggatgaattgatagtcatgataccctggaagatttaaacagctgggctggaacagtgagagtttcttgggcatttctttctgtgtatctacagttcctctcctggtcttcccagcatgatggctttgaagacgccatccttcatatgtgttggctcaagactcctaagatgcatagagagagagactgagacacacacacacacacacacacacacacacacacacacacacaccatattgcctgttatgatctaaccagaaggtcaggcagcaacactgccatcacattccattggccaagacaactacagatattctcccagttccaatgaccccatctttcagtggaggatggtcaacatgacacgcaggaagattgtgggggatgagatttatactaatgtagttgtctttggaaaagacaatttgttgcaggaatcaatgggagatgaggatcccataaagggcaagagagtagatgttggcaaacgtgagattaatctgctttgttttttatattctttgcgggtattgaaaatgggattgatttcttgatttgttttttgttgttgttgtttcttgtttgagatggagtcacacattgtcacccaagctggagtgcagtggcacaatctcagctcactgcaacctccgcctcctgggttcaagcaattctcctgcctcagcctcccaagtagctgggattacaggtgcccaccaccactcccagctaattttttgcatttttagtagagacggggtttcaccatgttggccaggctggtctcaaactcctgacctcgtgattcgcccaccttggcctcccaaagtgctgggattacaggcgtgagccactgcacctggcctgctgctttgttttttaattcaacagctcatgcatgttgaaagcccagtgggaaagatccatttgagagggaaaggttgaataaacaagagagttaaaggattatcgataaacagtgcaaagtacctgcaaagacagaggatggaatctgagtacaggtgtaggaactgccttaggagaagtcagggcttctctagtgaaatgggagggaagaaggggagtgtggagatgtttcttcagtttgagtttgcaaccctgaagatgagcaggtttgtgggagatggctcctgcttcctctgtgcaatggaagatgtggtcatgtgctgcaagaaaaaggcagaagcaaggtcagaggtttaggagagttggctaaactgtgaaacactcactgtgactattggaattgccttaatcacaggcacagagtcggggaccacttgtgggtggtgatcagggcccatcttccctgcaataagggaccctagcaacactcaggacatgagtttgggctggaggagacccactcagggttgaggctttgccatctgtgtacaacaaaatgacagaggggccaggcacagtggttcacacctctaattccagtgctgtgggaggcccatgcaggagaatcacttgcagctaggagtttgagaccagcctgggcaacatagtgagatcccatctctacaaaaaaagggtttcgtttgtttgtttgttttgaggtggagtcttgctctgttgcccaggctggagtgcagtggtgcgatctcagctcactgcaagctccacctcccgggctcacaccattcccctgcctcagcctcccaagtagctgggactacaggcacccgccaccatgcccggctaattttttttgtatttttggtagaaacagggtttcaccatgttagccaggatggtctcgatctcctaaccttgtgatccacctgcctcagcctaccaaagtgccgggattacaggcgtgagccaccgtgcccggcctacaaaaaagttttaaatgattagctgagtgcagtggtgcatgcctgtagttccagctacttgggaggctgaggcaggaggatcacttgagcccagaagttggaggctgcagggagctatgattgtgctactgcactccagcctgggtgatggagtgaatccccaaccttaaaagagtaataaataaataaataaataagtaaataataaacaaacatttctgaatttcacatgcaagaaagtgagctgaatgtggtgtcagagaggaaaggcagacaggaagggcagctggcctagaggcgttacagtgatggagggttgtcagcagatgagccatggtgatttgtgccccatgtcacacaaatgcagtgttggagaaccaggaggccaaagagctttcctggcagaggttgtgggactggccccatctctgggttccctggcagccggtgcttcgtgattaccttgcttgtcaatgtgggacctgtgtagtgtcgtctgccccaagttcttctcagtgcccctcaaagtcctcatcctactgatcttggcattcactttttctcatgatcccctgctccctgctgtaataacacggtactttcatttcctttttttttttttgagacggagtctcactctgtcacctaggctggagtgcagtggcgcagtctcggctcactgcaacctccacctcccaggttcaaataattctctgcctcagccttccgagtagctgggactacaggcgcacgccaccatgcccggctaatttttgtatttttagtagagatggggtttcaccattatgcccaggctggtctcgaactcctgaccttgtgctctgcctgccttggcctcccaaagttctgggattacaggcatgagccaccgtgcccggccggtagtttcattgcttattatgatagtagaagtcattttctaattcagaacacaggaacaaaactcatattctagaagagatgtgtcactctgataatcctggttgactccctcaaaagcagcggagtgtgtcattaacatgctgcagttgacaatgggtcatcagagatataggcaatgcacccatataggcatggatctcacatatgtgaagatgaaatagctgtgtttagtatttctcttacctggatttagtggtagttttttgtttccagtgtattttggggctttgtttggatgtctttttattcttttttaatttagtagatttcagatagaaagacctaggagatccatccataggaatgagatgtctcaacaaactatctagaaatattctaacatggacttgagatgaaaagaatctatggaaatgcctagacttcaatcggcatgcaaacatttattgagcgtctactaggtgctggcactctgccaggcctggggtaatcagaggtctctgagttgtggagacattaagtgactaagcacacagaaatgggcagtagcaaatcgggtaaatgatcagaaggaaaagtactgagtgctatgagaaagaacgggggggattgcgtggtgggtggtgggggtggtgtcggtggtcttagttgacctgtctagggaattgcatggaagcatggcttgaaagtggaagaagatagccaggcacagtccaggcagagagcaggactcataggggcctcaaggtctggaaagaaatgggtttgttgagttccaggacctggggaaggcctgtagctgagcagaacagtgcaggctgagagtggtgaggttggaaaagcaggaagaagctcaatcttacagagcctcatgggacaccatgagtcttgggaactttatctcaactttaatgagaaatcattgaagggagaaccacatgatcccacatgggttcagaacagacttggttagggacagagcctaagaggagactgacttggtccaattgcattgggaagccctgtatttaagggctttgctttcttttatttaaaggtttgttgccaccctctgacagtgaacctctaagggtctctggaggatgactgcttgggcaaagacagccagaattgaggtctgagcagggcctgtgagcctcacttgctgtgaaagtgtggtcttggctagtgtctccagcagccccaagtttgagtcttgttccaccccgcatcattctgtgtcctcttaaaaaatatccttccctctactggagcagctctgaataccagtcagggaccagctgaattttaagcctaggctgtttcttctgcctgagttgaggaccctagagggcacttgggggtcacccatcagagcagaatttctcacctagacattgatatctggtgggtagaggccagggatgcttctaaacatcctacaacacacaggataccccccccaccccaccttaagaaattacctagcccaaaatgttgacaaacatgcaataataattgcactattgcaattgtgcagtcataattgcactgttgacaaatatgcgataataattgcactattgcaattgacattttgggctaggtaatgtcttattgtggggtagagggtatcctgtgtgttgtaggatgtttagcagcatttctggcctctacccaccagataacagccatgcctcaccccccagccaagttttaacaaccaaaatatcttcagacatggacaaatatcccccaggagagaggacaaagtcatccttgcttgggaaccatggatttagaacatgacttcccaagagggtaatacgccccccacctcaaggagatagaacattagttttggggggcccaaaatcttagatgttatagtggtttgtagttgaccaaaggagccacagtgtataagcagatgtacagcagatccatggtattgaaatttcatgggaaggaaggcaattagggaaggaaaaaaaaaaaaagtctaaaggctcctgggcaggaatagggggatgataataaaaaaaaaataagaaagattgatttagaccaagagagagccagtttttcctggaggataggaaactggatattgaactggggaaccagagggtacattgggaggatcaggcaggggattagcaaggcacggaaaaccagagactcatggtcataatgacacctaactgtaatcattccccacgtgcccggtaccgtgcccagtggtctgagtgctcacagcaacaccatgatgcagctgctcttatttatctccaactttatagataggaaacagacagacacagattaagcaatcagcagagccgtaatcagatgtccaagtccagagccagtgccctttgccatgatgggtcaggactgacctgtgtccctggaggaatgggacctaaaggagctgattagaggggtttgtaccttggagagtaattttggttttttgtttgtttgtttgttttttcactcttttttttatttttccataagttattggggtacaggtggtgtttggttacatgagtaagttctttagtggtgatttgtgagatcatggtgcacccatcacccaagcagtatacactgcaccatatttgttgtctttatccctctccccactcccactcttccccccaagtccccaaagtccattgtatcattctatgcctttgcatcctcagagcttagctcccacgtatcagtgagaacatacaatgtttggttttccgttcgtgagttacttaagttagaataattgtctccaatctcatccagctcactgcaaatgctgttaatttattcctttttatggctgcgtagtattccatcatatatatatcatatatatatgatatatatatctaccacagtttctttatccactcgttgattgatgagcatttgattggttccatgattttgcaattataaattgtgctgccgtaaacatgcatgtgcaggtatcttttttgaataatgacttcttttctttgggtagataacagtagtgggactgctggatcaaatggtagttctacttttagttccttaaggaatctccacactgtattccacagtggctgtactagtttacattccttggggagtgatttggtataatggattagtagagagcaggggagataggacggagacagagctgggaagagagcaaagggaacacaggaaaggggagggggtgagttggtagaaaactggccaccatacctgtaatccaagcacttgggaagctgaggtggaaagatcatttgaggacaggagcttgagaccagcctgggcaacacaggaagaccctgtttctaaaaaatatgtatatataattagccaggcatggtagtgctcgcctgtggtcccagctacttgggagactggagcaggaggatcagttgagcccaggagttcaaggctgtaacaagctaagatcacaccactgcactccagcgtgggcatcagagcaagaccctgtctttgggaaaaaaataaaataaaataagaaaactgaaaattgggaaattacccaagagggaagaaggaggcagggggttgagagtccaagaagcatggaatcaatcaacctcagaatttcagtgaaatcatgatatgactttctcctggtgcctttgtgcggatcttccctctcctctggctgcacagtgagatgggaacagactgggctgagcagctgcagatggagtctttccagctgacccgtgcaagactggcctttgccatggcctttcacacttgctaagtgaatcaatatgctcccgacttcccccggggcctgtcttaactgacttctttcttgtcctaaacttatgatcttttcaggaaggaattttacgaccatccctaattttaaaaaatcaaaatgcgtagagtatttctcacccaaacttttcatctacaaagagaaatgatgctattttatgccatcttttgacaaatattgctctcttctcagaccccaaatgttggctctttttatctttagtctgtgctgaggaagggctttagattccagtcctgttgctgcagaggcagctcccagctcccagcacacaccccaaaacagattgaccctccttaactctcctttggtaacctaggaagccaataaaagctgtatctttgatgtctcggctttgaaaaagaattgctgtaatgtggcgtaattggagcatttcaaattaggaatggaattatgataattgactctacgtgttactgtctctaagattgttcttgcacacagattcggttttgcttctgcaccctctctctctctccctctgcagcttctgggggatacacagggcctgtagccatgtggcaggggaggtgacaggccagatcattttcaggctcccagattaattgtagattgtcagagggccccaaaagttcatgtagtgtaaacagtgaaatatctgtgtgagttgtcaggtgacctgggcttaaactcctccagtgacaagacactcaactccttcactacttctgccactggactgatgggaacactggaaatagtggatacacctggtactatgccaagtgcatatactgggtactgtgccgagtccacacactaaatgttatgctaagtgcatataccaggtaccatgctaagtgcatacactggatactatgctaagtgtatataccaggtcctatgctaagtgcatacactggatactgtgctaagtgcatataccagttactatgctaagtgcatacactggatactatgctaagtgcatacaccaggtactatgctaagtgcatataccagatactatgctaagtgcatataccagatactatgctaaatgcatataccaggtactatgttaagtgtatacactggatattatgctaagtgcatatactagatactatgttaagtgcatacactggatactgtgctaagtgcatataccagttactatgctaagtgcatacactggatactatgctaagtgcatacaccaggtactatgctagtgcatataccaggtactatgttaagtgcatacactggatactatgctaagtgcatacactagatactatgttaagtgcgtactctggatactatgctaagtgcatataccagatactatgcgaagtgcatataccaggtactatgttaagtgcgtacactggatgccatgctgagtgcatacactaagtactatgctgagtgcatatgctggataccatgctaagtgcatacagcaggtactgtgctacgtgcatatgctggataccatgctaagtgcatacaccaggtactatgctaagtgcatacactggatactgctaagtgcatgcactaagtactatgctaagtgcatacactaactactatgctaagtgcatatgctggataccatgctaagtgcatacactggatactatgctaagtacatacaccaggtactatgctaagtgcctacagtggatactatgctaagtgcatatgccaggtactatgctaagtgcatacactggatactatgctaagtgcatacaccaggcactgtgctaagtgcatacaccaggtactgtgctaagtgcatacagtggatactatgctaagtgcatttaccaggcactatgctaagtgcatacagtgaataccatgctaagtgcatataccaggtcctatgctaagtgcatacagtggatactatgctaagtgcacataccaggtcctatgctaagtgcctacagtggatactatgctaagtgcatataccaggtcctatgctaagtgcatacagtggataccatgctaagtgcatataccaggtactatgctaagtgcatacaatggatactatgctaagcgcatataccagatactatgcttagtgcatatgccaggtactatgttaagtgcatacaatggatactatgctaagtgcgtatacgaggtactatgctaaatgcatacaccaggtactatgctgagtgcatacactggatactatgataagtgcattcaccagattttatgctgagtgcatacagtagatactatgctaaatgcatacaccaggtagtgtgctaagtgcgtacaccagtactatgctaagtgcatgcactaggtgctgtgcataaaccaggtactatgttaagtgctcattgccttatttcattcttagaactgaccaatgaactattattcttattcttattagcatttcacaggcaaggaagctgagtcatggtgcttgcaacaggaggagccagatttgaactcaagcagtgtgacccagcaggttcaattaactaccatgcgatactaccctataatttatctcactcaagctttaatacaatgcttccctgtggctcttatacagggcattggttctgttcgctggagctttatagcacaagcccaagtcctcttctgtacaacatccttcagataactgaccacagttgcatgtctcctcctccttcagagtcttctacagggtaaatgtaccaagttcctcactggtcctctaatctaatgcttcaagtctcctgctgttgaggttcttctcctgtcttgctcagaaaagaacacacccatcatatgtggcaaagagcagagtgcccccattctaggacaagggtgtgtcctatccatttttctggaagctacacttaaagcctgaaatcgtatcacattgtggacagagtgaatcactgcacctgttttcccacaaacaaataaatgctttggggctgtcccttcagaaactaccagtgaaactacattgagaacacttaattcaaggatatcttgaaagctggacacattcttcaccctcaaacttggctcgctcttgaatactatgcagttaaggaaaattacaccggatgccagccttccgtttatttattcttttgctcatgtattcaatatttacacagcaaaggagtgcctactaggtttccgacagaggactgggttccaggcatagaactggccaaccacgatggctcacacccataatctcagcactttgggaggccgaggcaggcggatcacaaggtcaagagatcgagaccatcctggccaacatggtgaaagccaatctctactaaaaatacaaaaattagctgggcgtggtggcgtgcgcttgtagtcccagctactcaggaggctgaggcaggagaatcacttgaacccaggaggcggaggttgcagtgagacaagatagcaccactgcactccagcctggcgacagagtgagactccatctcaaaaaaaaaaaaaaagaaaggtgaagaacttatcagttttgttctcaaaggagaaaacaaacaactcaatagttacaataaggtgtcattagcaaaataaaactgatgtgcccaggataatctggggttagagaagaggactccagggtgcagaatgaattttgactctgatggtgtttcaagagagagaatacataggaaacagaaattcatttagcctaaggaaggcttgatctagccctaacccgaatctacatcatagctaatagcacagtgaatgaggcttacccatttgattgattgattgactgagacaggatcacccactgtagcacagtgaatgaggcttacccatttggttgattgattgactgagacaggatcacccactgtcacccaggctggagtgcagtgctgtgatctcagttcactgcaacctctgcctccttggctcaagggatcctcccaccttagcctcacaattagctgggactactggtgtgtaccaccacactcagctaatttttgtatttttttttttttttttttttgtacagacagggtttcattatgctgcccaggctggtctcaaactcctgggctcaagcagtctgcctgccttagtctcctgaagtgttgggattacaggcgtgagccactgcgcccaaccacttacccatttaaatgcttatggactgtgactattttgaaaagagtgcaacactctttcgaaagttactcaccccattccgaatctgtcacctttggtggtcagcatgcttagatgaacagcgcttcacacaaggagtgtaaaggaggctctataactcttggagtgacacctttttgtgaaactgtcctttctcctatcatcttccatctgagtgagttcctgtttttactgacctgtaatagcatctgctcttctcttgtggcagcaacagcacacttccatcttcacatatgtcaaggttcttgcacgtggtacccagtagtctgattagactgtcttatctcttcgtgggccagatacccaccttcatcatcctctgttctcctagtatataaacaggcctgtgatgagtgaatatttcttaggaggtccttggtttcgttgggtttacttctgtcagcattagccatcatcaagtcttgttcctgcccacatatgtgctggcaggtattcacatacacatgtgggaatcccatcttgattttttctgctcataattctggatcacagttctctacaactggatgagatacactgatatattcaagaagccatatgcggtatgaatgcagtgtacagtaaatctgaaagacaagggtagtgggggtggaaagtaaagctacacagtaatttggtggtcagaaacaaatggcccatccccacaagatcaccttcttggatagatgccttgttaaaatactaattgataccaggagtgttggctcacacctgtaatcccagcactttgggaggctggggtgggaggattgcttgaggccaggagttcaaggctgcagtgagccatggtcatatcgctgcactccagcctaggtgacagagtgagaccctacctaagagaaaaaaaggaaaatacaaattgatacccaagatagcgatatggtgagaagcccactaaaaatacttctaatactgcctgagaaactaaaggagttcatcatcagttcactaaagaattttgtttgaattcttgacttcagtaaattgatgatgaaagaatatgaataaacttaaaaaatctaaagcctgtgagaacattttgtaacacaaaacaataaagtcgtaagagtttaaaggtggatctaattatttcttacttgaaacacatagaaaagttggaagacaatttttacaaattctcaataagatagaggagggctttatacctattaatcataaacagggtggcaggtaataagcaagtggaataaaactgttagaaaacatgacacgtactatttgtttgttgttaatttccactgaagagcaaattaacactgaaagatataaagagataaactcaagaaatactgctgaaggaaaatgagaaaagatgacctgccagggttgtaagacataaagatataatctatgaaaaacataatttcccaaagaaaaggagaaaaaaaaccccacagattaaaagaggaaaacaatctatcccttgattttcacttttctcttggtactttctcaatagagtaaaccaaatgtgaaccagacttccttcttccttcttgatggttaacttccttgggatgcacactgaactaagttaagataggataagctatgctacagtaacaacttagtcctgaactttcagttgcctcacacacaaaacttatgtctcatacctgtaaaatccagtgagagttgaatgactctctagagcagtttccttccaggtggtgactcagggatccaatctgcatcccacttacatgacatagggagcccatattctgttttccccaggaaagttctgaattattcctgttgagctgacataatgatcactaatacctctttttactctcagaaacgtgcatgtgagtacataaatcatatagtcatctgagagtttcaccccctgaatctggctttcaggtcactgcagcaggaaagaaagaatggagactcatgggccagttttgttctgaaatgctttgatcctggagtgatggatactgtttcccacttgccactcatgcagttgctggctccatccatctaccaggggttgggggagggggaagggacaggacttgggttgggatggaggtgtcacgtggacagtcagtgagcagtaaatgtcaggatcacaataaccttagtaaaaaccaaaataaaatgaaaagtgttacacaaatacaagtagtatcaacataatgaaattctcaagtaccatcatataattttgagctctgctattgtaacagcaaagggagacctgaattgtgcttggtttcctccactgtctggccaggttcatagcaaacaccatctcattttttatcccagcatttgaggagtagtcaggtaccagtggagagctgaaagtggaggactggggtcatagaagaccctttgtgagtagtgagggcttgaagaagagaccgaaaaaccagcaactggagatgaactgggaatcctttattattaataattattattattagaaatggggtcttgctctgtcacctaggctggagtgcactggtgcaatcatagctcactgcagccatgagctcctaggctcaagtgttcctcccacctcagcctcccaagtagctggggactataggtgcttaccaccactcccagctaattttttttttttttggtagcgatggggtcctgttttgttgcccagactcatctcaaactcctgggctcaagtgatcctcccattacagcctcccaaagtactgggattccaggtgtgagccattgcacccagccatcttttactcttcctgatcaaagccattctagcatgctctgcctgtctaagtcttctcactcaggatccacatcacagccttgatgtctataccaaaggatgtgccttttatctatttccccggcattggttcgtttattctgaatcttttgtctggacttgtctgtgtggattatggattcagaatgagtgagcatttgagagggagtcgggtaccatagacctgaaagatgaggactgaggtcaccaacgttcctttttgtaagccgtgaaggcttgaagaagaggccaaagaaccagccactgtggaggtgaagaaagaaagcaagttcaatgcatcaggcgaatgggagttgcaacaagaaagtagacattgttgttccaccattcttaactcacagcaaactgagaaaacagagagagagaaagagagaaataatttttttcatttttattatttaaaatttgtttatgggtacatagtaggtgtatatatttatggggtacatgagatgctttgatacgggcatgcaatgcataaaaatcacattatggagaataggatatccacccccttgagcatttatcctttgaattacagacaatccaattacattcttcaagttattttaatgtatactatatgtatatagtgtgactatatactatgtacataatatgagtatatggtgtcaccatatagtcaataataacttaattattactaagttattattaataactatctaattgtgctattagtaggttttattcattcttaagagaaagaatttatatagctgatgtgaaaagtataattaggctcaatcgataaatatttattcatcaattatatgatgagtgaatgaacacatataattaatagacattttttagaactttaatacctcccaaaaagagaatgtaatgtctttttaactgtgtccatgaatcagtcacaaaaattgatctactaagctgcaaaattttcatagaccttaaaaagtagaaaatttacagaccttattctccgatcacaatataataaaatcaaaaattgataatatagaattaaataaaaagacccctgatggaaagatatcctagccattaaaatggtcctaaatgactaggtgtggtgactcacacctgtaatcccagaactttggtaagtcaaggtaggaggaccgcttgaggtcaggagtttgagaccaacctgggcaacgtagcaagactctatctctttaaaaaataactgggcatggttgtgcacatctgtagtctcaggactagctactcaggaggctgaggtggcaggatcacttgaacccaaggctgcaatgagctaggatcatactactgcactccagcctgggtgacagagtgagaccctgtctctcactaaaagaaaataaaaaattttccctaaatacagcattctggggcaaaggagaaaaccaaaaatatcctaacaggctgctaaaaaattattgccagtgacaacaatatttatcagaatccaaggaatgttgccaaaataatgtccaaagggaaatacacagcttttaatgtggtcattattattacatgagattctggagaaatcaggaatattcaatctccatcaaaaaggcatgatgcggtggctcatgcctgcactttgggaggctgaggtgagcggatcacctgaggtcaggagttcaagaccagcatggccaacatggtgaaaccccttctctactaaaaatataaaaataagccaggcatggtggcatgtacctgtaatcccaggtactcaggaggctgaggcaggagaatcccttgaatttggaaggcggaggttgcagtgagccgagatcacgccactgcactccagcctgagcggtgacagagcgagactccatttcaaaaaaaaaaaaaaaaagtccactggccacataacctctgagcttctgtctgatcttttgtctccactgtcttctttatgcttcacatcccattcatccacaggtttcccctgggctccttcagattatctcgcagcaaaacctactctctactccagtgccttctttccccgagaccattattcctccccaccatgggatcttccagctgtctcttcttgctaaggcagatagagtcctgttgttccctcatgagaaacattggttatatccctctactgtctgattgaaatctgtcctctggggtgggcactcaaggcccattccacgtggaccccatccaactcactggattttaagatccagcccagtgttagctgacttttagttaccagtcatcattccctccatcctgggactcttcctctgcttatatttgatttgaccctgtgatatcacagagaaacaaatatcagttgctttgtcttcttcccaatagcttatacgcttctgtgccctgacccacttcctttaggaatctctctgctcctcctcttcctcactgtgcccctgcagaaggtctggagcacacaaatccaagataaatgtttccttgatgacaaagaactcttgtcacggtctagagcagtcatacatccaaaaaaaacacgcacttgcatggtggcatgcacacattaaactcctaggaaaatggagaaattatgtattatctagtgccatgaaaatgctaaaggaatttggacaaagcggaagaccatggtgtagaataacctcggatgccctgatgttgcaaaatggaaagcattgtgtcagtaaagggatggatggaagaaaatgacctcaagcagagagagaaagtgagtattgggagtgtgtggtacagcttaggggccgccttatctggagaggaaaatctccaatgagaagcacaggagatgagcttggatgatccacacacttaccacccagccacaatttgggtgcaagttggtgccatctcttggttgaagcaatcggcatcattcaggccaaaatagatgtctttgttctttttgttcttggaaaccctgctcagtttgtattgacaatgtacattaaattcaaatggaatgttcccccagtgcagaagattttttcaaacttagactatgagagcaaaggaatttgaggtcacacttgagttagtgtgagtaggagaaacaggacattgacccgaatgctttggattttttgtttgcatttggattctatgcctttggattttcatcccacattgcactgtggctaactctagcacaaccacataccccatctgaagaattgggcatatggaaatagacctttagacactaaatatttgtcattttatattgtgcataattactctgcctgcattgcaacgtggaccaccagcatccagctccacgctcttcgtgcattgggtcgaaattagttaaaggaatgcgtaaagaagaggttgtgttcagcaagccatggtgctaatattctgattaagtgtgagctttttggcacacagcgtagatgagatgtgctgttgtattaataggctgtaaattataaataattgcttgataggatgagaacctgaagcgatgggtttctttacagaatgctgattattccctcagtaacaaaagacaagggaaccgattcctgcaattgtttccctttggaaaggaaaggacattttggtctgtcatgttgatggaaaacactagaaatttcctttgtgattattttgttccctttcatccaagctcctagtttattctcacacatgcagacataaactgggcagggtgaaaattccctgcatgaaccattcggttttcggtttgccagtccccatcaatgacaagtatttctttatctggtcagaaaatggaaattctgttttctgagccagccaagataccaggtacaaacagagcttccccctggggattcacagcctgaaggtggttaacggcccccctctcgcctatcaccagactccagtagacgtttctgatgcggggaggctagttctgaatccaagccaacactggttgttggttccaattaaaaagcaattgcattcccagcagttcagggctgcagccaaaaatacagcatgttcagaaaagcatgatcttttttgagaggcggttactccatcaagggatagatgctgccagggagagctaatgatggtacattcgtatgtgataaaaatttaaaagttcaaagaagaaagcaaaaggtagatgatttactttgaagttatttgtagatggcaatgaggattttctgttggtctctttttcccccagcattaatcagcccatttattagaagacaaacaggaattgaccgtttgtcagacagcaaagaaacagagcaatcacattaaggaaatcaaaggcgagaatgtcaaaaggtcagcattaagcagccctgggaagcagtgtcactctgcagacgtttcagccaaatccttctttccatgagtagcctctgctttttgggaggaccaatgagcatagagagcttggagggactttccagttcattgcattctgtctcctctgctggtcagaggcttatgtctgggtatttttagcaacctccctctgtctttgttggctccagaacacataatttcagaaaaatcaggtataaaatctcaatcccagcactttgggaggctgaggcaagaggattacttgagcccaggagttcgagaccagcttgggaaacatagcgagaccccatctctatgattttttttttttttttttttagttagctggacatggtgatgcacacctgtagtcccagctgaggcaaaaggatcacttgagcccaggatttcaaggctgcagtgagatatgatcgagtcactacattgcagcctgggtgacagagtgagaccctgtctctttaaaacaaacacacaaaaaactcataacatggagagtcaagaactctgatttgtttcagatctggatcactcactacaagacctattactttttattttagtcctcatagtgcaggattttatgataaaactgtttagacttgtcaccaacaaagttagtatttcaaaacaaaacaaaagccctaatcccccaaacttttgtgatcacattaagttggatcaacccaaattttccttctggagagagccaagaagtcatagggagcaggttgggtatctctaatccaaaaaatctgaaatccaaaatgctccaaaatctgaaactttttgagcacagatatgactcaaagaaatgctctttggaacattttggatttcagatttccaaattatggatgctcagcctgttaaatacagtgcaaatatccccaaatttgaaaagatccaaaatctgaaatgcttctgaggagttgcagatcagcctaggtaacatagcaagatctcatctctacaaaaaattagccaagcatattggtgcatgcctgtggttccagccactcaagaggctgagatggaagattgcttgagcccaggagttcaaagctgcaacgagcagtgatcacactgttgcactccagcctggtgacagagtgagaccttttctcaaaaaaagaaaggaagggagggtaggacaaagagacagagaggaagaaaggaaggaaggatggaaggaagggagggagggaagaaagagaaaggaaaaaaagaaacagaaagaaaaagaagtggagagagcgaaagaaacagaaagagaaagaaacagagaaagagaaacagagaaagagaaaaaagtaatagagaaagagagagaatgaaagaaacaaagaggagagagaaagaaacagaaaaacaaagaaacagggagggaagggagggagggagggagggagggaggaagggagggaaataagcaaaaaaaaccacttctggtctcaagcacttcgaataagggatactcagcccatgatgtccagcctcacatttctagtgctcctcaagaaggacacggattactgtttgttgccaaggtggcttgtttcaagaccagcgtgattggcaagaatcttccagcaccactgtggcagcttttggtggaaggaatatagccctgactgggaggctgctggggagatgacaaggccagcgcttcagcacatagcctgcagaggccccattgccagtgcctaatgtaactgaacaggccatttgtcatatttaattttagctgcagtggctcaattgggactttatccagactggcttccactctgctagcctgctgtgctccccttgtcccaggctgagtcacttatgtccctggccctccatctgccagcgagacctccgagtcactgatactgagatcatgggccccagatgtggcttttccagcctgtgcagtaaattaaagcaccttggtgccctttttctatctgcactttaggagcaaagcacttttttttttttttttttttttttttgagacagagtcttactctgtcacccagactggaatgtagtggcacaatcttagctcactgcaacctctgcctcctgggctcaaaggattctcctgcctcaccctcccaagtagttgggactacaggcacatgccaacacgccctgctaattttttgtatttttagtagagacaggattttaccattttggccaggctggtctccaactcctggcctcaaataatccacccacctcggcctcccaaagtgctgggattacaggcgtgagccaccgcgcccggcctcaaagtgctttcttactttttactctgcatcaacctcttttctctccaaggaactctgaatgaatgagaccatgagaagaggcttagcctccactcggcttgacaggaggaaaggaaggagctttcccctgaggatagcaggggaggaggtgtcgtcttgcccacctctgtccagggcaggtgtagcacaaggcagcaggaaaagcccagaatttggattcagaaacctcgatcccagttttgaatgtggttcttagttgggcgagactgagtgtctgtaagattgaaccaatgtgcctatagacgagctcccagttgggtgggatgggagggcactcttagatcatcagagagtggggctttgtcagtggtgaagatcagaatgcgcctggcaggtggtcaagactggggctcttactagaatctagtctgttcgagtaccctagggtgggcgattcacagtagtgtctgaagctgaacttgaagacaagtaaattccagattctttcccccccgtcctctcagagacttgattgcttctcttgtcctcactcgctcctcaacctcaccttttgttggctcttttttaccatatgaactggccagtcttcttcctttccagctgtgtgcttctctcctggaaatatttttttattattatttttattatttatttagtaaatatcattaattatatactaatatataactaataactaatatataaatatttgatatgttaatacattatatgtaatataaatatataataattacatataactatataatctgatattctggatattaggcctttattggatgtacagtttatatattttatatttatatgtaatataaatatataatgtataattataatcataacatgtaatataatacattataatatataatatattgtgattgatgtatataatatataattacaatttgtttacattatatattatatttatatgttatatattatgtgttaatatgtaactaatatattagtgtatacattagttaattatataatcatattatatattataattatgtattgcatattatattataaaagtatacattatataattaagaatatataattcttataagaatcatattaagaataaataattattatatcatatggttaataattaactaatttatatatgaatatattagttctatattaatatataaatatattaattacacattaaatactattaactatatgaatatataaatatattaattatgccacatataattttattatatatgtgattatgtatcagttatatacttaattatatagtaaatattatttatacaatattatttatttacttattcatttgcatttcaacttttattttagatatgggggtacatgtgcagatttgttacatgggaatattgcatgatactgaggttggagtatggattccatcacccaggtagtaagcatagtacttgatagatagtatttttggttttttttttgcaggggcggggggggttggtttttttgttttttttttttttgagacggagtctctgtcaccaggctggagtgcagtggcacaatctcagctcactgcaacttccacttcctaggttcaagcaattctcctgcctcagcctcccgagtagctgggactacaggtgcccaccaccactcccagctaatttttgtatttttagtagagacagggtttcaccatgttggccaggatggtctcgatctcttgacctcgtgatccacctaccttggcctcccaaagtgccgggtttacaggcatgagcaactggctgcttttgtttgtttgtttgtttgtttgtttgtttgtttgtttgttttgagatggaatctcgctctgtcacccaggctggagtgctgtggcgcgatctcggctcactgcaacctccacctccctggttcaagcacttcccctgcctcagcctcccgaataggtgggactacaggtacttgccaccatgtctggctaatttttttttgtatttttagtagagacaggatttcaccatattagccagactggtcccaaactcctgacctcaggcgatccacccaccttgacctcctaaagtgctgggattagaggtatgagccactgcgcccagccgatagatcgtttttttaacccaccccctgcaaaccctctagtagtccacaatatctgttgttcctgtgtttatctccatgtgggctgagtgtttagttcccatttataagtgagaacatgcaggatttgattgtctgtttctgcattaattcacttaggataatggcctccagctcaattcatgttgctgcaaaggacataatttcatttgttttatggctgcctagtgttctgtggtgtatatgtaacacatttcctttattctaccattaatgggctcttgggttgaccatgtctttgctattgtgaatagtgctgtgatgaacatacgagtgcaggtgtctttttggtagaatgatttcttttcttttggatagatacccagtaatgggatggctggctcgaatggcagctctgttttaagttctttgagaaatcttgaagctgctctccacagcagctgaactaatttacattccttccaacagtgtgtaagcattcccttttctcccgtgccatgccagcatctgttgtttcttgcctttttagtaatagccattctgactggtatgagatggtatctcactgtggttttgatttgcatttctctgatcattagttatgctcaccattttttcatgtttgttggctcacttatatgtcttcttttgagaagtgtctggtcatgtcccttgcccattttttaatggggctatttgctttttgcttgttgacttaagttccctatagattctggattttaggcctttgctggatatataatttgcaaatatcttctcccgttctataggttgtctgtttgctctgttgatagtttcttttgctttgcagaagctctttagtttaattaggtcctacttgtctatttttgtttttgttacagttgcttttggggacttagccaaacattctttgccaaggctgatgctgagaagagtatttcctaggttgtcttccatgatttttattgtttgaggtcttatatttaaatctttgatccatcttgagttaatttttgtatatggtcaaagataaggttccagcttcaatcttctgcatatggctagccagttgtcctggcaccatttattgagtagcaagttatttgctcattgcttctttttggcagcctttttaaagatcagatggttgtaggtgtgcatttaatttccatgttttctgttctgctcattggcctatagtaccaagctggtttgactactgtggctttgtagtatagtttgaagtccagtagtgtgatacctccagttttgttcttttagctcaagattgctctggctatttgagctcctttttggatccatatgaattttagaatagtttattctgattccgtgaagaatgacattggttgtttaataggaataacattgaatctgtaaattgcttttggccatatggccatttttatgatattgagtcttctaatccatgagcatagaatgcttttccatttatttctgtcatctctggtttctttcagcagtgttttctagttctccttgtagagatctttcacctccttggttagctgtattccaaggtatttcattttctttgtggctattttaagtaggattgtgttcttgatttcaccctcagcctggagattgttggtgtacagaaatgctactgatttttgtacattgattttgtatcctgaaactttacttaagtcgtttatcaactcaaggagccttttggcagagtctttagggttttctagatatacagttttattgtcagtgaagagagatcattggatctttttttcctgttggatgccttttctttttttctcctggctgattgctccagctaggacttccagtactatgttgaataggagtggagagagtgggtatccttgtcttgtttcagttctcaatgggaacaatttgagcttttgcccattcagcatgatgttggctgtggtttgtcatagatggctcttattattttgaggtatgttcattcgatgtcttgtctttcgagggtgtttatcatgaagggatgttggattttattgaaaaccttttctctgtctattgagatgattgtatggtttttgtttttgattctgttctgttggtgaatcacacttagtgatttatataagttgagccagccttgtatcccagcaatagagcctgtgtgatcatggtgtattcacattttgatgtgctgctgaattcagtttgctagtattttgttgaggacttttgcgtctgtgttcatgagggatataggtttgaagttttccttcttgttgcatctctgccagattttggtatcaggctgatgctggtttcatagaatgagttagggaggagcccctcttccttgattttttggaatagtttcagtaggcttgatatcagtttttctttgtacttctggtagaatggagcccaagagtttgaggttaccatgagctatgatcatgccactgcactccagcctgggtgacagagcaagaccctgtttctaataaattaaaaaattacagtcacaaaaactgttttaaaaataaaagtttttgaaaccattcttgtcactcagagagtaatttttaaataaattggaattaacaaaaaaaggcacaaaacctttatttaattgatgcataacggatatacatagttttggggttgatgtgatcatttaatgtattcgtgtaattttcaaagatcaagtcagtgtacgtgggatatctgtcaccttaaatatttgccttttctttatgcaccaaacctttttgacagaaaaggaataattgtcagaagcataaagccttgtcagtgtcaagtttctgctgacctcttcagctattctggttgtcatttttttttctggcatcaataagcattttttccctttggataaatatcaagtttattctgattctcaattcacattggcttgcaaattcagatgacactgaagaccaaattactgcctgtgggacaatggactttgtttagttgctaataggggatttagtagatagcccaagagacaggatatgggtctgagattacacttagttgcattttttaaaaactatgttaattataggcttaagtcatgtattcaaatgcagatataagaaatacagcattcccatattttaattggatccttaggtaaagagagttttagccactcagctattaatccagcctgaacaactctgctataaacgcactttcttctgagcgccttttttttttctcccttgccttacatcatgctctgtggcctcctgaacttttccttttcttctcagtatacatgaaatacttatagctacttcattagctttcttctgtcttggatcacaagctctctaagaagagcatctatgtcgattttattcatcagtgtatcacctgacctgcctagcatggtgcccggtatgacacttaaccttaaagaaatatttgtaggaaggatggctgaataggcgggtggatggatggatgaatggatgaatggatggattgatggatagatggatggatggatggatggatggatggatggattgatggattgatggatagatggatggatggatggatggatggatggatggatggacagacaatggataaaaataataattttttctttcttctatttttgacaactgtgataagatcataacatcctaggctagatggatggatggacaacagataaaaatatttttttcttctgtttttgacaaccgtgataaaattataacattctagggtagaaatggaaccctatttgatgcaccctttaattcttcatcgaagggttcccttggcctctcttccagattggtcacatactgtgtcactaagaaagggctcttgccctcctcccttagaagagtaaactaactttcttttgatcatggaccctggggttcaatttttttcatttgtcaccaacaaagagaatatcattcctgcatggatatcttggcagctgcttgattttccctccttggagaggagagaccagtaaaccttacaccataatctacccaactcctttgctgtgagagactttccaacttttggtactttggaatggtggccctgcaaccgaagaggtcagtgggcaggaccacaggctgcatagctttggagcacacctcacaggggaacagggacccagcacaaaatctgcgggaatggaactcctagaatgggcaacatggcggctctgccattgggctggtagaaggcctgttctgcaggctaccaatatgagagtgccccattgtatcaatcaaatgttctaggcattcttctggggctttcctcacatagaaaatgaaatcatactcttccaagtgttaagtgcatcaattcaaacactggacacagaagactttaagacttactcgatgaaagcagctggaatcctgagtcttcaaagatatcttcttgtctctaggatgagtggcctgacctgcaagccctctgggtgtctgtcttcactctcactggtgtctctctcggcttctgctggctttaatcttgaatgcatcaactgtcttggactcctaccttgcccatgacaacatgaagtttctctttatgtcactttaggatctaacacttccaggacacaacagctctcatgagttgacctgactctttctggattgatctctgtcactcctgtttgtaggctgagagactgctcttctggtctggttagagatgggaagaggtggaaggactgggaagaccacaggctcttcagacaatcctccataaatacagattctcccaggcgagttctaaggcactataggtagcaggaagttggcaatagtgctcttggtaatgtttagaatgtctcttacaaaaccctgtgctggactttgagggattcccatggggatgaatcaagatctttaagcccagactttcctcactgaccctgccttttcccttctcaccatcccctctggactccatcttatgctcttcaagttgtcaagttgtttcctctgaatgactgtggtatttggcctacatcacaattcacctgccacttgccatctcctgggtctgaaccttatccccgctttcagactatgagctcctaagttccctgagagaggatatcatattctctctgtttgcgtagcagtgaaaatcatcaaacttcctgaatgcaaaccctgtctctgtggtttactagttgtgtggcattaggcaagttacttaatctctctgtgcctccttttcctcatcagaaaatgagaagaagaatcatatctgctttccagggtttttgtgaggtttaaataaataaatacatgcaaatgactaaaacagtgcctggcttggaggaagccttcgtacgtgtaagcgcttgtttctgctctcggtggtagttttttttcatttctattttattttattttatttatttttgagacagagtcttactctgtcactcaggctagagggcagtggtgtgatcttggctcactgcaacctctgcaccctgggctcaagtgattctcctgcctcagcctcccaagtagctgggattacaggctcacaccaccacgccaagctattttttgtatttttaaccttgcccaggctggagtgccggacaaggtttcattacgttggcgaggctggtctcaaactcctgacctcaagtgatccacctgcctcagcctcccaaggtgctgggattaccggcgtgagccaccgtgcgtggcctcagtggtagttttgtttctcctggcatgaaggtgcttaggaagcatcagccatggtgtgcatgcatgtgtacacatgtgagcatacagtcttcccccgtcctgtcatctgcatttccaccatctttgtcccttcaccagacaatggcaaaagacaggaccaaaactccagttgcttaaagacccaaaacatggatctatagtggaccaaggggtccccaaaaccgtggtcagaatgacaactcagaatatcccccaggaagtcaaggaagccaggcaggacaaggcctgtcacagactggacaagagacacagacacccagggctctgttttatggctttgcgatgtcggcggctgtcccactctgtgcttacggttggggtcagcagtgaggtgctgatttcctgtatttgccactacccagagggcatggggctccaggttaagatggatgacagcacttcaaagatgaatggagtgaacattgggaagttagggagctgtgcagcggccattatctctgagtgtcctcacaccagggcctaggatctgaaaaggtctcagggcccccaggcgttccatgggccatactttgaaaaccacagcagaagagcataaccaagggagggctgtgtagagaagagcagctgtgaggccggtgcgttcatggggttctaggtataattaagggctgttttacctttctgttagggcccaagggaaattaaacctggccttataccaattgcaaggggaaaaaaatgacgtaaaagagaatggagaaaaatgatggtttcatcagtaagtgtcattcactgctgtagagcaccctttctcaaactctggtttcagctcccctttaccatgttaaaaatgatggatgaccccaaagagcttttgtttatgggtgtcctatctatcgatttttactatgttggaaattaaaatggaaaactttaaaaatatttctgcattaaatcattcaaaagcaataataataaacccattgcaggttaacataaatcacacaattttgtgagaaataactgtattttccaaaacaaaaacatattagaaggaggacggcattgttttaaccttgtcgcaaatctcttgaggtcctggtagacagcaggtggatgcttgtttctgcttcatacatttcattcatcattagagcaatgacatcgtgccatgtgatgtgtcctctaggaaactccactgtacgcttgtaagagagtgaaagtgaataaggcaagtggcgtcatagcataattataaaaatcattttgacctggtagagccctgaaaagctctcaggatccccacaggccacactttgaaaaccacagctgaagaacctaaccaagtccatgtcacttctttggtctccagcctttgtttttatttatttatttatttattttgagacagagtctcactctgttgcccaggctggagtgcaatagcacgatctcggctcactgcaacctccatctcccgagctcaagcagttcccctgactcagcctcccgagtagctggaattacagatgtgtgccaccacacctggccaattttttatatttttagtagagacagggtttcactatgttggccaggctggtctcaaactcctgacctcaggtgatccacccgccttggcctcccaaagtgctgggattataggcgtgagccaccgagcccagctggtctccagcctttataaaaccacactccaagtatttgccttgcccttagagatgtatgttttctcctcctctctttttaaattgcttataattttttggtgttttttgttgggggtggggtgatcatgtaatggaagcctgggaaggttctgattgactggccctcgggaaccctgggtttgagctcagagcccatgagctgtgtgattgcaagcaggtacttctcctttcgggacctcacttttccagtttatgaaacacatgacttcagcagtctccaaagcgctgacagtctgtgtttctctgagacttaaactggagagaccagatgcctttcccatctgttatgggctaaattgtatactccaaacaatcatatgttgaagccttaatccccggtacctccacatttgactgtatttggagatagggtctttaaagaatgaagttaaaataaggtcattggggtggactctgatccaatatgactggtgtcctcgtaaaaagaagggattagggctgggtgcagtggctcacacctgtaatcccagcactttaggaggccaaggcaggcagatcacaaggtcaggagagcgagaccatcctgaccaacatggtgaaaccctgtctctactaaaatacaaaaaattagccgggtgtggtggcacgtgcctgtagtcccagctattcaggaggctgaggcaggggaatcacttgaacccgggaggtggaggttgcagtgagctgagatcacgccattgcactccagcctggcaacagagcaagattctgtcaaaaaaaaaaaaaaagaagggacacagacacacacaaaggcaagcccatgtgaagacaaagggaaaaatggctgcctctaagccaaggagagatgcctcagatgtaaccacccctgtggataccttgatctcagcctgctcgcctccagaattgtgagaaagtacattcctgtggtttaaatcaccagtctttgggactttgctatggcagccctagcagactatacacactatttattatgttctctaatcctgagtccaggcatcttttccaggctgttgctttgaactcaggcttacctctttgttttcaagataattgctctagaagctgaatgaccactatttggagatgtaagctaaagattcttctggaagaatacaccatctggacagctcaggagccctgagtgctgaaagtttctgtgatgttcattcgctttgtctgttatccaaggggagagaaaatgagacacaatgggcatcttcagggtagaactacaccacctttgattaaagagaaatcaagaaatgaagttgaatttctgatgtctgcttactctcatgctgagcctcgcagagggagaatgactacagcctagagctgatggcttcaggagctgtagtgtttatcagatttgctccatgggtggccaaagctgggtgatggggtctcaatggccaggactgggcgccccaggaacctcaggcctttctgcatcagcacagatgcttatccattgacttccagtcacttgtgacctcggggtaaaggaacatgaattaagaaaacctcaggctcagtttttccccaaagtatgttgcatggaatacagtttcatgggttgtcataggtcttctgcaaaaaataaaggagtttcgtgaacagacacgtttggaagcttgtgacttaaacagagttaagtgggcttcactgctgagtgcaacgtggtctccccagcatctttacaatgctgtgttcattacaaatatgtatatgagaaaggggcatttcccaaaccggtgcttctgcagatgggtttgctatgctaggttacccacactggagcaacagcctttccaggggaggattgcttgagcccaggagttcgaggccacagtgacctgtggttgcaccattgcgccctagcctgggcaacagagacagacccggtctcgaaaagaaaataaaaggaaaagaaagaaacagcctttccagatgaccttcagagcttgccatggctgccttgagataccccaatggcgggcagtgggcagtcaaagggcaaatggccagagtagtgagaacagtggaggccatcaacagaggtacaaccacggcctccccctccttttcatctgtcaaagaaccacaagacctgtccggtagacaatagataacaagacctactacatccacagtatccacagttctttttttgtttgttcaaatcattgtcataccctaactctaacggacaagggaaataaaagaaaggtaatttacaataacatgtatattgcaacgctccgactcagctatcaactgccaagaacaatgcccccccgccccatagacttgtacatccctcctgggccagagccagctctcctaagaccataacagttcttttcgaactatttatagcctgtatccttattaggagtgatacggctgccaacagggcaataattggttcttgaaggggggtgcaaaagagtattacacttttatgtgtaaatcacagatacacatacagcatgcaagcagatatacagcgcatctgtggtattaaaatttcatagtgggagcaggtaggggatctcagggggaaaaaagtctaaaaatgcctcatagagaggtgataatgaaaaaaaaaggctgagagacactgatgtggagtgaaggaccagatcttatttccaatctatcacgcaatgatacttttataaaatatagtaaaagtgaattcctagaaaaataaaataggaaaaagagaaacaaatgttaagctccacgtttttattattagattcaaccgacataaatttgctctattgaattgctagaaatgcttttttttattttttatttttttaagacagagtctcacttttgtcgaccagactggagtgcagtgacatgatcttggctcactgcaccctttgcctcctgggctcaagcaattatcctgccccagcctcccgagtaactgggattacaggcgtgtaccaccacgcccagctaatttttgtattattagtagagacggggtttcaccgtgttggctatgctggtctctaactcgtgacctcaggtgatccgcccaccttggcctccgaaagtgctgggattacaggcctgagccaccatgcccagccaatgtttttaaagcttattcagaattggccaggtgcggtggcttatgcctgtaattccagcactttgggaggctgaggcacgtgaatcacttgaggtcaggagttcgagaccagcctggccaacatggtgaaaccgcgtctctactcataatataaaaaattagccaggtgtggtggcaaacgcctgtaatcccagctactcaggaggctgaggcacgagaatcgcttgaacccaggaggcagaggttgcagtgagcccagatcgtgccactgcacctcagcctggatgacagcgagactctgtctcaaaaagtaaaaattaaaatttaaaaaaaagcttaccatttgcatctgaaccactgttcagactgtttttggatggggagtagtccatgggccacgcccctatctgggggcactgagggtagagaagcagggcctagaagaggggtctagaagggtcaagaggagttggctggtggagaagaaggaaagattgtttcagagagaggaccctagcagaggcaccaagcaggaagtgcatggcacctgtggagtggccagtggcaagttagggttctagcagagagtgagggggcagaggaataggggaggccaggcaggaggacagatcaagctgctccagccaggagccagcccacaatcctgcgggctgcattcacaccgtgttctgttaataaccaagtggagcttcatgctttggggtcattgagaatctgatgacatctacctatgcaccctgtcctgaagacattacaaactcagaacatcatctaacaatcttgggagctggttttgggatcccttaaagcttatctaaaatctctaggttcgtttttatttttattttcagttgtattttgagacagggtctcgctttgtcacccagaatcaagtgtgatcatggctcactgtaccctcaaattcctgggctcaaacaatcttcccacctcagcctcttgagtagcggggactgtgggcacttgtcccaactaattatttatttatttttggagaattgggagttgggaggtcttgctatgctgcccatgctagtcttgaactccgggcctcaagcaatccccctgcctcagcttcccaagtagctgggacagcaggcacaagccaccatgcctgaattatatttttaaacttttttatagagaggcagtcttgctgtatttcccaggctggtctctaactcctgaactcaagcagtcctcccatcttggcctcccaaagggctgggattattagtgtgagccactataccaggccaaagtcaccaggttcacaatacctcccaaacagttgagctgataaaccctcctcatgtactcattccttctagtccatgtttattatatcgtaactttgtgctgactccagtactatcaggcctgccagatagacacaggactgacaccacccagagatcattagcctgggatccagacatccaggggcaatgctgagactaaagccaactcctgaactcaagcagtcctcccaccttggcctcccaaagggctgggattataggtgtgagccactacaccaggccaaagtcaccaggttcacaataccacctaaacagccctttcttcaggtaactgaaaagatgctcttacaaggaccattaaggctcaagataaggaacagccttcgcttggcaaactcccgtgccaaaaaagccaaggataaactcagaacatccagtctggatgaaggtctcagcattgccctaacacacccataaggcccccagtgcactgatcccctcctcctttccttgacctctttttgtctggctgactctgcatttctatctcttttcatggaccctaatgagtttcaccgggtagctatggtggccaaggacactcagaaccggaatttcattgatgcttgttaggattgatacccatttagtggacaatctcatcaatgtttgcatggaatgtaaaaatcagccagcaaatggaaacatacccagagaggcagctggtgtaattggccctcacaaacacatgagaagtgctcttctaaaaataccagggcacctcatactgaaaggcaggccagagactgaattcagcaagagctgaaaacagccaggacaaagtgtttggatcttccagtgcaatccggaaatcatggagcttgatattgaggacccaagggagaagtgccatttcagatttaaagaaaataagcaaatttgagataggccacgtcgttagaatactacccaagaatagtatgtgttgatgctgataaattagggtacaggtacttcaattcgtttattcattcagttgttcaatgagcacttactgggtaccaggccctattctggccctgggaatgcaggaaggaacagaacagatacaattcctgcctgttgcagtggacaatgagcaaataaatacataatttggagaaaggagagagagattggaagggagaggggagattgttttgcattctgtagccagggaacattgtggtgtaaggaagtgtttaagtagtaaatcttttatttttatttttactttttttttttttcttgagacaattgccctgttgcccaggctggagtgcagtggtatgatcatagctcactgtagcctcaacctcctgggctcaagcgatcctcccatttctacctcctgagtagctggtactgatggacatgcatgaccacacccagctaatttttaatattttgtagagaggtctcactatgttgcccaggctggtctggaattcctgggcttcagctatcatcccttattggcctcccaaagcactgggattaggtgtgagccaccatgcccagactcagtagtaaatctgaatgaagtaagggaacaagtcttgtgggcttctggaggaagaatattccatgtgggaaggatgggaaattcaacagcccttcaacaagaacaagcttggtccagttgaggaagagcaaggaggccactgtggccggagtggcatcagcaaaggtgagagtgagaggagataagggaaggaaggaggaggatgaaccatttgccgtcatgtagatcttggtgtgtactctgagtagaatgggagccatgggagggttttgagctgaggtgcaatattgggatggttaatttcataggtaaatttcactggtcgcagggtgcccggattaaatattaattctgcacgtgtctgtgctggtgttttcagaagagattagcatttgaatgggttaactcgcccagctgagttattctttttttgtgtgtgtagagacaggggtcttgctctgttgcccaggctggtctcaaactcctggcctcaagcaattctctggccttgttcacccaaaatgctgggatgacaggtgtgagccactgcatccagccctttaaagaaggctttaaaggacctgaagatgtttagtctaaaaaaaaaaagaaaaagaaaaaagactggggctgagagagccctttcttcagatacctgaaaagatgctcttacaaggaccattaaggctcaagataaggaacagccttgtgtccggccaagcttttccactgtggagcaggctgcttttccactgtgagcttttgtccctggaagcaaggccctgggggaccacctgccgggtgccgggagcactgggatctgcctgccctatttcaggttgtccatgcatgcattcattcctgtgatatggatgggattcccattgcccggtgttggggttcgaatattacacaagatccagccctagccctcaaagaaaggagaaggcagtaggtgctctgatggggtgagagtgtccatgaggggccctgttctgacttgggtgagtagagtgatatctacgaccaagctcaaaagcacaagcactttcagccgagctgaatacatctaatgcatctgtgggtctgtgtgtgttggggacaaggatgaggagagaatctgggaccacgctagacatggatggaaaatacaaccagaatgtagcaagtgagaagggctggtggaaactccttctctcagggcccagaccagggggaggattgtgagcccggggaacctgtctttatttcaacttctgacattttgctcaccgtggattttctgcatgatttttgatttattaaacattgcatcaaaatactatttatcttggccaggcatggtggttcatgcctgtaatcccagcaatttgggaggctgaggtgggtgaatcacttgaggccaggaggtcgagatcagcatggccaacatagcaaaaccctgtctctactaaaaatacaaaaactagctgggcatggtggcacacgcctgtaatcccagctacttgggaagctgaggcatgagaatcgcttgaacccgggagtgggaggttgcagtgagccgacatcgcaccactgcactccagcctgggcgacagagtgagactctgtctcaaaaaaaaaaaaaaaaaaaaaagaaggttgattattgattatttagttctagggggtgcttaaatgtggttcacagagaatggcactgggaaggtgtcagtgaagaaaacatagtccctgccattctcactcgccatgtcccaggcacagcccggctgtgggttgggaaggtttcccaatatggaacactctagtgcaatgtggggagtttgcatcataaaatcataggatggggcttcaaatcatggcctgcctaacctgaccccctgcaaaggggcagactgaggctacgcagtttgtcctgggggccgggatagctctcctgtcggctgatggcttggggaggattctcccgaagtccttattcagaagcaaacttcttttaccaggcagggagtgttaaagggaaatgtggccgaggaaatgaatgcggctgtcagtatttaccggctcattatttatttatttatgtaggggatttctgttctctctgctaatcttcatataacatgcctcattgccctctgagggccccgagaggatcctcgcagcatttgtagggtggaatttgttcttgaagctctgtttctggttgctcattccttgcttccttgcaaataccagagaggaaatgagtcatctcagagacaagcctctcactcattcctaccagctgctggcaaatccaaggcgtaattggcatttgcaggtagggtccaaaggaaaaagcacatttttttgctttcagtttgaagtcatgtgctcagcgacatcaagcattgagaagggagccagccccgggcaaggcagagacaaagggggttggggagcttgggtggagggcccaagggcccagcccatgcccacacacatggtgtgactggcctcctgtctattaaactctctctactacaatactgtggtctttctttatgcagtgggcaggaagaacccctcgggcagtgacatctctcaaatattgtacattgtattcgacaggtaatcttgcaaccctcagccccctccttccctccccctttttggagtctccagtgtctattacttccatctttctgtccatgtgcaattggtagaatttagacctcctaagggccgtgtggagccactgaagatggggagtgccatggtcagatttgcacttttggggggtccgtttgttgacaaaaagagtcaaactctgtaaaatatttgaagagatttattctgagccgaatgtgagtgaccatcgcctgggacacagccctcaggaagtcctgggaacttgtgcccaaggtggttggggcgcagcttggttttatgcattttagggagacatgagacatcaatcaaatacatttaagaaatataagccaggcacggtggctcacgcctgtaatcccagaacttcgggaggctgaggcgggcagatcacctgaggtcaggacctcgagaccagcctgaccaacatggtaaaactccgtctctattaaaaatacagaaattagccatgtgtggtggccagtacctgtagtcccagctgcacaggaggctgagccaggagaattgcttgaacctgggaggcggaggttgcagtgagccgagatggtactactgcactccagcctgggcgacggagcgagactccatctcaaaaaaaaaaaaaaagaaaaaagaaaaagaaaaaaagaaatacattggtttggtccagaaaggctggacaactcgaagcagggggtttccagcttataggtcgattaaaaattttgctgattgacaattggctgagtttatctgaagacctgggatccataaaaaggaatgccagccgggcatggtgactcacgcttgtaatcccagcactttgggaggctgaggcgggtggatcatgaggtcaggagttcaagaccagcctggccaacacagtgaaaccccgtctctactaaaagtacataaattagctgggcatggtggcaggcgcctgtaatcccagctactcaggaggctgaggcaggagaattgcttgaacccgggaggcagaggttgcagtgagccgagatctcgctactgcactccagcctgggtgacagagtgagactccgtctcaaaaaaaaaaaaaaaaagaggaatgcccaggttcagataaacgattatggagaccgaagttcttatttgcagaggaagcttttaggtactaggctttagagaaaagaggttgtaaaatgtttcttactagacttaaagtctgtattgatgttaatgctggagagatatcatgaggcctgtctgacccccacttcccatcatggcctgaaacagtctctcgggttaaattttaaaatagccgtggctaaggaggaagtacattcggatggttgaggggccttagaatttcatttttgtttacacattatatttgtatgtatttatggggtacatgggaaattttgttacctgcatagaatgtgtaattgttaccagaaaggggtcctgatccagaccccaagagaaggttcttggatctcatgaaagaaagaattcagggcgagtccatagagtaaagtgaaagcaagtttattaaaggaataaagaatggttactccataggcagggctgctggttgcccatttttatggttatttcttgatgatatgctaaacaagaggtggattattcatgcctcccctttttagaccatatagggtaacttcctgacgttgccatggcatttgtaaactgtcatggcgctggtgggagtgtagcagtgaggacgaccagaggtcactctcgtcaccatcttggttttggtgtgttttggccagcttctttactgcagcctgttttatcagcaaggtcttcatgacctgtatcttgtgccaacctcctgtctcatcctgtgactaagaatgcctcaacctcctgggaaggcagcccagtgggtctcagccttattttacccagcccctattcaagatggagtcactctggttcaaacgcctctgacataatgatcaagtcaggccatttggggtatatccatcatctgagtatttatcttttctatgtattgggtacatttcaagttctttcttctagctattttgaaatgtgcaatacattgttgttcactatactctgtgctttaaaatcttgctgcagaagagatgtggctcatagctagaagcagggagtgggggacacagggagactattagaacactgcagttctctggggaagatggtggacttgggaagaggcagtggggacaggtgggataggctcccaaggaaggaggatggacagatccaacacataggggaagggccacatctcccctgtaacaggagggtaggtgggaatctggttcaggtggaggcaaactggtttggcaacagaggactgagtgacttcccactgggtggtttccgtttgctccagtaaatagcaggcgacgtcatcagctgaaagtgagaagtggttggagatctgagaacagggaagactgaaatagctgcagtgaagacccaagaaggagttttccgggtagacttagcaggcttctctggctgtatcaagtgaccagtttaggtttgaggacatacattgatagtgacaactctgtgtgcctgtacatttttctccagtcttattcagtcgttgggatattggtccagaaaatgcaggtggttggttcaatcccaggttgtggttttgccatgtgagtgcagtgataggtcagtggtacaagaggtaaaacagtaagagggtgtggaagtgatggagaacagactgtaagctggggacgaaaagaagagaaatgcatagcaaaaatagaggagtagtgtctgcagatggccaggattcaaatcccagctcaacctgggatggagtcggatgacttagagctattttttctttaactctctgtgcctcagtttcttcatctgtaaaatgggcagcacagtagcacataactcatcatgttattacgtgatcgaattaacaaggagttaataaatgtaaagtgctgaaaacacagttacatgctagctctcattactttgttgttgttattatttatttttatttatttatttatttttgagacagagtcttgctctgttgccaggctggagtgcagtgacgcgatctcggctcactgcaacctccatctcccaggttcaagtgattcccctgcctcagcctcccaagtagctgggactacaggcacagccaccatgtccggctaattttttgtattttagtagagacaggatttcaccatgttggccagaatttttctggtcttgatctcctgacctcgtgatccacctgcctcggcctcccaaagtgctgggattacaggcgtgagccaccgcacctggccatttttttttttttttagccatcaagtagcctgagggcttccctccaaataggtttagtgggagtaagtgaatgagagaaccagaagaacagaagcctgaggtcagagtgagatgtcccaaatggggccaggatggaaccatgggaacaggggcttgccagggagggtgagggtcagtcgagatagggagtttgggacatagctcagcactgacttggtagatgagtcacaggctgggatctcctgtacgctgtcgctgtgctcagccagcatgtcagaccatctgctccatctggtgaagtgagcagtgctaatattgctggaaaggggtcccgatccagaggccaagagacggttcctggatcttgcgcaagaaagaattcagggcaagccatagagttaagtgaaagcaagtttattaagaaagtaaagggttaaaaggatggctactccataggcagagcagtcccaaaggctgctggttgcccatgtttatggttatttcttgatgatatgctaaacaagaggtgagttattcatgagttttccaggaaaggagtgggcaatgcccagaaccgagggttcctcccctttttacaccatagagggtaacttcctgacattgctgtggcatttgtaaactgttatggcattggtgggagtgtcttttagcatgctaatgcattataattagcatatagtgagccttgaggaagaccagaggtcactctcatcaccatcttggttttggtggatcttggccagcttctttaccgcaactgttttatctgcaaggtctttatgacctgtatcttgtgccaacctcctatctcatcctgtcactaagaacacctagcctcctgggaatgcagcccagtaggtctcagctttatcttacccatcccctattcaagatggagttgctctggttcaaatccctctgacactaatatcaagtcttagagtggtagatgaagaaaagaggctgtccctcccctggaaggttaggaaagggcttctggaagagggtccctgggccttgaaaagagggtgggatgtggacgaaaagggcatcccgatacagacacggcatgggtagtccttgaggttagaatggacggagaagcatgcagtgaagtctaatgtggatggctggggaggtgagtctgagagtgtaggtttatcaaggtctaatcagacaggtcttttggtattctggttttagcacctgccatccaaagagtaggtgaggcctctaagtctggattctgcatactgcgatccatgacgttaggtaggtggacagtgctgtttcattatgttaaatgaaacaagccagacacagaaaggcaaacatcgcatggtctcacttatttgtgggatctaagaattaaaacaattgaacacatggacacagagagtaggatggttatcagaggctgggaagggtagtggggggttgtgcaggggagataaggatggttaatgggtaaaaaataaaaaataaaaagaatgaataagacctactattggatagcacgacagggtgactatagtctataacaactcaattgcattttaagataactaaaagagtttaattagattgtttgtaacacaaaggataaatgcttgaggggggatgaataccccattctccatgatgggattattatgcgttacatgcctgtgtcaaaacgtctcgtgtaccccataaatatatacagctactgtgtacccacaaaaattaacatttgtttgaaaaaaaaggagtcaacagataaaaaccatttgaggagacttgaatggcacttggtgatttgatgagaccctctgtcctgtctaactgatctgcactctcttgttcggtgttcacacttaagagaaatgtaaccatctgtggaggccccatcttctcctcctaggtgatctgggctgtgcctactggtgtcccagagatgacagctgtccatcatcctctttggctggtgtctctattttgccttcagaggttctgacactgagcgattgcacgaggagggctgtggggagggctcgcctccagggagtgaagctgaactccctgctacctctgccatggagatgaataattgtgaacggcccgggaaacatttaaacccacctaaaccatagcacacaaccgaaagcagcaagcagggaatgctttaagctgttaaatgctgtgcgaacatgcacaaaatcctattatctactgtatatattgaaaagctaaaaacagcaaactttctgaggttcataaagcattgttcttggttgcaacttggagatttccattattgctttggctgttggaacctttaggtaatctctttcagaggggggtgagctctgacaaggcaaaggagaggatggttgattgcgggaagatcgcagcccatgaatatatctccagcaccatttgctctgaataaggataatcatttctcgcaatctggaaaccatgttatttagaaaattagggtaagtgcaaaacaaagcaagagtggggaaaaaaacaacgttcatcttagaatatcaggatgccgacaaaatgataaatcatgcaccattttttccaataagatttgcatgagtgtgatttctcatggttactattccactccagtattgatggtaaatttttaaatccatcatttaatatggtccctttgcaagaaagaaaagatcaagatatccacgcagacttcttattgctaatgaaaatcaagcacctctttggttcgattttccctcttgtaaaacttgtatttgcaggaagatttttttgtaagtctcttgaaatctgcattctacattttttttttagatgatggctggccatagctccacaccaggggctcttggcttggaatccactcatctccaaggagtctgtgatcatatctgagtctgtaaacttggtcagaaatataaaatacatgttgatgtttccctaatctctaactgatattagtgtttgtttctttaatgaatgtaggctagacatttttatattacattctagttgttgtggctatcttgaaatacttaaatatcctcttgactactctcaaatttatagtagttagtaaaccaaacagtagatcttgttatttaaggtgctaaagaagcacataggttatatcatattttaaaaaaaccaataactatatttcaacatagttagtctttagtaatcctgtgcattttgtttaatttgatgcacttaaatacattattttctgtaattccagctacttgagaggcttacccaggaggatcacttgaccccaggagtttaagaccagcctgggcaacatagcaagaccccatctcaaaaaaaaaaaaactaaactaaaaacattattccgagaagggatccacagttttcaccagatgccaaaagtgtctgcagcacagagctttaagaatctttagctggtttctgacagttagattccctaactgtgataaaatgcagattctgaggcccctcccaaagcctgctatatcagaacctcaaggaatgggatatagacatggatgtttatcagaagctcccccagggagctgggatgcaagcagcccagaccagaggtctgtcattgggaacctgtggcttaggttatctgtatcccaataaccatgatctcaggacataggggttggtagacttggtcatagaaaaacaaagtcttcttacacttcttggggtatatgtggtgggaaagagaacagaggttaagcagacccacgttttgaatgaatttggtcacataacttaataggtgtgtgtcttgggcattgttgaccttcatttcctcatctgtaactcgggaattatagaaggacctacctaatgggctttgtcttagtctgtttgagctgctataacaaaataccgtacactaggtagctgataaacaacagaaattgatttctcacagttctagagattgggaagtccaagatcaaggcagattctgtgtctggtaagggcccactttctggctcctagacagtgccgtcttgcaatgtcctcacgtagtggaaggagtgaggggtggcttgttcctctttcataagggcaccaaccctattcacaagagctccactctgaggacctaatcacctcccaaagacccccatctcctcatcctgtcaccgagagggtcaggatttgaacacatgaattttggggagacatggacattcaatccattccaggcctgttgtaggaatgaaataaaataatgcacaaatgaatatagagcactttgcaaagtgtccaacacacagtaagtgttcaagtcttagctgctgtggatggtgaggatgctgctgctgctgctgatgatgatgatgttcttgatagtaatgagctagtctagttagcatttctgaggctaatgagggaactgtggttatggaatgacagcaagatctggcttccaaagcttggtagagaatttcggctggaggttacaatgcagctgagaggccccattgaagctgatctcagtgtccccagcatcagctgtccccccactatgggacagggctgacatgttactgggaacacgaggctgtctgctgatgctcattcagtgatccagaaagggtaccatcattcctccctctcccaaatcttgcatctcatgaaccaggcatctcattttcccaaagaatccttcccttacagcaggccagaaagctattgtcctagcctatggaaacacctaaaacacactggggagatgtggacactcagcccattgcaggcttgtaaaaatgaaataaaataatgcataaatgaatatagagcactttgcaaagtatctgacacttaaccagtgttttaagtgtttcaatgggcaaggacaatagttttctgagaggggatttttaatggctctccaaaagcaggcccccaaggtaaataacagaatgtgctgcagattcatggacaaccaactccttcacatccttagagatgaaattctttgaagaaagattttcctttaccaaagctcttctagattcttgactgggtgcagtgactcacacctgtaatcccagcactttgggaggtgaggcaggtggatcacttgaggtcaggaattcaggaccaacctgaccaacatggtgaaatcccgtctctactaaaaatacaaaattagctgggtgtggtggtgtgcacctgtaatcccagctactggggaggctgagacacgagaatcacttgaacccagcaggcagaggttgcagtgagctgagattacaccactgcactccagcctgggcaatggagtgagactctgtctcaaaaaaaaaaatgaacctcttctagattctctattccttctatcagccaatgctatccaggttcccttgaggcagtgccctgcctgtcattaaatctacggaaaatgtatgaagaacaggtttttctcttaacccccaggtgttcctcataaaacccaggggtggcaagaaaatacaggagcacatcgcatgttttgggacagtcacacatgatgaacttcgtcgataggatggatggcgcttcaaattttccaggacaaagacctggggtggtctctggagaaaccccaagccaatggttctttaaggtttcaagatcaacgctattcagaactatcaaaacccagccacaggccaggcgaagaggctcacacctgtaatcccagcactttgagaggcaaggcaggtggatcaccagaggtcaggagtttgagaccagcctggccaacatggggaaaccctgtctctactaaaaatacaaaacttaggtgggcgtggtggcgtgtgcctgtaatcccagctactcaggaggttgaggcaggagaatcgcttgaacccaggaggcggaggttgcagtgagctgagattgcaccactacactccaacctgggccacagagcgagactctgtcaaaaaacaaaaacaaaaacccagccacacaccccagcatttttacaaaagggaaaaagggatgcattcaagataatacaatgacattcctatgttttctctgagccagagagcagagaaacattgtggctaaggtggctttctttctgatcaaggtttctgtgaatgggcagtgtccacacatgaattctgcctaaaggctctgtgggagccaggctgcgagctgattgcagcagcagaaggcagcaggtaggagatgacattttagaattgttcaaacagaccccaggcctagaagatatgccagacacggtgttaggagagaaagaacaaagcgacaccagaaacaatcgtttaaaaatttaaaagaccatttccctttatcaactccacagctggctaccattccagtaaatttctaaaacatgaaactggccccagcagggcagagaagtgaatgggatggggcaggccagtgacatttacaatctccaggtgcgatatccagctttcctggaagctgaaaaatgaattgttttctgggagagaaacagaaataaaagtattggttggtcataacctcggggaagcctcttgtttctggatacctaatatttataaaagaatagggttcctgtgtgcattttaaaactctgggctgggagcagtggctcctttctgtaatcccagcactttgagaagccaattcatgaggacagcttgagactggagtttgagaccagcccgggcaacatagtgacataccgattccacagaaaagaaaaatagaggctgggcacggtggctcacacctgtaatcccagcactttggaaggtcaaggtgagcggatcacaaggtcaggagattgagaccagcctggtcaacacggtgaaaccccatctctactaaaaatacaaaaattagcttggtatggtggcatgcgcctggaatccaagctacttgggaggctgaggcaggagaattgctcgggaggccaaggttgcagtgagccaagatctcaccactgcactccagcctggcgacagagcgagactccatctcaaaaaaaaaaaaaaaaaaaaaacaaaagaaaaaaaaaagaagagaaagaaagaaaagaaaaaagaaaagaaaaatcagccaggcatggtggtgcacacctgtagccctagctacttgggaggctgagacaggaggattgcttaagcccaggagttcaaggctgcagtgagctaggattgtgccactgctctccagcctgggtgacagagcagagaccctgtgtctctaaataataataataataaagtaagtaaaattctacacattacaagtcaaaatagcagatgaagagtgctgggggcaagtcactctggctcctggaacaagcaaacctccaaatctcagtggcttagtatggtaaaaatatgttccatggttggcaggtagccttcctggtggtcattcagtgactttagcttctttaacactgtggctcctccatcatcaacaggtggcttccaaggtctccatgcagtgggaaaaaagaggatggagaatgcacactggcttttcaaccatggcagggttgtgctttacttagacccacatttactactgagaacaaatcttacagccacatctgtctgcagaaaaggctggactgggtgtactcaggaggctcctggcctttgcctgtaagaattaggaggcgccaaagctgacaccaactttctccaggtgttatcataagtggattaggtctgtccacagatggtgatatggttcggttctatgttgccactcaaatttcatctcgaattgtaatacccacatgtcatgggagggacctggtgtgaggtgattggatcatggggccagtttcccccatgttgttattgtgatagtgagtgagttctcacaagatctgatggttttataagtgtttgacagttcctcctacacaccctctctctctcctgctgccttgtgaagaagtgcctgcttccctttccgccatgattgtaagtttcctgaggcttccccagccatgcagaactctgagtcacttaaacctctttcctttataaattacccagtcttgggtagtatctttatagcagtgtgaaaatgaactattacagatggttataggcccaagaagagtatcactggctttctgttctggggaacaaaatagaagtttccattcaataaaagggactgagatttgtcatttcttcagtgtataagtacctcctccacttctaggatcctctcctgatcaaagccctaatgtttacatttaaaaacctgaagaggagaaaacctgacttcagttgtgaagtcagctggtggagtaatttaccaattggcaaatatcaagcctgcaggcccaatttcacatagacgggtcatgtcatggttgtgaatgtcattttgtgcctaggcctaagtgaaatgggatctgtatttgtctttccctggctttaaattatctggtatcaccagcagcactgactggcaccatgtcctggaatgtctgatcttttgatgtggcaatatctcctcccctaaggccacctccctccccaggttccatcagtccatgactagacttggcattttgcctccaagttcctaggctctgatacaccatcgtggaacagagaacagcatttctgcccctaaccttactgacgttttaacacccatttcagaaaccccggatttcctgacttccatagcttctaacccagcagctagtcccacacttttaaaaatttaattgattttatttgcagtttatgcaaaaagaaaaggatgggatggagctccaagaagggttctgagaacattctatgttgaagtaagtaagcaaaggataacccagctcagcatggcaggaccagggctgttcctggagcaccagcagccccagccacaggccaccaccttcctctgggactcagcgtgtttctatctcatgagtagaatggagagtggattcactctgtttaaatttaatttatagctattttctcactctctattctctttgccaagcctgagaatggagtgcatgttagtttatcagatgtagttccttgcatgcataagttcacagaggaatcacatgggtcagacccctcatcttggctgtaacaaaagcaagtgagaggctgaaccctcctatgcttggaccatgcttctttatgagttgcctcctgccacagacagtatgtttggtggcttggtcccaaaaggggcatccaagtttcctttttttttttttttttgagatagagtctcgctctgtcacccaggctggagtgcagtggtgctatctcagctcactgcaagttctgcctcccaggttcatgccattctcctgcctcaccctcctgagtagctgggactacaggtgcccgccaccacacccagctaattttttgtatttttagtagagatggggtttcaccgtgttagccaggatggtcttgatctcctgacctcatgatccacccacctcagcctccgaaagtgctgggattacaggcttgagccaccgcccctggcccaattttgctatttttatttattttattttattttttgagacagagtctcgctctgttacccaggctggagtgcagtggtgcgatcttggctgactgcaacctccacctcccaggttcaagtgattctcctgcctcagcctcctaagtactgggattacaggtgcccaccactgtgcccagctatttttttttttgtatttttagtagagatgggatttcaccatgttggccaggctggtctcaaactcctgacttcaagtgatctgcctgcctcggcctcccaaatcactgggacctgaggcataagccaccatgcccagcccaaatctgctatttttaaacaacgacagggatggggagacaagttggaggcctgagagcctgcccagttcctcctgctcctacaggaactggagaggagtgtgagtgacagcttctcctgtcctctgttgataccctccattttcaagccccagtgaccctaactactggcactgagcaggcaggctttcaggcagaggcccctccaggccctggaagcccatggctctgttttctgcaagcctcttacctctaccattgcttctgtgtgctggagtccatgctctgtccactgttcctagggatgtctgtggccatgaacacatccccatggacctctgagcagtgcccagtaatcatacacattctccaagcctctgtgaacccactgacaccacctgacagcagttccactcaaggaaatccttcagcttgctctgcttccagccacttaggccaggctgcagtccaggtgtctggggggccgtctagtgagacaacaagagagtcctcacagccaggcagggcaggaagcggcctggcccaccaacagcccacacccattgcgggctgtgcaacagggaaaaacagaatgtggacagagggacacacagtgagcctgtaacccctatgccaacatcagcagctaccacttcctcacttcctctgggtcctcacagtcattatctccaacctgcccctcccatgggcccacacagaggtggtggcaccgctaccactcaggaaacagttcacttcacagctacacagctattctcttggctagtaaataataactactttggtttttctcagcatttactatcatgttaatgagtgttccatacattatctcatattaccttcacaacaaccctcagatcagctgctgtcatgagctacttttttttttttttttaagagacaaagtctcactctgttgcccaggctggagtacagtggctcaatcacagctcaccgcagcctggaactcctgggatcaaacaattctcccgcgtcagcctcctgagtagctgggactacttgtgcatgccaccatgcccagataacgtttttaaaaagatttttgtagagacggggtcttgttatgttgcccaggctggtcttaaacccctgacctcaagtgatcctcccttggcctcccaaagtactgggatgacaggcatgagccactatgcttggtccactccttttttaagttgaaaataatttttatttatttatttttcagagagatgggatcttgctatgttgcccaggccggtcttgaactctcggtctcaagtgatcctcctgcctcagcctcccaaaacactgggattacaggcataagccaccaagcctggccctcagctgcgttttatggctaaggaaactgaagatcaggcataaaagtagctaggcaaccgtgagacctagcctcaattgtgggcaactcagtagtaattggcaatgactttgatttcaactcaaccaagagccaggatttgaacccagtgctgtgactccaggactatctttctgtaatgtcatgccatacaatgaaataacaaaagggtttgtggaaagcatgaagccttatgggccccacattggtgcccagttctaggtgatgtcttttagggtcctcttcatcctcttcctcccatctgcagggatggttctgcccccattacccagctgtcaccactggatctctctccatttgccagcccacctgccctgaccttgagtcctaatctcaggcccttgggcttggtggcttgctgcaaggtgcttctcaagctctgccgacagttgagagctctgtcctggcccagatctcatgtttgtgcaccagatccaagttttgtgaccttgagtgagggattctcacatctcatgggccattttttaggaccaccagtttcaattttccattgtgccataacacaccaatacaccaaaacagcaggagttgcagcagagaaagatcattggtcagccaaatgaggagatgggaggaaacctaaaatctgcctcctcaaaaggtttgggatggagttttcagggggtttttaagaggatgggtgattggctaaagtgtggggattcctgactggttgagaagcaagaggatgaagtcctgggacaggaagatgaagaaactgtatgcctgtcctgagtcagttccttggtgggggtcttcagattggttagccattctgctggaattcaggattaaacacacacacacacacacacacacacacacacatacacaccttaagcaattattgggttaaaaggtccagtgttagagattttatctataggaacaatgagggagcaggtagtcagtgtgctacgtgacccttgaatagttagcaactgcagggaagtggattaaagtgcacctgtgtaccctgatcaatgtctaaccataattctgcctaaagcctggcttgtaattctcgttaaccctatgagggcaatttcagcctccttctggcatctcctgagtaatagagaagagttcaggaagttgccagtcaagcttctttccaaggggtatctcaggcatgcctggctggctgcatcataaagaacaggaagtccatattagatggtggccaatgtgcagatgtgcagtttagtgtggcagagccatgctggctgagcagtgctgacttctcccaagtcctagccccaaactctagacaacccagtaccactgtcctttctgcagacttatgggaccagtaattgggaatgccttttattttgcctttaccaagttgagttcagttagggaatctgagtgccagagagagtgatcacaagctttgctgggcttttgggccatatgacatcaatcatgctatttatttattttgagatggagtctcactcactctgtcgccgaggctggagcacagtggcatgatctctcttcactgcaacctccaccttctgggttcaagtgattctcctgcttcagccttctgagtagctgggactacaggcatgcaacaccacacccagttaatttttgtattttagtagagacaaggttttgtcatgttgcttaggctggtctcaaactcctagcctcccaaagtgctgggattacaggtgtgagcccaattatgggattacaggtgcctggcccaattatgctctttaaaggatgtggacagacccgtcctcttcagatcactgtatgcagtctgaaagctctggccctttggtgttgaagacacagaattaaatataattcactattcttttatagttaaacatagcttatctataattgtgccctaccaactcctttaatcccaggcaaaatgcaaagaaatgacagtagaaggatggaggacatgcatggataagggagtgaatacagtgttttcaccctccctgctctgccagcttctacaccaaaggttctaaagtcattttcaatactttcctggcattctatttttaagctctgaggaaagaataaaggctatgagcctggcagtgacatccatgtctaaattatctttatacccctggcagcgtttagcttggagctcttagtaaacatgtagatagcactggattgaataactaaggaaggtaaattgttagaagttaaaggcatcaggctgggtgctgggaataccaagaataataaaatgcttaatacttacttagttgaagctgttgtagagagaggactaatggaccagtgtttgaactgtcagagtcgggaggacagaaatagagtgagagctagtagatgtgaagtagtgggtggtagggaagagggaatgcaggagaggagaggaagggatgggagcacaaaaaaaaaaaaaaaaaaaaaggaagggaggtggggagaataggacaaagccaatctagacatgcctgatccaggctactttttaggctttttttttttttgagatggagtcttcctctgtcgccaggctagagtacagtggtgcgatctcggctcactgcaacctctgcctcccaggtttaagcaattctcctgcctcagactcctgggtagctgggactacaggtgtgtgccaccacacccagctaattttttgtatttttagtagacacggggtttcaccatgttggccaggatggtctccatctcttgacctcatgatccacctgcctcggcctcccgaaagtgctgggattataggcgtgagccactgcacccagccttttagccaattttctaacatcaaagccctggtcctctatgacagtcacaagctatctatcaggctgggtcataagactgggatggattttgttttctttttattaattattatttttatttctttagagacaggttgttactctgttgcccaggctggagcgcagtagcaccatcatagctcactgcagcttcagtccccggggttcaagtgatcctcctacctcaaccacctgagttgctgtgactgcaagcatgcgcatccatgcccagctaatttttaaatgttttcttatagatggttgtccaggctggtcttgaactcctggcctcaagcaatcccccccagctcggcctcccaaagcattgggattacaggcattagccaccgtgcccagcctgggttgaattttaaaatggtgaaaataaacccatattattcttttcagtacatagtaacagcaacaaaaatcaaaagaaaagaaaaaagtcctcccagccctacttctgggctctatagatcaagctgctttcaatctgcatttcttgacttctctgaactgctcatcacaaaacacttcatcttaattcctcttgccagtcaatgacttgcattgactggcaagaggatccacgtatttagaagttcttaccaccgcggtacttaaattgagatatgtcttgaggtccatatttgtcaatcccatttctgagaagcagtcataaataaagcagaagattgaaattgaattttttaaaaggactttaggaggaaagccattatgcaaccgtcccgtttagtgaaagagaatgttgatttaaactgggaaaagtcagctcaccatctctagcatggcagagagaaacgctgaggaaaattctccctattttcaggagtagtagcttgctcctctgggaaggaggttaccagaaaggcccgcaaatgattggtaggatgcgagtaacaaattaaaatattctctttgccagaaacctgtgttgttgagaatcagacaaagggctaaaatttgcctgcgcttggattaccagatggtgttatttacgtaatttatgcgttaaatttcctccagtgttgcttttaacaatgtaaatggatttaaatggcttcctaagtgaattccttttggtaaaaagaagaattcctgtcagtaggaaggaagacatcagagacacatgctccagaggtggtggaacatcactctctatgttacagaacccgccatagctcgcccatctggctctgcaaacccaaacactgacattgcaattgcagcgagagaaagtgaggcagttattgcagggcgcccagcaaggagaatcgggcagctcatgcttaagacctgaactccctgatggctggtagggaagggtttttgtttgtttgtttgtgtttgtttttgtttttgttttttttgacagagtcttgctctgttgccaggctggagtgcagtggcacaatctcggctcactgcaacctctgcttcccgggttcaaacaattctcctgcctcagcctcccaagtagctgggactacaggcacctgccaccacacccagctaatttttgtatttttagtagagacggggttttaccatgttggccaggttggtctcaatctcttgacctcgtgatccacctgcctcagcctcccaaagtgctgggattacaggcatgagtcaacgcacccggccctaggtaagggtttttaaaggcagagaggcagaggttacaggcaaagtcagaaattgacacatggaagctgtacattgtttcgacctataaaagtaggactttttttttttttaagactttctctcttgttgcccaggctgcagtgcaatggtgtaatctcagcttattgcagcctctgcctcccaggttcaagcaattctcctgcctcactttcctgagtagctgggactataggcatgtgccaccacacctggctaattttttgtatttttagtagagacagggtttcgccatgttggccaggctggtctcgaactcctgacctcaggtgatccacctgccttggcctcccaaagtgctgggattacagacatgagccaccacgcccagccaaaaagtaggacatcttgaagcagggcccaaaggtctaaggtggagtcaaagattttctgatttgcgattgctccaggatgcaaagctctgtgtaaaaatctgaggtcagcagaaaagaacattagtgctccctcatggacatgacctcctccagaccccttgggaagaaatttagaaacaagcactgtggtcagagttcagtccacagttcccccttatctgagagtctacctgccagcaaatcccttgagtggggtctgagtttctgaaaaacagctcaagaacatatgctaagatgttatcttattttttttattttttatttttgaaatggaatctggctcttcacccaggctggagtgcaatggcacaatctaggctcattgcagcctccacctcctgagttcaagctattctcctgcctcagccttctgattagctgggattacaagcacctgccaccacgcccagctaattttttgtatttttagtagagacggggtttcaccgtgttagccaggatggtctccatctcctgacgtgatccgcccgcctccagccttgtgatcggcaaccgaaagtgctggaattacaggcatgagccactgcgcccggccggctggagggttttatgggagagggatatggggaaactgtgtagaggttggactcaagaagcaactgaggacggcagataatctgggcaccagcaagagtcctaagtgattgggaacttcttcgtccttggttagatcccaatgttcctgtaaacctttaacaaaacatagtggtgtacctacttcccctgtaatcccagagttagtttcaaaactatgtgattgctgctttgcattgtatatcagtgctctcaaattatcctaacttgcatgcaacaatgagtaaattccccttaaacaaaaatggactagttatgttaatttcttgttgtttcactgttacgttaagagacagtggtgaaatctttaacttcaggtatctatgtgcctatgctttcaggaagaaagcttctgaaaatagatcacaggctttcaccgggagggttttattttatattttattttattgcattattttattttgagatggagtcttgcttgtcgcccagactagaaagcagtggcacgatctcggctcactgcaacctccacctcctgggttcgagcgattcgtctgcctcagcctcccgagtagctgggattacaggcacctgccgccacgcccagctagttttttgtatttttagtagagaaggggtttcactatgttggccaggctggtctcaaacttctgacctcaggtgatccgcccacctcagcccccgaaagtgctgctagaattacaggcgtgagacaccatgctcagcctacaaaatattcaaaaattaggcgtagtagtgttcagctgtggtcccagctactcgggaggctggggcaggaggagtgcttgagcccaggagtttgaggttaccatgagctacagtcatgccactgcactcgagcctgggagacagagtgagatcttgtctctcaaaaaaagaatcaaagaaaaagattcaaaaaactttctgctacctggaagggaattttggacagattaaaagaagtattgatatacccagcagtagttcagatctgatcgggtagtgtgtcttccatgatctagaaaacattcctgaattcattacttggggaattcctggcagtctccagatgattcctcaagaaagtcaacaccggggtaggcagcctctgcggtctgctgttttctgttagcagaggccatagttctgcagactgggccatggtatcttgagatgccagagctgaaagaaacctcagagatagccccctgtcatttacagatgagaaaatagtttccgggggaagaatgcatgtgcctgacttctgggagaaatggagccagtggcctttcccactagagagtaaaatgattgatctttcttgggtctatctcagctcttgctagagaacatctccccactgattccaggctaggctgggctggctgatgttgacatactgtagggtagatttgcaccagaaggggtgccagggaacagcattcttagaagcatcagggtggttctgggtttgtgggaagagcgtttgggaagagactcaaatctagctcgtgttgagttctataagggcccttggttgactgactttaactttctctgcctggcatattatatcttctagtctatttccttttcctttctttaatttgttcctcttttcccacctcctaggccccctctccagacaatttcgctgcttactccctccagcccctctccattcattaatgtatgtacacattcactcattgattaagaactcagaactctttgggtacttacttatgttccaggcacagtgctgggcagtagggacacaggatgacacagtctgtcctcattgaggtaacagcctagtaaagaagggagaaagtaattttttttgcacgcccacatgctggcaggatcatgcaattacaaccgtgataagggctatgctagcatgttatagggaactctgtttttatctggggcttccttgagtaagcactgatggagctgaaagccaaagtttgattaggagttaactaggcagatgggggaggagtgtcccgggcaggaatggggcacaggggaggacaaaaggaaacatcatgggattgaggggagctgcagagatgaggctgcagggggaggctttgaagaccacacgaagattgaggatttattttcagagtggtcggtgggagccatcgaagtttgcagggccgtggaatgatcagttccaccctggctgctgagcggaggtcagactgaatggagttggattcggaagtggtggctgtggtccaggtgggagatggtcgtagcttgcaccaaggtgatgagggaggagaaaatgatctggtggtcatagtggatgtgaaaggaagtggatgcagttgagctgtagtgaagaggcatcatctgcaggacttggtgatggattggctggcgcctagggaggaagtggtgaggatggtgcctggctttctttctggtatatgtagcttccttgctcaatttgagtgacggaggtcgtggggagagagaacacactgtctttctgctccgggccacctgctataatagcatgcaagctctttcaagagagagctgccccctgttagtgccttgaagatccctggaaaagtggctttcacataatcagggcacccagggttctcaatttaatggcacaattgaaaactctcaccagaatattttggatccaaacctacttatgcccgaatgatccttcctgctgcttttgagaaactcctggcctctaaaagtcacaggacaagaccagaccttgaatattagaattctatgacaaggtgagaacagctgcctcactgttagggcagtagattccaaagtggggtacacaagatgatgtggaccattagagggacaagaggaatatattagcactcatattctaatgtcatttttggatttctatatatctaaatttttcatgtgtaaaatatattagcatagtagtatgtgcatgtactgaaaaataaataaagtaaatatattggagaaggtatgctttacatttttaaacatcaaaaatgtttggagcccatagcctgtgagcatagtgaatataaatgaaccagtcatgttggctttgatggcttggcctcctctttcctccctggctgcctaggctcctcagtgacaggtgcccaggggagcaggtggcctgggcagtacctggcaccctgcatcctcatttgttgcctgtggctcttccggggtccctgaagctactatccagctgtccaggctgtggcagagcacagcccttgcttaaattctttcagcttctgtaaaattgagtcatcagatcacaaccctggaaatgatattagaagccttctaagctggtggctctcaaatgtggctacacatctcaatcccatggggggcctttttacatacacccaggtgcctcaacttcatccctggggaatgtgatttatagggctggggtgggatccaggtgtttgcaattttatttcattttatggatggatggatggatggatggatggatggatggatggatggatggatggatgggtggatggatggatggattgacagggtcttgctctgtcatccaggctggagtgcggtggcatcatcatagctcaccgcagccttgaattcatgggctcaagtgatcctcctgtctcagcctcctgagtagatgagaccaccgccatgtgccaccacacctggctaattatttaattttcttttgtagaggctggtctcgccatgttgcccaggctggtcttgaactcctggcctcaaggaatcctgctgcctcagcctcccaaattgctgggattccagtcatatgccactgcgctgggcctagtgaaagtgtttagtaaatgatgaagttgaatgtatgaatgaaacatgtatcaaaagatgtaactaaaccaacgtgccactgaagactctccaaaatgatgaaaatcaatccccattgacattcatctcccatagtgtgtcttcttccaggacatcagctgtcaggaagcagaacaatgtgtcctgcctaagacttcccagaccccagagtcttgtgatggtttcttttgcctcatcccttccatattccagaggcctgggtagtttagggcaggctttttgccccaatgaatgaagcttcagtatatccagtggctaggggtcattcataaccctccttctccttccaagccatatccaatctattgttgatgattttgcctattaaaaatccctcggccaggtgcggtggctcacacctgtaatcccagcactttgggaggctgaggcaggtggatcacttaaggtcaggagttcaagaccggtctggccaacatggcaaaaccccatctctactaaaaatacaacaattagccgtccacggtggcacacgcctgtcatcccaactacttgggaggctgaggcaggaaaatagtttgaatctgggaggcggaggttgcggtgagccaagatcatgccactgccctccagcctgggtgacagagcaagactctgtctcaaaaaaaaaaaaatccctcaaatctatctacatctctattttgttgctgtcactaaagctatcagctcttcttccctgcaaaatagcaaagcattcttgttttctccatctcccctcttcatgctgccagtcttttccccacagttcagccagagtgatcttttcaaacccaaattcttcagtggcttctcatttacaacaaagatcaatttctttttaacatgacctccaggtaattgcctggtgtggaccctgcctacctctccaatattttccactattctcctctcttccagccctactttctgaatccattttctacgttccagccacatggctattctttcagctctttgaatatcctctatgtatcacttatgtattgcagtgtaagcccaaatttagtggcctaaataacaattgattggattaagattctgaagtttggaagtctgggctgcggtcagccaggtggttcttctgctccacatggccctggctatgcttatgcacacactggcattccactgatgggttgtcttgggggtgtacagtctcacatggcctcactcccatgccttagtcttcagccatgatatctggaatagctgggcctctattgctccattgtcttttatcctcagcttccttacagcctgacgggctcagaattccaagaggaagaaagtgcaagccgcaaagtctctaaggcctagtcctgggttgtgtgagacatcacttctgcattctgttaatcagtgcaagtcataaaatcagcccagattcaaggagaggggaaataggttcagcctttttataggaagagcaaataagtcacattgccaaggagcatgggtggaattgttgctgccatctttgaatacagtccagcacaccctgctctctccttcacaaggtcattgcaactgtgctggctgcccctgggcttgggactgttgcccacttcctctactcagctcagcctagcccttcagacttcaccttagtatcctttcctgggggatgctttctctgagcccactggccacatcctcgtgttacacgctagatttttagccctgtgttgttttccctcatggaaaagctccctttgtgatggtgcatttctgcctgtgattctttgattaatgcatttcccttgctagattatccacttcatgacagcaaggaccttgtctactagcacctctcatttcatccccctgcccagcccagtaggccctgaatggatcattttttgatgaataaataaatggatgagcgtctgtttctggagtcaccacacctcctggaggcccatatccatttaagcagggccacttccccacttccctagcaaagggtcaccaagaaccctgcggtgggttctttgcctccaggactggtcccagagcttggagcgtgccctcctcctggcccattccaacccatctggaagtcctcctccctccactgtgtgaggagccacagcctggggcgctttccatttgggcacttccctctgctcttggcatcagcgacatgccagtcagagtcttgttcctacctttctgtgcatttctcttcatttcttcagcctgcctaggaactcaccatgtgggctggtaaacactgatgtagagaatagatccgcaggaccctttcttgggaccagctgtacttgggatactcatagctgggtcttatgtgtggtagaaacataaactggatcgttccctttagagggtaccccttttgcttccagacctcttgggtggactcagaggccaaggtggaatatcactccttccgggaatacccctccataggggacttagctggactgttggtttattgctaaggctcaaaagccttcagtccactttcttgcatttctttccatctgctatgtaggcctggttgcttaaccactggcagacttcacatcagctcatcatcacttagagccagcccatgagctgtgctggtgatcacccccagccaacacagagcagagcctgaggcctgaagaatcacttgtctcccaggcatcttccagcctcccttgcacagccatgccgccacttggatccgtgcagcagcaggctttgacctctgaccctaggatgtcattggtgccactgcagatccatggagcttcctctgcatatatctatatgcccagctctgtcctcactgtttcccctgctcactgtggttacaatgcaggtcagaggcaccaaccaggcacccagagtgagggacagggctgtgactgaagagaagtcaaggggtctacagctgtaggtcagctctcccagggcaggaagggccagtgtctgctgctgtcgcatgtggtcgggggtgtggttctgactcctccccttactgactgtggggttatgaaccactttctccacctctttgaccctcagtttcctcatctgtgataagctgatgagggagttggttttggtgctttctgtcattactggactggtcctggagtttggagcaggcagagcaggtatacttgcctctctaaggggaggggcctgtgaaagtggagagtagaggagagatgagcaagaggagccctcgtcttctgtctcacacaagaggtgccgctaatgacagttcatgtttaggatttaaaatccagtctgagtcactggaggtgatgagctaaagtgcagacttaggctgaggcaggcaggataatgaccacagtgcatgcccagtgatggcaatgttgtgggcatccaggccagcagcaggattccagggcaggcactgaccctggcagttcaccctgggcttgctggaccccacagcagggcataccttcaagacatctgctattccaggagcctctgagtcctccccagactctacagggagagctgagggactttgggtcaatgcacacttagtgtgctggctgatatccacaccacagagcccaggacaggaagcccatgtctctgccacacaggacagatgtgctgagcttcctgccacctgtctgttacaccatctccctccccttgtttaaaaggcttggtgtccagcacagggctaacacagccaacatatggctcctccatcctctcacctccactcctaacagctacatccacttgaaccctcttgggagtttggctgcaccccaggcatgaaagccatcctgaccttggtctggatggcttgtggaggacatagtgccaagtcagactggcttgtgggttctgttcccacttggcacctgtgttcttatgactgggtttcaggcttttgctaaggtctcttatgcgcctgtgtctgtcatccctgctaagtccttgaagagttctgctttgcttccatccatcctcctgagcctccccaaactgagattcacgcccgaatctactttcccccatctctctgtttatctatctatctatctgtctgtctgtctgtctgtctatctatcatctatctatttttataatggctttgtagatatattcacataccattataattcgtccatttaaaatgtgccactcaatggttttttcagtatgtttgagctgtgcaaagttcaccacaatcaatattagaatgttttcatcaccctaaaaagaaccaccaaacccattagcagtcactctaccttcctccagccccctgcccaccacctcccaagcaaccatcaatttatttaccagacatttcatataaatggaatcatagaatatgtagtcctttgtgatttgcttattttgcttagcatgctttccaggttcatccatgttgtagcatgtatcaacatttcatttttttcccaaataatatcccatcatatggatatgttacattttatttatgcattaatcaattgttgggacatttgcttaatccaaggtcatgaatttttactcttatgttttcttctaagagttttatagttttagctcttatgtttaggtcgttgatccattttgagttaattttttatatggtgtgaggtaggagccatgtccattcttttacatgttgttccagcacaatttgttgaagatattattccttagcccactgaattgtcttgacacccttgttgaaagttagttgaccataagtgtgagagtttatttctggactttcagttctattccattgatccgtatgtctgtccttatgccagtaccacaccatcttgactatagtagctttgtattaaattttgaaattggggagtgaagtcctcccagtttgctcaaggttgttttagctacttgaggtcccttgtttttccttacgaactttaggatctgcttgttaatttctgcaaggaattcagctgggatttttatagggattgtgttgaatttttagatcaattttgggtgtattaccatcttgacaatgttaattcttccaatccttgaacatggtatatcttttcattcattcactgagtcttgcaacatcattgtgagaccctgattctttatatattgtccgtaccttgaaattcagccgccttgttttactctctaagacaccagtttcctgtctctattcccaggccctttgccaacatttggcctccttgacttccttccatggccagcagctgggtctaacctaacatgcgagggcatctagctgtcctgtcccagatcaaagaagtctggaacatctattctctactaaccacttagcccacaattcctcctggaagaagcaagcaaagtgaggattcttgcttatgggagaattttctatctgtatcgtttccctgtggtataaccgaagttgggaaatagaaacagaacatcatacacgcaaaacaaattttgccaccaaattcagccaacaaaagtcaagaagggggtatgtagacactcaagagtgtcccagtattcttgctttggtggttactgggagactaaaggtggaatggcttgaagtaacccatcttggaatgagcctacctgagtcagctcacctgcaaaaactgtcacttatgcagagcatacagtgtcttcacagcagaacagcctcacaggctcctgaaacttttctgtcattttcctttttttccactggtactaggaacctcatttccataaattaatttttttttttacaataaggttttttttttttttcccacctggaccaagagaagttggatagtccagctttccttttggagcaggtccttacggcctaggtgcctgccatccccatgcagagggatgagaagtcccacatccttgggcttttgcatccctcaaaggcagccatcattgcaactttctttctgaatagttcagtaatagcaagcgacagctgctcataatggcattggagtggatgcttccagaaggcttggcatctgtacctgtaggactccaaagtagagcatattaacagtgtagaactaggctgggagtagtggcacatgcttgtaataccaacactttgggaggccaaggtggaagaatcgcttgagaccaggagtgtgagaccggcctgggcaacatagcgagacctcatctctacaaaaaaatttaaaaattaactgggcatggaggcacgtacctgtagtcccagctacttggaaggctgaggcaggaggatcacttgaagccaggagttcaaagttatagtgagctgtgatcgcaccactgcactccagtctgggtgatagagagagaccctgtctcaaaacaaaataaaacaaaacttaacccagaactagatcattatatacatcttgtgctgatatgaataaagatctgtttcttagtatgaattttccattctacattggcagggcgcagcttcagccagatgggaaaggcagccttcagggatgtcagttgtgcattattgagaacataagaaaactcatgtgttgccatgggcagcttaggtttatgggcctttcttacctagaggtggattttatatcctgagctgttgtttctataagaattctcccaagcctcttttttatatgttttagtcaggttaggttagaccatgctgcagtaacaaaccaaccttgaactctcattggcattatttatttatttatttatttgtttagaaacaaagttttgccctgtcacccaggctggcgtgaagtggcactatctcagctcactgcaacctccacctcccgggttcaactgattcttgtgcctcagcctcctgagtagctggattataggcgtgcgccatcatgcctggctaacttttctatctttagtagagacgaggtttcaccatgttagccaggctggtctccaactcctgacctcaagtgatctgcccacctcagcctcccaaagtgctgggattataggcatgaaccaccgtgcacaacctctcattggctttatatattaaaatgtattttacgtttatgcaaagtcagctgaaccattgcttttgggcttggggagggggcatagcctctgggaatttctttttcaggctgatgaaatctttgtacccctaggtatggctctgtgggggcagcatggaggtccttccttgctcacgggtggcccacattgagcggaagaagaagccatataatagcaacattggcttctacaccaagaggaatgctcttcgcgttgctgaggtctggatggacgattacaagtctcatgtgtacatagcgtggaacctgccgctggaggtagggatcaccagcctttccccaccaccccagtacagtgatccttactgtttgatcactatttatttaataaaccaatcgttcctccccagaaaatgctcatgcttagaaaaattatgaatgcatttcaaagggattcacagatgtctcagctttagaactcctgcctaactccagggctagcacaatggaagtctctttaaatccacttacagagattagaagggtcttagtgtgttaatcccagtcttattatgttaatctggctgccctgctcctgatgatatgctgtgtccaggaagttcttgcccagatacttcacagcagactcttcatcctgccagtgtgtgacttcccatggagctccagctgccccgtatcatatgcctttactctatgccaaatcccctagctcttcagctctcctccacattctgctcagaagatggcccaaggaaatttccatgttactgcagccccacaggagtgtcatgcggtagttgtatattagcgtggtttgaatcccaactctatcatttatgagtcaggagatcttgaccaaatccactcatcttctctgtaccattcatcccttggtatccacaggggatttgttccaggattccctgtggatagcaaaactcacagatgctcaagcccctgatgcaaaatggcatagtgtttgcacataacctaagtataacctcctgtgtgtgtatatatatgtataaaatatatatttatataatatataaaatatataatataaagatttatataaatttttttatggcagcacaaaatttttttaattttatttttctattagttattggggtacaggtggtatttggttacatgagtaagttctttagtggtgatttgtaagatcctggtgcaaccgtcacccgatcagtatacactgcaccatatttgttgtctgttatccctcgcccccctcccactcttcccctgaagtccccaaagtccattgtatcgttcttatacctttgcatcctcatagcttagctcccacatatcaatgaaaacatatgatgtttggttttccattagaataatactctcgaatctcatccaggtcgttgcaaatactgttaatttatttctttttatggctgaatcatctctagattacttatagataatacaatgtaaatgctgtgtaaataattcttatgctttatttgtattttttattgttgtattgttcttactgggcttttaaaaaatattttcagtctgcagttggttgaaccgatggatgcagaaaccatggatataaagggttggctgtaccttattttcctcagctgtaaaatgaggataatagcagattctccttcttggggtgattgtaagaactaaatgaatttatacatgtggcatgctgagagtagcacctggcacagagtgcattgttcgtcctatgctgcacagcagggtaacctgcaccctcagccacagctcagtttatctcctcagccagagcacccataggtgtctgagccatgctggaaagtcacctggagtggtgcccattgagagatggcagcccctatgtatcaggaggctagagcccagaacagaagaaatacagttgaatatgtgccagatatgtgggtcaagaagataaaagtgaatttattcaatgttgttataagttttgaaatacattctcaagaattaaaaaaccccttctggacacttagcactttttagctgttaagtaataagtgcttttagccattattactattatgtaaagataggtaacattcgttgagcacttactatgtcccaggtacctagtaagtcgttatttgtaatatcttatttaattctcataacaacctcatgacataagaactgtctgcctcagtttcctcatctataaacatggattattaaaatttatctgataggactcccgtgaagataaaataaggctgagaacagagcttagcaaatattaagagttccataaatgctagcttgatatgaatgtattatgatgttcattttacagatgaagaaattgaagctatgagaagctaaaaggggctcgttcaaggtcccacacaaagcacatgggcagggaagtcagttcaggtcctcatacaaaacctcaccccagccctgtgaaatagtgaaataggtattattattattcctgttttataaaggggaattttttttttttgagataggatctcactctgtcacccagactggagtgtagtggtacgatcttggttccctgtaacctccgtctcccaggttcaagccatcctcccacctcagcctcctgagtagctgggaccacaggcttgcgccctctacctgtctaacttccgtattttttgtagagacaaggttttgccacgttgcccaggctggtcttgaactctttggctcaagcaatcctcccacctcagcttcccaaagtgctgggattacaggtgtgagccactgcgcctggcctcaagttttgacctggaatggtggtgtgacttagagttacaaataactcaagtcttttgactgtagccaagtgctttgtccatgactgcagacaatctctggtcccaaatgccagtggtaacctaccaggcttttaaaaaatgaccattagctcacgcctgtaatcccagcactttgggaggccgaggcgggcagatcacctgaggttgggagttcgagaccagcctgaccaacatggagaaaccctgtctccactaaaaatgcaaaattagctgggtgaggtggcgcatgcctttaattccagctactcgggaggctgaagcaggagaatcgcttgaacctgggaggcagaggttgcggtgagccaagatcgcaccattgcactccagcctgggcaacaagggccagacaccatctcaaaaaaaaaaaaaaaaaaagaccatttcatggatcatactaaatatattaaaacaaagagttaaaagttactgctcagggttgtctttgaggttgaataagtttgacatttaaagggatttccctttaaagtcattgtttgactgcccaagtgatcttaatgacataatttgaagtcttctcccaggccccccagtgcatcctgtctctgctaattcctggccatcttgcagctgagtctgcagagtcatatttcagatactttattttccctgtcagcacacagcagccattatgggttcatttctgtaaaagcagagtgaattattcattagaacatcattacaagctttgcaatggaaaattattttcacttctgcatgtaatgaacttcgcaaagagccaacaaaaggagaaattttgcaggtataggaaagaaaagacaggaggtggttgtaggcatttattttcttgtcgtaatcaaataattcctctaataattgtctctgatagttactaaggaaatgcgtaagagcagaaactgagaatgtaggtcgtcaacatcagcgtgtcccagaaatccatttgcacagcaatgataaggatggttgacctgtctgggacctttattgctgtaggttcctgattttgcttaggaaggaggattccctggcctgggtctggatgaatcaaataggtctccttaaaccacccttctggccgggtgcagtggctcacacctgtaatcccagctctctgggaggccgaggctggctgatcacttgaggtcaggagtttgagaccaacctgaccaacatgatgaaaccccatctctaaatataaaaattatccaggcatggtgatgcaagcctggaatcccagctactggggaggctgaggcaggagaatcgcttgaacccgggaggccaaggttgcagtgagatgagatcgtgccactgcattccagcctgggtgatagaccaagactgtgactcaaaaaacaaaaacaaacacccttctgaataagcatacgaggcttaagatctttttttttttttttttttgagacaaagtctcgcactgtcacctgggctagagtgtagtggcatgatctcggctcactgcaacctccacctcctgggtttaagtgattctcgtgcctcagcctcctgagtagctgagattacaggtgcccaccaccatgcccagctaattttttgtatttttagtagagacggggtttcgccgtgttggccaggctggtctcaaactcctgacctcgtgattcactcacctctgcctcctaaagtgctgggattacaggcatgagccaccgtgcccagcccaggcttaagatcttctatgtgaaggtttccctgaaagtgactccacctgtgccccactctggccagagctccacagtcactaacaccccttggcttctctctcctttcagaatccgggaattgacatcggtgatgtctccgaaagaagagcattaaggaaaagtttaaagtgtaagaatttccagtggtacctggaccatgtttacccagaaatgagaagatacaataataccgttgcttacggggaggtaattcagaccgtgcatgcttttggcttggaatgctgttcaatatgctgtgggttgcttcgctggggagaaatagagttgctcattcattcattcaatgagtggtttttggaggtgctggccctgatagcaagattctctctagctggggggttggggtagggaacaaatgtgatgaatgttacaatggactatggataaaagactatgatagtctactttgcctgagatatgtagcagataatgaatcctgtttgggaaattttgactttgaggtcctctgggacctgtaaatggagatattgagcaggaagtttggatgtaacgagaggcaggagggttggagtcctccattgctctgtgctgtgggctggaatcacttatcaaagaaaggaggaaacgttctcagattgtctatggtgtgatcatatcacctttctaaacctgaaagcaaagcgatttttctcttattacaaataccatcaatatgcatttgagaacattttggaaataataatactagggatgaatatttgagtgcttttgaagtactgggcactattctaagtgctttttgcatacaaattaatttcaccttcaccttatgagagattagcgttatttctgttttcttgataagaaaactgcaacttagagaaattatctaacttacctaaggtcacagagcgtgtaagtcacaaagccaaggttggacttggggatctggataccagagataacgtgtacactttgatgtgtgggcctccggactgtgtgtgtgtgtgtgtgtgtgcgtgtgtgtgtgtgcatgtgtgtgtatatgtgtgcatgtgtatatacccatgtattttttttactaaaaccattccattcacaatgcctaataatttgaaattttactcaataatatggaggatatataagtgtatcatgaaatattttttgtcagtaattaatggccgcacatggttccactttttgtgtaagctgggctttgcttgagaacatagacactggtgtcttttccaattttaaaatatcacaagtaccattgctgagaacatcttcatatagaaacactcatgcatccacctcattctcccttgtgatgcctgtttgagatggaatcggtgacacacagtcaggccaaggagcagagagccaggtgctctcaatttggctgagacaccccattagctctgcaatcgggttttctttcctgggactccctgtgactaccaggttaaagctaagaagaatccctttgacttaggagtatttacatttttctacaactgtggattttcctattctttgcctgctgccttttatagaaaataaatcaaccacaggttaagtcatcagggtgtagagtggtgaccctcctgagctggaatttggaatgggatgctcacatcttgcaagggcagtctctagggcggttagggatacatgaagactagagccagcctgctgggttcaaatcctagtaggctgttaccagctgtgtgggtctgcttggcagccattccctcatctataaaatgggaggaaggagagtatctcctctacaggattcctgggaggataaaatgagctgtgatgtgtgaagttcttagaacggtacctggcatggccaagcaccgtggctcacgcctgtaatcccagcactttgggaggccaaggcgggtgatcacttgaagtcaggagttcaagaccagcctggccaacatggggaagtcctgtctatatagatatatatattaaaaaactagctgagcgtggtggctggtgcaggtaatcccagctactcggggctgaggcaggagaattgcttgaacccgataggcagaagttgcagtgagctgagatcgcgccactgcactccagcctgggtgatagagtgagactctgtctcaaaaaaaaaaaaaaaaaaaaaatggtacctggcacacaacagtaattattaatagatctgaactgccttgccttttcttctccaaaataaaagcatgaattttttaaaattatcaaagtaagattaaatataaaggaagaatcaaacaatgggcagtgaatggattattcctaagacaataagacaattggctcaattgcctagctttttggaaaataaatcaatttagattcttacagctcaccatttaccaaagtagatttcagatgaactgtagcattacatgaaagaaataataaaagaaccatgaggaaatagtgatgaatctgatctctgaatgaggaagggctttctaagaatgaaatccacgcaagaaatgcaaaggaaatgtgtcatggatccaagctcataaatattaaaataatctgtacatcaactgagtagagaaataatacaccaaactgaaaatacatataccacaaatgctatagatgaacaaataccattaatatataataagctttgcaagttaagttaatttttttcttttttttgaaacagtcacccaggctagggtgcagaggcacaatcttggcttactgcaacctccatctcctgggttttagcaattctcctgtctcagcctcccgagtagctgggattacaggcacacgccaccacgcccagctaatttttgtgtttttgtagcaacgaggttttgccatgttggccaggctgctcttgaactcctgacctcaagtgatccactcgcctcagcctcccaaagtactggggttacaggcgtgattttaaaaatttgatttaaacaacaaaataaaacatcctcaaagaaaaataaacaaagtacaaggtcagttacacaagaaaaaatacacatggatgaaaaacacatgacaattttaaatttatttcatagtcaaagaaaataaaaaattaaatacacagaggtgtttttttttccccctatccgcaaatgaacaaagattcattttttgtgttgatactttacaggcaaggccttagtaatatgaaaaaaatcatatcttctgtgagtgcaaattgaaacaagccttttaaaaagcaatttgagccacatgtattaaaaagcttgataatgacagtcatagtttcttctccactcatatcccaagcaaataatctgaaataaggacaaagatttgagagtaaaattgttcagctcagacatgttatttttgaggaaatttttttttaatttaacttggagattagttgaatgtaatgcattcatggttggggatattttatagctgttataaatggtgcgtacaaaagtttaatgacatgagaaaaatattgataccataatgcttaagaggaaaaaactcaggatgataaaactgaaatcgctgctattttagattggaagcaagtgtgataatagcattgggaaatggagaagatacttataattaccttgggtagtaagtaggactttgggcagttttgcaagtgggtactttgtcatgcttttccagctttcactaatgtcaggtgatactttcatcattagaagaaaaatagttactaaaaaggaaataataaacatgatgaccagcctgtgccccccaggctggagtgcagtggcacaatcttggctcactgtagccttgaactcctggactcaagctattctcccacctcagccttccaagtagctgggactacaggtacatatcatcacatctggctaattttgtgtttttgtttttgtttttatagaggtctcactgttttgccaggctggccttgaagtcctgggctcaagcaattctcccacttccgcctcccgagtatctggggctataggcataaaccacttaggctagaaggctgccagagctgctgtgtacagctccaagtctgtgcactgcacaactccaggagctgcctttgacatcaaccacagtataaatgatgtcccttgagccgtacagtgggggtggcattgggggtgacattgtgatcatagtctgattatttggaagagagaagccttttgtttttacaaactttctttttaaaataataaaatcaatacatacattctatcggaaatataaagatgaaaactaaacttactccaaatcccaattcccagatataatcaatgttaacattttaaggcatctggttctattactccttttctacctgctgagtatcaccatttacagatatatatatttcagatggactatagtgttaaatgaaagaaaccaaattagtcaaaaaccaatttttaaatagctcttcctttttaaaaaaaaaaaaaagagatagggtcttgctctgttgcccaggctacagtacagtagcatgatcatgacatactatagccaagaactcctctgctcaagcaatcctcccacctcagcctccctagtagctgctaccacaggtgtgagccactgctgttggctctagacaactttttcttttttttgagacacagccttgctctgtcacccaagatggaatccagtggcgcaatctcagctcactgtagccttaaactcctagactgaagccaccctcccacctcagactcctgagtagctgggactacaaacacatgccaccatgcctagctaattttgtttattttttgtgaaggtggggtctcactatgttgcccaggcttgtctcacactcctgaccttaagcaatcttccagcctcagcctcccaaagcactgggattacaggcgtgagccaccgcacccagcccacatatgcttttaacgcttagggaaggagtcatctcctcttagcagttatctctgaatcctcggaaggggtaaagaagttctccttggccagttgcagtggttcacgcctgtatttccagcactttgggaggccgaggcaggtggatcacgaggtcaggagatggagaccatcctggccaatatggtgaaaccctgtctctactaaaaatacaaaaattagctgggtgtggtggcgcgtgcctgtaatcccagctactcagaaggctgaggcacgagaatcacttgaacccaggaggtggaggttgcagtgagccgagattgcgccactgcattccagcctggtgacagagcaagactccgtctcaaaaataaaaaataaaaaagaagctctccttgttggccctagcatatttcaaacattgcagtagaccgtggactactttagggcagggactatgttatttatcttttgctcattaaatttagcacagtgccaggcacttaccaggccttcaataaatatttattaaattactgaatgatagatttgattgcagaaacattagaacaaagtttaaaagcctggcagcctcaaatcatgacgtaaagcaaatattctgttaaaacattcatgtccttaatatgtaaagagctcttggccaggcacagtggttcacacctataatcccagcagtttgggaggctgaggtgggaggattgcttgaggccaggagatggaggctgcagtgagctatgattgcacccctgcactccagcctggagtacagagcaagaccctgtcactcaaagaaaaagaaagaatttaaaaatctgctcgagttgtctgagcctaaacacaatttgggtacataaagaacaaaatgccagccaggcgcagtggttcacacctataatcccagcactttgggaggccaaggcaggtggatcacctgaagtcaggagttcgagatcagcctggccaacgtggtgaaacgccatctctgctaaaaatacaaaaaattaactgggcgtggtagcgggcgactgtaatcccagctactcgggaggctgaagcaggagtatcgcttgaacccaggaggtggaggttgcagtgagtcgagatcgcgccattgcatttcagcctgggcaacaagagcgaaactctgtcccaaaaaaagaaaagaaaagaaaaagaacaaaatgccttttcctctctttgtttccatggagaatataacctggaggggaatgaatatagatggaaaggaccagcaacatgacctttttcccactcattgagaccctagggtggtggtgggatggatacccatatagatcacagtgcacccagagatccaaattagatcagttctcacatgctcccaaagacccatgcctagtttcacgggtgttgctttggggacttttgtctatttcctccgtgggtgcattccaaacaccaaacacctacaatggtgcttagtacagcataggtatcagtaaatgtttttgaatatataaatagatactgctagagcattttatgatagtaagcttttaggttttttttttcttttttttttagaaataggtcttgctctgtcgcccaggctggagtgaagtggtgcaatcatagctcactgcagcctggaactcctgggctcaagcgatcctcccgtctcagcctcctgaatagctgggactacaagtgtttgctaccatggctggttaatttgttttaatgtttttttaggatggggcctcgctatgttgcccatattggtcttgaactcctgggatcaagcgatcctcctgcctcccaaagtgctgggattacaggcgtgagccaccgcatccagcctaatttgcttttaggctcttcatgcctttatgcaaataatgacctgagaagctaacctctgattacccagtttattaaaaccaatgtcggtgctgaggcccacttacaagcctaaccatctggataactggattttacaagccacttagaagacttagaagccactgagaagcttagaagccacttagaagcttcaaagctgtttagaagtctaagatcggggtaaccagtgctcctgtatgcagaagttccctgagattgcctttcatgttaggaatggaggtgctgtgagggtgggggggcaagctgcccaggacacagtcagagacctagcatccatgccatccaccttaagacttgatctttcttgttaaggtgatcaccgcaaagatttgagccctggtcctcacttagaggctcgtgttgtcttcccatcatgaagttggaaccaagccatggtagaacagtgactcggcatccacacctccactagctgagctctcatgggtcgtgttttgtctattcttgcagcttcgcaacaacaaggcaaaagacgtctgcttggaccaggggccgctggagaaccacacagcaatattgtatccgtgccatggctggggaccacaggtaggagctcgtctctgaccaggaaggaagtaatatcaccatctccgacccacagaggccttgcaggccttctggataaactttgttgctgtctaccttggtagttatttattctgagaaaaatttttaagaagaaggtaggagtctttctggttatttctgtaaagaagctagggaaaaaattcataagtggttgttgcagcatgcagattttttttttttttttgagatggcgtctcactctgtcctccaggctggagtgcagtggtatgatctcggctcactgcaacctccgcctcccaggctcatgtgattctcctgcctcagcctccagagtagctgggactacatgcgcccgccactgcgcccagctaatttttttgtatttttagtagagacggggtttcaccgtgtcagccaggatggtcttcatctcctgaccttgtgatccgcccgcctcggcctcccaaagtgctgggattacaggcgtgagccaccgtgcccggccaaggctcacaggtttttctctgtgtgtagtggttttgcattcccccgaggtcagctgtgtaccctctgccacatcactgccggtagttctcaatgtccagatggatactcacccttcctcctaaggtgggtgagcaatgccagacaggttactgttcaaatcctcagccctttgaccttgcagcaactctgggaagtaggcaggcagcatgaggaaactgaggcacagaggggcaagtgcctgtgagcaaagcaacctagaacccaggctttccagcacagccaagcattttatactatttatttatttatttatctgtttatttttttagactgagtctttctctgtcacccaaactggaatgcagtgccacaatctcagctcagtgcaacctccgccttctgggttcaagcgattctcctgcctcagcctcctgagtagctgagattacaggcttgcaccaccctgccccagctaatttttgtattttcagtagagacggggtttcaccatgttggccagactggtctcaaactcctgacatcaagtgatccaccacctcggcctcccaaagtgctgggattacaggtgtgagcttccgccctgggccaagcacagccaagcattttaaagtcaaattatcacctgaggtcaggagttcgagaccagcctggacaacatggcaaaaccccgtctctgttggccaggtgcggtggctcacgcctgtaatcccagtgctatgggaggctgaggtgggcagatcatgaggtcaggagatcgagaccatcctggctaacacggtgaaaccgtctctactaaaaatacaaaaaattagctgggcgtggtggtgggcgcctgtagtcccagctactcgggaggctgaggcaggagaatagcatgaacccaggaggtggagcttgcagtgagccaagatcgcaacactgcactccagcctgtgcgacagagtgagactctgtctcaaaaaaaaaaaaaattagccaggcatagtggcgggtgcctgtaatcccagctactggagaggctgaggcaggagaatcacttgaacctgggaggtggagtttcagtgagctgagatcgtgccaccgcactagagcctgggcgacagagcgagactccatctcaaaaaaaaaaaaaaaaaagtcaaatgcgatccatttaaatccaagttatttatggagcaccatcaccatctacgattggtgaaaagtgcctgtggggagtaggagattggctgggaagcctagaccttctcctctccctgaaggttctctgtagggaaatggggatgcacatggaaagcaatatgagctacagaatctaatgcaggtggctgtgatggctgaggcgggaggattgcttgaggccaggagattgagaccagcctgggtaacataacaagacccccgcctctacaaaaaatacataaaatgagttgggcgtggtggcacacgactcaggaagctgaggtgaggggatcacttgaacccaggacttcaaggctgcagtgagccatgatcatgccactgcactcctgggtgacagagtgagaccttgtctcttaaaaaaagaaaaaaataagtgcacgtcttcattcattcattcactcaactaatatgtcttgattacctattctaaaatgctaggcaccactgtaacacaggcagctggtatgatgcagtctttgctcccaaatcgtttacccttgaaggggagggactagaaaagaggcaagaaatctacagtagaataagcgtaacccacggtgctggggcctgggaggtgggaggtagcccagtttggccggaactttgaatgcaagagggaagggagtgctgagagagaaggcagcagagaggtggagagcagatggtgagagacctaaggaggcctgcaccaagactccagcctgcacgctgcagtgggcagcagaatcgtccccaaggctgcgacaacaccagctcctgggccccatccccagagtttttgggtcagatctccggtggggtctgagagtttgcttttgttttctccttccttcctttttttctttttccctccctccctccctccctccctccttctctcccttcctcctccctctctcccttcctccctccctctcttcctccctcccgctctctcttcctccctccctctctcccttcctccctccctctctcccttcctccctccctctctcccttcctccctccctccctcccttcctccctccctctctcccttcctcctccctctctcccttcctccctccctctcttcctccctccctctctcccttcctccctccctctctcccttcctccctccctctctcccttcctccctcccgctctctcttcctccctcccgctctcccttcctccctccctctctcccttcctccctccctctctcccttcctccctccctcccttcctccctccctctctcccttcctccctccctctctcccttcctccctctatcccttcctccctccctctctctcttcctccctccctctctcccttcctccctcgcgctctctcttcctccctcccgctctctcttcctccctccctctctcccttcctccctccctctctcccttcctccctccctctctctcttcctccctccctctctcccttcctccctccctctctcccttcctccctccctctctcccttcctccctccctcccttcctccctccctctctcccttcctccctccctctctcccttcctccctccctctctctcttcctccctccctctctccctccttcctttccttccttcctccctctctccctccttccttcctttcttcctttccttttgtttcctttcctttcctttcttttccttccttccttcctccctctctccctccctccttcctttcttcctttccttttgtttcctttcccttcctttctttcttttcccttccttccttccttcctttcttccttccttccttccccccttcctttcttcctttcctttccttttttctttccttccttccttccttccttttcttccttccttcattttcttctttctttttttaagagatagggtcttgctgtgttacccaggctggagtgcaatggtgtgatcacagctcactgcagcctcagcctcctgggcttaagtgctcctcctgcctcagcctccttagtagctgggactaaaggcagatgccaccatgttccactcaattttccatttttttgtagacatagagtcttgctgtgttgcctgggcttgtcttggactcctggcctcaagggatcctcccaccttggcctcccagagtgctgggattacaggcgtgagcctcagcacccagccccagttttgcatttccagctgatttctaggtgatgctgatgccgctggtttgaggaaatgggacttgatccagaggatgtcagggagccactggaaggctcacctgggggtgggagaggtgatatgtttagactgcctacagcagttccagcagggactaagaagctatgtcttggaatagaccaaatgaaaagccctagctagtctcgggctgagatggccaagagttggatatagcaacttgtggtactgagcctagaggacttgaagaaaggggacatagagggtgggaggcagggcccagcacactccccacaccaccttcctaggatacccacagcctctggcccaggcagcaagatcccagaggctgagcctagggcagtcccactcctgggccccatggctgtgccggatcatccttttaggcaattactccaagagtagctgtgaaaagagcacttaactcccagacttctttgttcaatcttctgaataagtcacatttgaatggcgcacttattaacggtgacatagtagaggctatcccagttagatactggcataatcaaaaactgctccaaggacgtccacttgtcctatgaatgtggaacaaagtaaagatggtctgatcccatagcttccccatgtggctctaagcagttacattttgctttgggtgtttcaggggaaggttttgtttttgtttttgttttgtttttgtttgtttgtttgttttgttttcagacagagtctcgctctgtcacccaggctggagtgcaatggcgcgatctcgggtcactgcaacctccgcctcctgggttcaggcgattctcctgcctcagccttatgagtagttgggattacaggcgcccaccaccatgcccagctaatttttgtattttcagtagtgatggtgtttcgccacgttggtcaggctggtctcaaactcccgacctcaggtgatccacccaccttggcctcgcaaagtgctgggattacaggcaagagccactgcgcccggcctcaggggaaggtttttaaagccactcaggaagcacgtgggtgaacctgagggctgggatgtgaaggcggcagtgtctgccttctgtggccctgtggccccccaccctccccagcatctttaacacctttgtgatgcctacacctccagacatagtctggggcagactgctgtgaacttgaccttccttacctttctgtctggagcctttattcctctatagcccctccctcaagcttctgcccagtgggaacctgatagaccagcaggaatgcctggatggcataatttcaggacaacatggtcagaacttttctttcttttcttttctctttttagagacaaggtcttgctctgtcacccaagctcgagtccagtggtgcaatcatagctcactgcagccttgacctcctaggctcaagaaatcctcccatctcggcctctcaagtagctgggattacaggcatgaatcaccttgcccagctaattttttttaaaaagttttttgtagaaataggggtctccctatgcttcccaggctggtgtagaagtcctgacctctggaactcctgatctcaggcaattttctcacctccgcctcccaaagtgctgaggctacaggtgtgagcccctgtgcttgagcctgtggttaaaatttaatgagggctttcactctgaaggtgaccaccttctgactccctccccaggcaggaggcagacatcaagtctcctttcctgctgggagcttagtggcactcccagcacagtgtggcccctttgttaggaaatggctgggtttcatctttcccagttccacctgcgtgcggaacttttccaagtgaaagctcctgccatggagctgattagattgagttgatttagaacggcaaaccggattaggctgctcatggctcccccggctctgggatggacgcttgttaagtgggccccggctgctttccgtcagctgctttttaaaaagtcaatctcatgttgctttctgttcagccacgtgtcctgaattagagaacgcttggtgtggctctccagctgccaggcggtccctctactcactcatcaaagctcccccacttcccaaacccactccttctgtgcaaggagtcctgtcacccaactggaatccttctaaactgcttcccaaaatgccatgggtgcaaacagtggcagaatcagagctcctgtaaccaggcggctctcagcagaaggaattggtgctccacggacatcgctagcttaattaatggactctatgttgtaatttattatcaaacagcaattaaacagagataaaataggcactgaggagggtaatttcctgtcttgcagcatgtgtttgtcaacaagatgttccgggccactcagagagccttgcttgctcggaaatgtctgtcgccttggttttggctgattactaattagaattagacaaacatccgcttctttttggaagcctgagttttatttaaaaatagaatgtcaaggctgggcgcactggctcacgcttgtaatcccagcactttgggaggccaaggcgggtggatcacttccagtcaggagtttgagaccagcctggccaacatgatgaaacctcgtctctactaaaaatacaaaaattagccaggtgtggtggtgggcgcctgtaatcccagctactccgggaggctgaggcaggagaatcacttgaactcaggaggcggaggttgcagtgagctgagaccatgccactgcactccagcctgggcaacagagcaacactctgtctcaaaaaaaaaaaaaaaaaacaaaagaaaccatcaaggatgcagtagcagccttagtgttggcttgaacctatttggaacagaagttcttgtctaaggagacccacagacccccagttctaccaggctgttgccctcctgcacccaggcccagggtgggtccccaagctagagcaaccacagtgaaaccagaacactttggctaccctgcacggagagcaccctcctctgccaggcccttcttgctacaccgctccagacagctggtcaaccttctccagccacagcttctgatttctccagaaaggcaaaggtgctatcaggaagaaagagggggctaggggtagtgctgaccccagggacccactgtggcatctttctcagccctgaacgcccccgatggctctgcatctgctctctcaggtccctacagctgacccgcagcccagggtttgaacagtgcggcatacaatggactctggccccatagccgcgtgttccagcccctgcctagggacagctctgaacactctgggtcagggctgggctgtgttaaagaacaaaaatgctgacaataagacccatatctgtttttggtgacatgtttaatccttccaactactctgtctggtaaatagtaacctcctcccatccccccgactttattttttatttgagatagggtcttgttctgtcatctaggctggagtacagtggtgcaatcatagctcgctgcagcctcaaactcctgggttcaagcaaccctcctgcttcagcttccagagtaactgggactactggttatgaaccaccacacccagctaatttttcagtttttttgtaaagatggggtctcactatgttgcccaagttggtctggaactcccaacctcaagctgtcctcccaccttggcctcccagagtgctagtattttggatgtgagccaccttgcctggcaccacctgctttttttttattattattattaatgagaacatggagattcagatagggcaatgccagctgtcaaacgaatgtcccatatcatttggtcttgggtactctgatctgcatctggtgaattctggagagcacctcatatccttgagtccttcggtgttctccaggccacagcaaaacacagtggaaagactcataggaagcagagaggaatggaacatgaaagcccaggtgcagaggctggaatcacgaggcacatttcaggaaataatcacacagttggcagaagcaggtggttcagggtggcccaaaagggacagagtatggagatcctccggtgctaggatcaagggctagggcttccactcagcatctcaggtgtggtccactgacccagtgaaccctctggggacttattgtaaccgcctcttccaaagtccaacccccgacctagtggaggtggggcctaggattccacatcgtaacaagcattggcaggtgcttttctttgtcaatccacaactatttattgagcatctattttgagaacttgtttgggggttctagcaggggagtgcagatactcgtatacccttgaccaaagactggtcttcctctattggggatggtcatcctctttgaccaagcatgcagtttcaggagggatgcacgtggaggggtgagggagaaaggggacacccgtctagccagccagatcagctgaatcaaccctggcgatcaatgggatgacagaagttgcagccagatcaccctcacatccaagtgagcatctatttaggataatgctgtgaattaggccatataggtggtgatcatatgtccctatctgcccaggacagacgctgtttaggcctagtgtcccagcttgattttttgtttttaatttataacactatcttagttttttatataattgaggttcttgggtttttttttttttttcttttcaaggcaattactattttttttttttttttttttttttgagacagagtctcactctgtcacccaggctggagtgcagtggtgcgatcttggctcactgcaacctccgcctcctgcgttcaagcgattctcctgcctcagcctcccgagtagctgggattacaggcacctgccaccacacctggttaatttttatatttttagtagagatggggtttcaccatgttagccaggctggtcttcaacttctgacctcaggtgatccgcctgcctaggcctcccaaagttctggaattacaggcgtaagccacggcgcccagcctgtttactctttataatgtataattttgcaggttttagcaagcacatgtgatcaagtaatcacaccataatcaagatacagagcagttcaatattcccctgaacctctgcccacatatactttttaaaaagatttattttgttagagacagcatctcactctgtcacccaggctggagcacagtggtgccaccagagctcactgtgaccttgaactcctgggctcaagcaatcctgctgccttagcctcctgagtagctgggattacagtcacacaccaccataccaggcttttttattttttttttaaatttttgtagagatagggatctcactatgttgcccaggctggtcccaaactcctgggctcaagtgatccgcccaccgctgcctcccaaagtgctgggatgataggtataagccagtgcgcccagccttccacatacttttatacacatcacaatcacttttgaggaccatagttgagagagtgttcatagaagttgcctgtacacctgcacatgttcaaacctaacacgttcctgcaaattctgatgcagctttgtccccgagctgagactcactgcccctccacagcccataccatggacgaggtgtgactaacagggtctgcaagaaatggccctggagatttcgacgggcactctttgaaacagctactggctgtaatgagatgttcgtaagatgaggtgtgcactgtgggaaggaattgagggtgggagtccctcttggaaggtgtcaagctctgttcccaggacctttctgattcagtaggctcaggggaggacattagcgcccaggacctttctgattcagtaggctcaggggaggacattagcgacgtctcctctgtgtgtcctccctgttaatacattttcctcctcttctccgtcctttccgagagactcaacgtttcttctctcagttaattcatcaccaaaatgacagatgagattcttttatcctgtaattaaattcaatctgatcttggactcattctctgatggcttcatcttttaagcgatacatcatccaaacaccttgtcattatgatgcattgtgccaataaggcacccgtgccctgctggcgtgacggggctctggcgagctattagcatgtaggaggcacccctggtcgtcgtcggaaaacacagaagtgagtgacacccagcagcctcttggcttccagatgctatcatgtaagtgtcggagctcaggcaacgcagcctttgagaacacattgaagtttcgcccaagaaaagatggctttggtccagaaaacaggcctgaggttctgggaatatgcctctcccatttgataagaagcaaacttgatcatccctttccatccacgaaaacccaattcctagaaatcaccatgggggtcaaatcaggggatctgtagaccttctggaaaacagagttgggggactgaaggcagatactttttaaaaatttttttattaattaactatatatttcatgacaaggtcttgctctgtcacccaggctggagtgcggtggtgcagtcagctcactgcaacctcaatctcccagactacaggtgcacaccaccatgcctagctaatttttttgtgttatttgtacagatggggtcttgctgtgttgcccaagctggtctcaaactcctaggctcgagtgattctcccccctcagcctcccaaagtgctgggattacaagtatgagccactgcacctgacccagatacttttgatgctgagaaaacctgctgcacacacaaatgggagatgaaacagaaaataggagaggaaatgctgatggtgttctatgtatctgaaattcgacaccacagaggttctgaaccacttattttcattttccattttcaatctcttatgccatattttttaaaacctctccttttgcattccaatgcaacacttataaattcgtcttacctcgttgcatgcagatagtgagaatattaacagccttttttgttgttgctgttgctcttctgactcgtcttctctcaaaatattcaaaatgtttctgattttattactttgggttgttcgttcctgcctcctgggccctgcgtccatcagcctgtgtgtacactccttgcagccactctctttgcagacctccatgcaatgcagttttacatgctttctgcttgctgagattttccccgaggctttgggggacccaggcctctttctctgccatctgctttgcttctcttttctatttccaactcccaattccgtttttctaattatccctgagaagtggctctcgtgatccacgtgcagagcacaggaaggcttgagttcctaaatatttcctgctgatgtatcacctaagtttatgaaatattccaaatattctgttgtgtcctttcaacaatattcacaacatcttcatcaggagtagattcctcctcaagagaccactgtctttgcttatccattaagaaacaactctatatctgttcctgtttgatcataagattgtagcaattccatgccatcagtgtgcagaagtaaagacacatgtacaggcatacctcatttcatagcgtttcactttatggtactttgtagatgttgcattttttcacagatcgaagggttgtggcaacgtgacatcgagcaagtctatgggtgccgtttttccaacagcacctgctcacttcctgtcgctgtgtcacattttggtaattcttgcaatatttcaaactttttcattagtattgtatctgttatggtggtttgtgatcagtatctttgatgttactattgtaattattcggggcactatgagctgcacctagacaggaccgcgaacgtaaatcataaatgttgtgtgtgtttgacggctccactgttgggccattctcctatctctctcccaattctcgggcctttctattccccgagacacagcaatattgaaattcagccaattaacagccctataatggcctctaaaagctttagtgaggaagacaagtcacaagccaaataaggctgaaagctaggcctcttgtgccaaataatttgccaagttatgaatgcaaaggaaaagttattgaaggaaattaaacatgctactccagtgaacacacgaatgctaagaaagcaaaacagcctcattgttcatagggagtcagttttagtggtatggttagaagaccagtccagccacaacattcccttaagccaaaagcctaatccagaacaagggcctagttctcttcaattctatgaaggctgaaagaagtgaggaagctacagaagaaaagtttgaaggtagcagaggttggcttgaggtttaaggaaagaagctgtctctgcaacataatggtgcagggtgaagcagcaagtgctgatggagaagctgcagcaagttctccagaagatctagctaaactcattgctgaaggtgtctacactcaacaacagattttcaacgtagacagaacagccttctattagaagaaggtgctatctaggactttcccacatagagaggagaagtccatgcctggcttcaaagcctcaaaggacagcctgactctcctgtgagaggcgaatgcagctggtgactttaagttgaagctaaagctcatttaccattttgaagatcctagggcccttaagaatgatgctaaatctactctgcatgtgcccgagaaatggaacaacagagcttggatatcagtgcatctgtttacagcatggtttactgaatatctttttttttttttttcttttttttgagacggagtctcactctgtcaccaggctggagtgcagtggcgcaatctcggctcactgcaatctccgactcctgggttcaggcgagtctcccgcctcagcctcccgagtagctgggactacaggtgcgcaccatcacgcccagctaatttttctatttttagtagagacagggtttccaccatgttggccaggatggtctcgatctcttgacttcaagatccacccttcttggcctcccaaagtgttgggattacaggcgtgagccacaacgcctggccggtttgctgattatattaagcccactgtccagtcccacttctcagaaaaaaaaaaaaaagattcctttcacaatatcactgctcattgataatggtcacctaggagctctgatggatacgtaccaaaagatgaatgttgttctcatgcctgataacacatcatccattctgcagcccacggatcaaggagtaattttgaccttcaagtcttatttaagaaattcattttgtaagactgtagctgccatagatagtgattcttctcatgggtctggccaaagtccatggaaagctttttgggaagaatgtaccattttagataccagtaagcatgtttgtgattcatggaagaccaaaatagcaacatgaacaggagtgtggaagaagtggattccaaccctcatggatgactttgagggtttcaaggcttcagtggaggaaggaactccagatgtggtggaaacagcaagagaactagaaccaaaatggagcccgtagatgggactgaattgctgcaatctcatgatcaaacatgaacaaagagttgtttcttcacggataagcaaagacagtggtctcttgagatggaatctactcctgatggggatgttgtgaatattgttgaaatgacacaagagaatatttagaatattccataaacttaggtggtgtatcagcagcaggatttgagaggattggctccaattttgaaagaaattctactgtgggtaaaatgctactaaccagcattggatgctacagcgaaatatttcatggaagggagagagtcaattaatgcagcaaactttgttattctcttattttaagaaattgccacagccgccccaacattcagcaaccaccaccccgccaccctgatcagtcagcagccataacatcaagccgtgaccctccattagcaaaaagattacagcttactgaaggctcagatgatcactagtatttttagccatgaagtatttttaaattaagctatgcacatttttaaaaggcatgctattgcacacttaatagtctacagtatagtgtaaacataactttttatgcactgggaaaccaatatatttgtgtgacttgcctttttattgcaatattcgctatattgcagtggtctgcaactgaacctgcaatatctcaagatatgcctgtatttgattttgcctaaggaagactcagggttaaggaggaattactgtactatttctttcctgccagaatggattgatgagctattctttccaggaaatcacaatgacagacataaattgttttccagtggagattgtgagttgagacttttgtgtcttccgggaagtttagctgacttttctccaggcacaaaaagtcattcaggcaggttttgtgctcatgttaggcttggaataaggaactcagattgaacaatagagtggtagccatgtcaccagctgagcctttctcccttgcccagggatattaaattccacagccaaataagtgaaagtcacttctgctcctctttttttaatcttttctttctttctttcctttctttccttcctttcttccttcctttctctctttctctctttctttttttctttttttgaaagagtctgtttctgtcacccatgctggagtgcagtgccataatcagagctcactgtagccgcgacctcctggattcaagcaatcctcccacctctgcctcccaagtagctggaccacagccacacaccaccatgcttggctaatttttaagttttttatagagatggggtctcgctatgttgccttgctgtgttgaccaagctggtctcaaactcctggcctcccgcaatcttcctgcctcagcttcccaaagtgctgggatttataggtgtgagtcagtgtgcctggcccttcttttttactgaaggcacaatagcatttcagagagtttgaaaaacacaaatttaaatcatccatggtcctgccaccctacaacaactattattattactgaaggttactttcagcttttctttttttcaaagaaatatattgatttgttaggctgtctttatatcactgaattaaaaaggaaacaacgtcactgtttctgaaggacaaggagggggacgtaaagcctcctggtggaatgtatttagtgccttactctttactctttagctaggaggctcagcagagcgatgcagaacttcacagtagcctcatccctgactgcttgattcacagagctttgatttctccttgggacagtagtatctgttgaatgattattttcagtaagttcatagtgagatatgtacacacacatacacatacacataaaacaagctacataaacaattttattatacatacacaatgtatgtatataagtactttttaatttttttatttttattctatttttttttttttatttttgagaaggaatctcactctggcacccaggctggagtgcagtggcgtgatctcagctcactgcaacctccacctcccaggttcaagtgattcttctgcctcagcctccagagtaactgggattacaggtgcccgccaccacactcagctaatttttgaatttttagtagagatggggtttcatcatcttggccaggctggtctcaaactcctgacctcaagtgatccgcccacctcggcctcccaaagtgcatgagccaccgcacccagccataagtacatatttgttatagtatatacttagatagataactatatactagtgttagtattcagtgaaagtggatcatcataaagttcttcatccttgttgtcttcacatactataagtatataagtatatatttaagtatatactataatataaatagtgtgtgtgtatatagtgtgtgtatatatatctacaatacatgtatacatatatacacatatatatacacacacacacatacacacacacacacacacacacacacacacacacacacacacacacatatatatatatggagacaagaccaaaacaatgcaatgtgagatcctgggttggatcctgggaagaaaatccatgtttgtggttttgatttgcatgtcccttcaatgatagactggattaaaaaaatgtggtgcatatacatcatggaatactttatagacataaaaaagaatggaatcttgtcctttgcagggacatggatggagcttgaggccattatccttagcaaagtaacacagaaacagaaaaccaaataacttctctcttataagtaggatctgaattatgagaacacgtggacacatagaagggaataacaaacactggggcctattggagggtagggggtggagggtggtaggagggaggggatcaggaaaaatattaaatagctaatgggtactaggcttaatacctgggtgatgaaataagctgtacaacaaacccccatgacacaagtttacctgtgtaacaaacctgcatatgtacccctgcactttaaaaaaagttaaaaaaaaaaaaaagaatctataggaaagaaaacaagttctttgtaaagctggagcaagaccccagttattcaatggtgggtgaggtcggggaagctaatatccacatttgcttctcattattttatttaatccgttattttattagtctgttttcatgctgctgataaagtcgtacctgagactgggcaatttacaaaacaaggaggtttaatggactcacagttccacgtggctggggaggcctcacaatcacggtggaaggtgaaagtgatgtcttccctggtggcagacaagagaagagaacttgtgcagggaaactcccctttataaaaccatcagatcttgtgagacttattcactatctcaagaatagcacaggaaagacccacctccatgtttcaattacctcccacttggtccctcccacaaaacattagaattgtgggagctacaattccagatgagatttgggtggggacagagtcaaaccgtatcaatctccataaatgcactatgatgtaatctataattatcccaattttttttttttttttgagatggagtctcactctgtcactcaggctgaagtgcagttgcacaatctcggctcactgcaacctctgccactcaggtttaagcaattctcctgctgcagcctctgccacccagattcaagcaattctcctgcctcagcctcccaagtagctgtgattacagatgtgcaccaccacgttcagttaatgttcgtatttttagtagagacggggtttcaccatgttggccaggctggtctcaaacttctgacctcaagtgattcgcccgcctcggcctcctaaagtgctgggattacaggcgtgagccacggtgcccagccattatccccattttaaaaaataaggaagcagagtcccatagggctaaagtaattggcccagggccataaaatcattaagtagcagagcctggatttcttaagcaggccccagagtccaagtccttaaccattatactcctgtctctctaatgacacagcaaggtcagaaatgctgctgtagttggcaagcgaagaaagtgagctggttgagccgtggtacagaaagccagtgcttgctagcacgtccacactgaaccaggatacagccctcccttcccatttcacatatagagacaaaaaagaaattcatgtcatcagcggtctgtcctactgagaaataaagtctttacttccttaaccaattcagcagtcaaaggtgtgctttgaagatgtgcttaggaatattctcctgattccctagaagtcggagtggactacgcattccctctctcacccagctcttccagctctcatcctggtgccccacaccaagagaggccccaggtctctccacaggtcatgtgggccagaccctgcctccatcagaactgccccaatctatccgctcctagaactgtctctgcaagaaaatcagcctgaggtttttgtggcacaaagatgtatccccattcattccaagtagcaaatgcattttctggaaacatagtgcttgaatccagcatgatgagtcatatggcagaagggagaagccagcagaggaagggcccttgggaccatcccagcccccaggagctggccctctctgcaggaaccatctggttccatagcatgctttctaagctcccatatatatttttaaatcaactatatggaagcgtaaggtaaataaatacactgcatctatttaaagtgtgcaatctgatgagttttgccaggtgtgtgcacctgtgaaggggctcttgaaatcaagattcagaacatttccatctccctcaaggatttctcatgctccttttctaaccccagctctcaggcagccaccacttgcccactgtgagacatttattttctatattcagtttgggattgggcatttggaattttccaaaggcagcatcctctgtagatgtctacaggcccctggagacagagcatcttctcaggcctgtatcctccatgcctgggactgggtccttgctctcaggacagcctagaggggctcctgtcccctgctgggctgcctctttctttgcttggcccagcttcccaaacacccaggataataaaggagaaactctgtcaatttcaataatatacacatgtacttgccagtcataagaaaccattcttctgggctttaaccaagcaataaataaatgtactccaaagcagatctgaattaatggaatatatctctctgtctcttgagtagaagctgggaaacctgaacttttcttttttggtgtttgttttagagataggatcttgctctgtcacctaggctggaatgcagtggtgcagtcatagttcactgcagccttaagttcctgggctcaattgatcctcctgcctcagcctcccgagtagctgggactacaagcatgtgccaccatgcccagctagtttattttatttttatagagacggtgtttcactatgttacccaggctggtcttgaactcctagcctcaagtgatcctcctgcctcaccctcccaaagtgctgggattacaggtgtgagcccctgtgcccagccaagaaacctacattttgcatttagccattgttttctacactgactgctggattttaaaatcaagagaaaggcctctaataggaaagcaattgcaagccatgtttttattgataatctgatggattttgctgtgttctggagtcattctgcaattatttatctggtttttgtttatctggctataacctgcgtattctagttttccttcaaggctgttaaatttgggttaatagttgtatgtgtctcttagatcatctcaaatggaaaattctttccccctaaatgagaattaattgtatttgagctcagagggttttttcccaatgcattagggtgtggataatgacgttcatttctcctcatgagcccaggagccaaatagagtaatcccattcacttccaaagacatttatagagcatttgatttttgcaagatacttttgttggtccttaatgctggataaaaatgggtataatgctgctaaaaataacactaagaaaaacctatagcaaagaaagacacatttataaaatacgagattatgtaagttggaagaatcatatctgggtgggggctatatggagccagtggagacagggtggggctagggagagaatatcctgcacatacagggaaggcaggctggacggtcagctgttgttgagaaacctcatatcatctatcagactaagccagaaaagcaagagttacacctgaaaaggtaagtgggaccatagagtaaaaagtcatggtagaaagtttattcttaaattggtggaccatgagagcaatggaagattgaggcaaggaatggtatggttataacctgcaggactgggtagggtagatgggaactgtgagggtctggaggcaagagaaccagtgataaagatctgtctttatctgcatctgtctcagaatagtaagaatattcgggtctcagaatagtctggaattttgggaggaaatatttagaggcaggaatcggaggacatgcaaatttgtggatgaaaggatgagggaggggaagggtgcaaagttgattcaagtgcgcaagtctagaactaggggactctgggtgcgtaacagggagctaattgtctgttggctccacactgcaggaatgagagtcacaagtttcaggcagtcgtaaactcagagaataatgcattacccatccttctcctcccactagcaggattaccttggcaacagtgagcatcatcataccaaaatgatagatttcacagatagtggcttggccataatttggtgaatgagcatcacagtaatgaaatagctttcagtagtagagtacattagatactttgaagggtctccctgctctcatatagacagattttagataaactataacaaatattatttagattttttttctaggctcataagaaagtggttgtatcagccgggagtggtggctcatgcctataatcccagcactttgggaggcctagtcaggcagatcacctgaggtcaggagttcaagaccagcctggccaacatggcaaaaccctgtctctactaaaagtacaaacattagccaggcatggtggtgggcgcctgtaatcccagctactcaggaggctgaggcaggagaattgcttgaatctgggaggcagaggttacagcgagccatgatcacgccactgcactccagcctgcgcgacaagagcaagactctgtctcaaaaaaaaaaaaaaaaaagaaaagaaaagaaagaaagtggttgtatcagtgagcttttgctgcataacaaattatccccagacattttcagataaactaaatctgacagtgtgtctgtcctatgacagacagtcaccaaaggaacttctaaagaatgtactgtaggaaaaaggaaaatgactgcagaaggatgtcttgaggcaagaatgaattataagcaaagaaatttataaacacataaatctatgcaaacatttattgcataaaatcataagaataatgtctaatttggggaacaagggagatataaccaaaatactgaactattagaaggaagtgatcagatttggtatcctaatgtctttgaattttattgaggggaagcagatgttaagatattttataaaattagattttgcaaagttgtcactggttaaatttgaagagtaaacaataaaataatagaaatggagtgtgatttttaaatctgtagaggggaacaatgaaatctgataacatgtcaacaaatcaaccaaacgcaactaatccaagcaaaggcaagtagaggagaaagaaggaaacagaggagcctggacaaacagaaagcacaaagagagatggtagaaataagtacaaatatatcattaattacaatgaatatgaatggatttaactcttcagttaaaagacagagattgccaccttaaatttttaaaactccagctgtattccattttcaagagacacataaaaaacctcaggagagcgccgggcccagtggctcacgcctgtaatcccagcactttgagaggccgaggggggcagattgccagaactcaggagttcgagaccagcctgggcaacatggtgaaaccctgtctctactaaaatacaaaaaattagctgggcatggcagcgtgtgcctgtaatcccacctactcgggaggctgaggcaggagaattgcttgaaccagggaggtggaggttgtagtgagccaagatcatgccactgcacgccagcctaggcaacagagcaagactccatctcaaaaaaaaaaaaaaaaaaaaaaaaatgaccaggtgcagtggctcacacctgtaatcccagcacttcttgaggccgaggccggtggatcacgaggtcaagatatcgataccattctggccaacatggtgaaaccccgtctctactacaagtacaaaaattagcctggcatggtggtgcacctgtagtcccagctactccggagtctgaggcaggagaatcgcttgaacctgggaggcagaggttgcagtgagccgagattgcgccactgcgctccagcctgggtgacagagtgagactctgtctcaaaaaaaaaaaaaacccaaaaaacaaaaaaaaaaccctcaggagagtgaaatgttgaattaaaaagatggaaagggttatgtcaggcaaattctaaagagcagaaagctggggtaacctcgttaatatcaaacaaactagcctgtagatcaaaatgcgttattaaagatgaatgcggcctggacacagtggctcatgcctgtaatcccaacactttgagatgctgaaatgggagaatcatttgagcctaggagtttgaggccagcctgggcaaaatagtgagaccctgtctctatgatttttttttaaataaccaggtgttatggcatgcacctgtagtcccagctacttgggaggctgaggcaggaggatcacgtatgcgcaggagttggaggctgcaattaactatgatcactttactgcactgcagcctgagtgatggagtgagacccctgtctcagaaaaaaaataaggtgaagtgtgtcagtgtatgatgataaaatattccgttttccagtaagatagaataattattggccaggcacagtggctcacacctgtaatcacagcagtttgggaggccaaggcgggcagatcacttgaggctaggagttcaagaccagcctggccaacatagcgaaagcccatgtctactaaaaatacaacaacaacaacaacaaaaaactagccaggcacagtgatgcacacctgtagtcccagatactcaggaggctaaggcccaagaatcacttgagcccaggtggcggaggttgcagtgagccgagatcacgccactgcactacagtttgggtgacatagtgagactttctcaaaaaaaaaaaaaaagaagaattcttaactacttaacttgtatgcattctcaaatctgtcttcttctaaccttcactgtcacacttgagttcagaccttcatccgcccctctacttccatcctcattgcagttcattctccactcaacagacagtgtggtcagcctaaaattcagatggctcttgatgagaaagccccgattcctgagcttgatggactccatctagtggagtctcacctgcactagacccagctcccccacctctatactccatcatggtgaaagctatgcttgggttctccaaaacaccacatttcctctggtctccaggcctttaaacagctgctccatattcctggtctgatctgtttttctcttacttgcctagttggctgactccatcagggcttgacttcaatgccttctcctctgggaatccttctttgaccttcctcttttggatggggactcatcctattctgcttttatgaaccaccgtgtatttcctagcaatatttcacattttatcattgcctttttacttgcctgactccagtgagtaagctgtgaacacctcgaaagcaagcactgtgtcattcattcatgatgtcaacaaatatttatcaagcacctactatatgccaggcattcttctaagagctagagatagagcagtgaacaaaaaagttaagcaaacacacccctgccttcatgccactctcattctagccaagggagccaaacaacaaactgggtaggtaaggaaaatagatggtttaatagaagatgataggtgtttgcagagaagtaaagcaaggagaaagatagggagtaaggggtggatgtgaaattttaaataagatgatcaagggaaagtctcagaaagaatatgacatttggccggtcacgatggctcacgcctgtaatcccagcactttgggaggccgaggtaggcagatcacctgaggtcagaagttcaagaccagcctggccaacctggtgaaaccttgtctctactaaaagtataaaaattagctgggcatggtggcaggtgcctgtaatcctggctactctggaggctaaggcaggagaatcacttgaactcaggaggtggaggttgcagtgagccaagatcacgccattgtactccagcctggataacagagtgagactctatctcaaaaaagaaaaaaaaaagaatatgacatttaagcagaaacttgaaagaggtgagagagtgagccattcaaacatctggaggaggcactcctgggtatctacccaaagaaaaaggagtcatcctatcaaaaagatgcctgcacttgtatgttcatcacagcactatccacaataacaaattcatggaattaacctaagtgcgcatcaagagtggatgggataaagaaaatgtggtgtatgtatatatatatatatgtgtatatatatgtatatatatgtgtatatatatgtgtgtgtgtatatatatgtgtgtgtgtgtatatatatatacacatatatatacacatatatatatgtgtatatatatatacacatatatatatacatatatatatgtatatatatatatacacatatatatatatacatatatatatgtatatatatacatgtcatggaacactatgcaaccataaaaaagaataaaatcatatcctttgcagcaacatagatgtagctggaggccattatcctaagtgaattaacaaaggaacagaaaacctaataccacatgttctcacttataagtgggagctaaacattggacatagaaatggaaacaatagacactgtggactaccagagtagagagagagggaggagggtaagggttgaaaagtgcctactgggtactatgtttactatttgggtgatgggttcagtagaagcccaaacctcagcattatgcaatatatccatgtaacaaatatgtacactaccccctgaatctaaaacttttaaaaatagaaaaacagaaagatacctaaaggaagagtattcaagagagaaggaacagccagtgcaaaggctctgagcaggagcaggcatggacggttcacagatcagcagggaggcgcatgtggctggattaaataagatgatcaaggaaaagtctcagcaaacaatatgacatgtggctggaagttctggaagctcagaaagccattattggattgcaagacccatcgcaaggatcttggacttttattttgggtgagattggaagcttccagaagattttcagcagagagatggcacaccctgactccaatttaaagtaacatgattttaaataatatagtattttaaaagcagtcactctggatggtgtgttgataaaaagctgagggaggcaaggagggggaactggggaaccagttaggaggccattgcactaaccttatcaagaaaggaagttggcttagaacagggaggtagctgtggaggtggaatctggatatgatttgctaatggattgaatatggtggatcagagaaaggggtaagtaaggtgtttggcctaagcaactgtaaggatggagttatcattaccaagaaggaatagatgctggatgagtgtatgggtgatggtggttacacaagaggatcagttcagttgggtcatctaaatttaaaatgcttattagacatccaagtggtatgtcaagtagggagctggatatacaaagttggaattgagagaaatttttggtttggagatagaagtttcaaacagccaaattagcatgtaaatgctattgaaagcgctgaggatggaaaactctccaagaaagtgactacatataggagaagttatatcaactgtactcagcacagcgcctgggggcaattgaagtttataatttatagatcctggtttattaggctgttcttgccttgttttaaagaaatactggagactgggtaatttataaagaaaagaggtttaattggcttttggctgtacaacatctgctcagcttctggtgaggcctcagggagcttttgcccatgacggaaggtgaagcaggagcaggcacatcaatgggcaagagtgggaaaaagagagtgaggtgagaaggtcctagacttctaaacaaccagatcttgcattaactaactaagcaagaactcatttatcaccaaggggatggtgcttaaaccattcataagggatatggccccatgatacagttacctcccatcagaccccatctccaacaccgtcaatcacatttcaacatgatatttggaggagacaaacactcaaaccgcatcacctgataacctttaaaagagcaatttcaataaagtaacaatggcagaagttaggtttcaaggcattaaaggtataagagagaggaaattcaaattaagagataagtagagctgtggctagagtcataaagatccggttatatttgtagcttgattgaagaaatgaaagaaaggagtgaataatggcttagggtacctacagtgtgggaagagggtcagagaccgaaggaaatgagagtgaaggaagacaggtttttgagaagtaagggagacaacttttcaacaaaatggaaagtaatattctctgaaggcagtaagggcccaggacaccaggataggagattgaggaggaagaacacatttttaaaaatctagactctggcagggatggaaggcagtgttggttgacagagagtcacatgaggcaaatgaaaagatgagaagggcccaggcacagttggaacacaggtctccagtgggtgtggtcagttggcacctgtccctggctgtgtgaaagcaaagaccaaggagacccgtaaaacctgtagttcagagtgaccatgaggtacctgggtggttggtgtgatcacagaggtgtattaaacacactacttgcactggcaatgaacattctgaaaagggaattaagagaacaaaaccatttacaatagcatcaaaaaggattaaatgcttaggaataaatttagccaaaaaaatgcaagacatgtacactgaaaatgagaaaacattattgaaagaaattaaagatctaagtaaaaaagatatcctgtgttcatggattagaggacttaagagtgttaagatggcatttcttcctaaattgatctagagattcaatgcaatccctatcaaaatgccaactgcctttttttttttttttgcagaaatggaaaagctaatcctaaaatacatatgaaattcaagggacacaaaatagccagaacagtattgaaaaagaacaaagttgcaagactcacacttcccagttctaagacttgctacaaagctataataatcaaagcagtatagtgtggcacaaagatagacgtggagatcaaaggaatcacatttagagtctagaaacaaaccctcacatttatagtccattgatttttgacaagagtgacaagacaattcaataaggaaagaatagtcttttcagcaatggtgccgggacacagatatccacatgaaaaagagtgaatttggacctcaaccttatactatacagaaaaaaaattcaaagggcatcaaagacctaaatataagagatgaaactataaaattcttagaaaacacaggggtaaatcttcatggccttggattttgcaatggtttcttagatatgacttcaaaaccacaaataaccaaagaaaaaaatagctactttgtattttaccaaaaagaaaaactttgatgcttcaaaggacattatcaagcaagtgaaaaacaacccacagaatgggagaaaatatttgtacatcatatgtcagaaaaatgtcttagtatccagaatatgtaaagaactcttaaaactcaaaaataagaagacaaataaccctttttttgatggtcaaaagagttgaatagacttttttttcaaagaagatataaaacggtcaataagcaaatgaaaagatgctcaacatctttagtcattagagaaatgcaaattaaaaccacagtggccacttcacactcctactaggatgactagaatcaaaaaaagcagacaataacatgagttggccaggatgtggagaaattgaaaccccggttcattgctggtgggagtgtaaaatggtacagctgctttggaaaatagtttggcagttccgtagaaagttaaacatagagttaccatatggcccaaggatgagtaattctactcctaggtgtatacctcagagaattgaaaacatatgttcatatgaaaattgtacatgaatatccacagcagcatcattcataatagccaaagaatggaaacaaccccaatgtccatcagcttgaaaatgaataaacaaaatggtcaaaatgaggagaccacaccttgaagagacacattaaagcagcacatacatccagttgctccaaagacctgaaaggagaggtctgggggctggaagacattgtgcaggagagagaatcacactgaagcctaggaaagttgaagccagaacattctagaggaaggccaatcagtagcatctccaggcagagaaatacacctagacaaagacttagaggcaggaaagcctactgaacgtgcagaggacaggaagaagagacgctcaaggaaggagcatgagggatgaggagtcatggtaggtggacaataccccaaaggctcctggttcaggactggggcaaactttggacatttggttgacagcagatccaagggttcgctacccacctgcctcatggtagaaaagcggatgtgagatctgtttgcctaactttagccccatcattcttcagaccacagtactggcttctaactttctcagaaaaggaggcaagtattggtcccttggccagaccagcagaacctatgcacatgacccagtattttcagtgagataaacaccttcccctggaaaggaaatcccactcaggggccctcctcacctgccccagcctaccctgcatggctgcatggcttaggactgccatgtggcctctgcaggtcctggcattctaggtctcattgtttcactccctaacagacctcagaaaggagaacctctaactcccagtggcatttagcttccctctttaaacatctgggtcacagatatgctcagttaattaatgttcttagtgctgctcatctgcctgctggataatagattgattcataatttcagtaagcagctgtgtatatctttccctgaacataaaggcagcttgctgtcattcatcactttgcatttggagaatttaaatatattcaggcagacattgtttagggacggggagggagggcttctgattttcttaccattttgcttctaacaatgactttgatttggaactaattggggtttaaagcacacgttaaccacatctctctcaagggcacttaataaactccctgtcccttgttcaaggagaccagccaggccctccttttgggataagagccaagagcttctgagtacctttcaccaagaaatgagaaccccatgcagagaatcttatctgccagaaaagagccactcctgtccctgagcagagctacttatttcattcctgggcagaatatgctcaagctttctggaggaggtggggttctcctggcaatctgggagggggctcttctgctgctcagctgctgggccatggcagccaaccatgaggtattcggtgaccaaaagaaagcggccagcacccagccaggtgaccagatgtcttcatgcctcagtttcctcatctataaaatgtaaagaataataaaacatatcttgcagagttgttgggaaaattgcattatttattctctttacaatggttagaaatgatgcagagtatttttttttaatttattaggcaacagctgtgtagatgtggctgccttttcaaatgatgccattcaccacagttatgtgctcaaccccaaacacgttttgagcacttggtctgtgatttgctcctagtaaggaaggaaattaattaggcacagcccctccctctcaggagtgtgaaagatggatgaatgaatgcattttttttattttggaatatgattcttaaacaatataattttccttccccaggaaagtaaaggcagcagaggcgaggctactagcctagtacaggccctgttgtgggaaggttgccgggcaacaccttccctgtatcagtcaggaattgctgcataacaactaccccaaaacgtagtggcttaaaacaatatgcattttttattgctcacgagtctacaggtcagctggatggttctctgatctggactaggcttggctgatctaggctggactcattcgtgcatctcctatcagcagctggcaggttggctgagggctccctgatccaggttggcctcatccatttggttaactggtggttaactagcaattggttgggccacatgactctcatcctcaaacaggccagcctgggcttactgttccaagagactgaaaggattcatacaaggctaaaagtctagtctaggaacaggcacagcctcacttctgctccattccattggccaaagcaagtcacagggccaaccaacattcaagggatgggggaacagactccatttcttgatggaaattgcttcaaagccatcttgccatgggtgtatagaaggaatagcggaggatgtggtcagttttgcaacctaccacaatcatccagcatttgttgttgtacatagagcataaagcaagtactaggattatgttgcccacttgcagtatttttgctctgctctttcattattataaattctgttgcaataaataccctacccatgaattttttgtttgcaattctgattatttccttctgatagagtgtattagtccagtcttatgctgttaataaaaacatacccaagactgggtaatttataaagaaaaagaggttttaatggactcatagttctacatggctgaggaggcctcgcaatcatgttggaaggcgagggaggagcaaagggatgccttatggggtggcagggaagagagcatgtgcaggggaactgtcctttataaaaccagcagatctcatgagacttattcattatcatgagaacagcatgggaaaaacctcccttcatgaatcaattacctcccaccggtccctcccacaacacatgaggattatgggagctacaattcaagatgagatttgggtggggacagagccaaaccatatcatggagttctacaaatggattctttttaatttctattttgattcagaggagtacatatataggtttttaacaagggtgtattgcatgatgctgaggtttggggtatgcttgaaatcgtcacccaggtagtaagcataatacccaataggtagtttttcaactcttgccttcctttctccctccctccttttggcattcccagtgtctgtaatttccatctttatgtccatgagtacccaatatttagctcccactcacaagtgagaacatacagtgtttggtcttctgattctgcattaattctcttagaataatggcctccagctgcatccatgttgctacaaaagacatgatgctgttctttttcatggctgtattgtattccatggtgtataggtaccacattttcttcatcaaattcaccatttatgggcacgtgggttgattgcatacctttgctattgtgaatagtgctgcaatgaacgtgtaagtgcatgtgtctttttggtagaatgatgtcttttcctttgggtagatacccagtaataggattgcaggtcaaacagtagttctacttttagttctttgataagtctccaaacttctttccacagtggatgaactaatttaccttcccaccaacagtgtataagcatgccttcttctctgcagcctcatcaacctctgttattttttgactttttaatgatagccattcttgctggtgtgagatggtatctcattgtggttttgatttgcatgtgtctgatgattagtgatgatgagcattttttcacatgtttgttggccacttgtatgtcttctagtgagagtgtctgttcatgtcctttgcgcataaaagtggattaattgaatcaaaggccatgaacattttaaaagaacgaagtatatatttagaaatctcctttttgaaaggttgtagtaatctaccctccctccagcccaatagtgagagggcccatcttagacttaggtcaccaaaatgtggtgaataatctctgattttagtttcagtttttgggtttttttttttgtttttttggtttttgtttgttttttgagacagagcctcactctgttgcccaggctggagtgcagtggcacaatctctgctcactgcaacctccgcacccccaggttcaagcaattctcctgcctcagcctcctgaatagcttggattatagttgctcaccaccacacccagctgatttttgtagttttagaagagacggagtttggccatgttggtcaggctggtctcgaactcctggcttcaagtgatctgcctgcctcagcctcccaaagtgctgggatcacgggcatgagccactgagcctggcctaatctcttttgtaaaatgtggtatcttattattttagatttttgtttcttttcatacctatgaggttgagtactgtttaatgtctgtttcttcagtgaatggcttctttgagccttttgcagcagggtagatttagtcaatccccctttgtaagtggggaggaaatggagactcaggttacttgttcaaggtggcccagccagctgaaagtagagccatttagaaattagacatccagcttcttcatctattccttctccccgatgttgctgaacagaagactaggtcctaaaacattgactgaggatatgcttagataaaagatcagggccgggcgccgtggctcatgcctgtaatcccagcactttgagaagccgaggtgggcagatcacgaggtcaggagttcgagaccagcctgaccaacatgatgaaactccatctctactaaaaatacaaaaattagccgtgtgtggtggtgcgcgcctgtaatcccacgtactcaggaggctgaggcaagagaattgcttgaacctgggaagcggaggttgcagtgagctgagatcgtgccattgcactccagacaggacaacagagtgagactccatctcaaagaaaaaaggaaaaaagatcagagagttgccctggggactctgtatccaggctcagaagcctgggtggctttctggaacagggctgtcctgtgaggtgagcatatggcctgagtgacaggctgggatggtggccaggactgcagtattgacaaacagcaggagtaaagccgagagacctgagccctgcttcctcccatgtctcactcctgcctcccacttccattcccctgctgctctggtctctcgacagcttgcccgctacaccaaggaaggcttcctgcacttgggtgccctggggaccaccacactcctccctgacacccgctgcctggtggacaactccaagagtcggctgccccagctcctggactgcgacaaggtcaagagcagcctgtacaagcgctggaacttcatccaggtgagtgctgtatggacagagccagcacccagagtagctgcaagaggctgcagaccacagaggggaatcctgcttccccaggggtccccagcaaagagcgaccccgaacccaggtctccctgccccgggctgggcttgtggacccaaagcacttcctgggggcagctgtggagtttctgcatggagtagcatttctgattcctatgtcagtgctaggctggttgagctctgatcaatcctgagataggagtgaggggggacttccttgaaatccactaagtacccacagccagtggggttgagaccatcagaccaagaatatcccaggaaactcaacatcctgaccccctcctgaccccatcccccaccccccaccaacgctcctcacctgattcagatactccaactgggtgaagcttatttaggttctgacttcagagtccccagaggaggtcctcatgcttccctgccccagtctcatgcaaagaattttggtggaattgattctctgcaagaagctatgtgccaggcgccatgatagttaagcctctctctctctttctttctcctattgcactctctctctctccctctctctccctctctccctctgtctccctctctctgcctctctctccctttctctctttctcttctctgtcttgtctctcctctatctcctgtcttctctctgttcctctcctctcttctcttttttctctctcccctttatctttctctttttctctctctcctctctatcttctctcttctctcttctctctcttccctctttttctacccctcctccctttctttgtcttctctttgtctctttgtctcgttctctctcctgtctctttctcttctgtctctatcttctctctttctcctctcttccctctttttctctctctcctctttctgtcttctctttgcctctttctctgtctctctctttctcttctctttttctttttctctttgtcattttctctctcctgtctctctttctcctctctctatatctctcgctgtctctctctcctctctctcttctcctctcttctcgattttgccccctcccagaatggagccatcatgaacaagggcacgggacgctgcctggaggtggagaaccggggcctggctggcatcgacctcatcctccgcagctgcacaggtcagaggtggaccattaagaactccatcaagtagagggagggagctggggcactggagcctggcccccaggacatggctgctccccccaacatctggaccagctgccctggcggagagacagcaaggggccggcaggtgctcgatgggccccccagggcttctccagggcagcacagggaccccggatgaagactctgtcccccctcaggcattcagctgcccacaagtttcctgcaccctggaaaagccccccacccttcctctgggaaactgacagctgtcttccacagcctctgatgtggacctggtactgaggagcaagactgtccagttctcctccacatctcccatcccagaatcaggatctgggactggcagggtcccctcctgtgtctcatctcttgcagcagcagctgctgaactccagccatcaacacggtgggaggcagcgggggcttcagccatgtcctagctccccgccctaaaaggaggcagtgaggaccaggcactatttcctccgaggttacttctacccagatgacacctgcctgttcacgccccaaggcagctactgcccctaacccttcccaccagggtagctttgggcactgcagctctggacttttctggcccctcctgagatgacctgatggagctgatgctttctctcctaatccctgggcactaggctcttatcagtgtgcttgggccagctctcctgcctgtgtctagaggaagccagagacagaaataggctaagcctgcagtaggatctcagccacaagggccccgcaggatggagctgggtcaaggaccagggagccctgactcccagaggctgccaccggggagaagcagcggtcctccatccagaacctaagggctgaagcaaaggctgccaggacccttgaagatgcttttggctcacctcatttcaccccacgctctgctggctggcagaggagaaggcagtcgtttcctctctgaagagtatttttttcgattgccctctggttagggtgcacatataaatcagagttaatatatgaacgcgtgtgcatgcacaagtgtgtgtgtgcctgcgtgctgtgcgtggcagggtgtgtgtgtgtgtgtctggctgtgcgttccggagtgtgtgacgatgctgacctagctgtgtggccttgggcttgctgcttcattactcacctggatggggacgagggatgagaagggtgtgggtttggccccatgtcactggccggaaggatgtgtctcagccctgccctgtggggtgcccccgatgggaggctgtcccatctcccagtccccatctctttttccccacactgtccctggccaagccctgcccagagctgaaccctgtagctgcccccttgccctgtgtgggattcgcagtgtctcatttggtgacgtcttactggtgatcatctcctcaccccatctcccaccttgtggaataaatacatgttagcacttccca

SEQ ID NO: 842 - DNA, 370701 bp, Homo sapiens
atttccttctcgacccacttgtttgtatacaaccacgcccggcaggatgaccaccagatgaccggccgcagcaatgcctccactcagtcccagttgggcaaagtttcactccactgcggcgacgtgaacaagaatcacggcttccttatcgtgagttatgaatgatttaagccaagtttacaggacacacaaagcgagggacgagtgagtgacgggaggtgctaagtgacagcgttttaaagttagctttaattgatatgccctaattaaaatgaaaaacagaattcaccctgccccacgggataactgtcggggcaataattaaaaaaaaaaaaatcacccaagactaagcctcaacctcccccttaccacttgcaaatacagtctgcagaaaagcagcctcgggtccccactcgggggtccctcgcggggtgcgtcatatgggctctcccctctgcgacccgctatttccctgctagacccccagcgcccagcggattccaaggctgcgctcccgccggctggtcccgggaggtagaaagtaggcagaggggcgtggcgtccctgtcgcccccacatgccagccctcctccaacgcctgacaccaccacaagccacggctgggaacactgggggcctcccaacccggcgcggggcgcacggccgcaggctggcgaggaggcaagcgagctcaaggggagacctttccttccacccccagccctagccccagccacagccgtgggggcggcttcccgcaacctcgggcggccgcccgtcgagggcgcgcgcgccgtttctgcctctgggtctcggtgtcccttggccccttcctccccctccccccggtctccggcgcccagcgcccagaccagtccccgccctccagcaggacactcttccctccttccttccttcctccgctccctccctccatctcgcttcccagcacccgggactcggaggcggcccccgaactcgctggccgacgccccgcgccgcgccccgaccccgcggggacccgactcaccacccgcgcccgccgcttggtactcacccgcctgccggtgcgctgccccgccgtcgccgccgggactcggtctctaagggctcctggagacggctccgacctctcctcctcctcctcctcttgctcctccgggcgccggctccgcctcgctggggtgggcggggcggcggcggccccgggctccttcctccgcgccgggccctgcctcccgcccggacgccctggctgtgctgtcccgggccggggagcccgcgttgtggccccgcaggaggaggggcgaggcctggcctgtggaagctcggtggacgtctggtcgtctttggccatcccccttcctctaattctcatggaggacctgaagttctaggacttgagggcccccactctacgacccgcccccgcgcggggccgccctgactcctcgcaagtttccttcgcgtgcgaacgcctcgcttgcccctgtgccagcggtccccagggctgtgaggatgagcgctgccaaacccctacacgaaagtttggttctgttccagaaactatggaggaaaacacgcatagtaacatttaaagggccctggggccacggagagaagtttcccagaaagtggaggtataactgcggattatagaatttgtagtacatccacccaccatgagcttcccgtccatctgccccgaccccctgaaatttgtttccgaatgtccagtacctggcagagttctgcctaatgaattaatgggatttggttggtcttttctggaagggttcaaggtcgggtaaatggaggagccatttccgcttccacagattttgtactattcctttggccattcgacagacattaccaagcacccgctgtgtaccaactgcgatgctaaaggtgatgggagaggtacaaagatgaatcagacaaggggcttgccttcttggagtccagaaagagtaaagaagctggatgttcagaaaaccactcagcggacttctagagtattcctaggtagccgctttcttgtttgacagggtggagagaaaagaggtgaggccaaagtaggtcacttagaaccagtgtgggcagagtccacacttgaaatggagtctgaaagcattggtgagggatgtctgtgtattgagtttcaccaactgaggacaagtgggccctggggaatctgggaactagggactgcagtcagggcattatattccctcttgctttccttctgacccctaagcaagtttcaggtttagtgaaatcatttgcacatgtagaagaggtgtcacaggtagagtaggtgtatgaatgcatgccttgccccaggagtgtggtcttagcaagctgcggatggcggtggtttgtgggatgcaagccacagactgccagaggggtctttatttcctgttctgttcagcattaggaaatgcttgactgattcacaagtactaacagttcaaatgatacacctgaaacagaacagcttgacaccacagggactgagagggtggcatactggagtttgtattttttggccacagaccacagaatagactcctctaagctatgctactaattttccttcctgggacactttatagtttaataagtgctttcatgtacttactcttacttttctctcattagtctcttgaaaaaacctggaagctggaacaccacatattgccaccagtaacttaagcggcttgtcgaaggtttttctagttgagtgctgttcaaagtgtggttcatggaatagtgacagtctgcaaaccgttacccatctacaaagggatgagcatagaaattgaagatgagcatgtagaaacttacagcaatttgacagagtaattttatgtctgttaaatcgtttaaaatgcagctttgtattttatgtctatttcatttttcttttatgtggaaaggcatcagcctgcaacagattgaaaataaaatatcacagatagtttgagaagcactgatcgagatagtattaggttagtacagaagttattaccgcaattacttttgcatcaacctaatagcaaggcaggaatgataagagctaatacttaaccagcactttctgcgtagcagatgttgctttaagtgctttacatatattaaaccttttaatcctcctaacaacctaaggacgtagtcacaggaaggttaggtcttacagagcaaaactggcagagccaggattcaaaccttggctggctgacccaatactttgtgcttttatcgatgcccttgatccagtgtcctttctactctgctgatgtttcccaaacttaaaggattcacattccattttcatacaactgtaattcctattttttatttatatttcttattgactcacttttgttattttgtacatatattaccctggcagttagtaactccaagcatgtaatcatgggtttgaaaagcaagcatcaatcttctactctagtttatattaaagtacatgcctaattccagcacttgctgccagtgcttggccataccccctccagtccttttccagtttcgtgcacactggttccaggcgtgctttcattccctcctgccagcacccacatcatattctcagagtaccagctccagctgcaggatttgctttgcctgggcacagggcagctggaaatgtgtagaattaatgtcctccacctccatccctagcctttagccagtgtggaggaataaatatttcagctcctttgctcatatttgtgataactgggtggatctacattgtctacagagttccctatgctgttgggccaaattccatgagcctgtttggtttcttatttttttttttctttctctagccttcttttaacttttttttttccttttttttatgttcttgctataaaatagttaatgaactattttctaccccctcacccagtggcattcaaaacaaataaatcagtttcctatgaaagagtgtcagtggagtggagtgaaatttatgctttatgagataaggtctttgggattaagtcctggctttgccgttaacaagctgtgtaaatttgagacagtcacttaactttgctgggtctctgcttgtctttaaaataaagggattgtaagagaatggctctaaagtcccaattctatggaaattagattttagttttaaaaagtggctttcttggccatttaatccctcacgagacaagcaagagaagtggttttataattcaggacagttgtttttttttaacgaattgcaattcatatgtcaatctactgtgaatttctatttaatattcaataacaacactgtagctaaaggatgagtcagaaagagatggtgaagaaatgaaaaagtgaggcaaatcagtcagtctctcggtgatcaggtctccacagacttcagaacaattttttattttatttttttagagatggagatctcacttcagaacaacatttttgggatatcagctttgctccctgtggattttattggtcctattgcacatggcttcactctttgtctggacctgccctggaaggcagggagagctccctccttttgagtaggtcacctgggaataagtgtcttccaaactggtttttctgctcagtcggagactgccatatttccatgtagaagttaggtcagggagaagcacccacagtcttggaaatccccaagtaacctgttgaaacgtgtattgccataggcaggagctatgaccaaaactgtggctacagatcagaaggcaatttagcatagttccacacttacatgggtggaaaccttcagaggcctgggtgggagtgacccaaaatggaggcacccatgcaagttagttgattactaactcaatatgagctctctggcttattactgcaataggccctctagctctagggagtggaagtccccagatactgttgtctagaaataaaacatatgggctcaagagttaatgaatttcctgtcattggaggagttcaagcagtggtctcttagaaagtagagatttagaggatatcagcgatgcaacccaaatgcccatcacaagagataagatacctccctctaaagcactctgaaaaaaagatatagatctaaatatgttcacatgaaaagatgccctcaatgcattcttgaacatagatagcagattataaaccatcatgtggagacgcttccattcatgtataaaaaagcatacatacacacgaatctcttctgtaagtgtatctgcaatgatgtttgtcaaaatagtaacagtgactttctcagggtggtgagatttcaggtaacctaccttttttatactgcatgaattttttcacagtgaatgtgtagcttttctataaatcatgtctttttgcatattgtaaatgtatctttctttcataatataaaaagacaaaaggcattgtgcagaccaggagttggcaaattatggccagaggaccaaaggaccacatcttttgtaaataaagtttaattggaacacaaccacactcattcatttccctgttgtctacggttgcttttgtttttacaaaggttaagagctgaatagctgtaacagagcttatggcttgcaaagcctaaagtgttttatctgcccctttaggaaagaagtgtagcaacctctggtgtagacaattggactggaaaacgttttcagcatggcaaattgcaacctagattttactttttcagatttcaatttatctgaatttctattaaaaatatgtataggctgtatattttaaagtatatcccagttctgagtagtgattataacagagcaaagtgacagtattagtatttgggtagctaaggtctgtatattctccttcttcttcctcttccttattcttttcctcctcctcttcctcttccttctcattctcctgataagatcatcatcttattctacagtttgccctcagatgctgttccacttgagaaagtaccaggaggagaactgaggtttctctttcctggcttggatctctccaagacagaataattgaggaagtccttgacaaaataaattgtcctggcagaagagaggcaaagttctaaagaatagacgtagacctggaggagaaaaaacagggacgctgaaggagcccagctgaggaggaggggagggtgtccagctccagaggaaaggctgggaattagatggagtaaatctctctcttttccccttccctcatcacacccttcccacacgatccatctagcctccagatatacagaggaggtttggggatttttctccttcacagtcagcagtatccagcatcaaagctcccatttgcagaactcacatgagcaaggctaactaatggcagtctgagcaatgccaggcccttgctcatttccagaactcagccagaaaagctggatattggccttgatatggaatgtactcagataccaagtaattaaatgattcagcagaaacacgctctttgtcagccactcaccttagaccttccctgaagaaaacataggcccctgcggtgtcagaaagaaaagcagcctgtgatatgattagattattggttcacctatagcctatgctattgggttttgactcctacacaggcaactctgtggacctgtaagctaagttaaaaagggcatggaaagtatttactctggcatgttgataacaaacctgttaatttcatctagctttagatactggtgagaatggaaagtgccaagcctgcaacctcagtgactccaatttacacggttcccaaaataaataaaatattttttcagaatatgggggaatctcagaaaatgtaataaaaatgctattttctttcagtgttccagtattacatattttagagtactgaaatcctggcattattgttggtattattcatttatctcagtattttttgagaataaaaatatgaacgatttctgtcttgagactacccagagaattacataccacattaaaattttaaaggtaatagaagtgcattagtttaaagagtgttctgaccacattccttgcctgtttaaatcctccacaggtgtcttattgttattttatttcctatttcctggattactagggaggttgagcacattttcttctatttattagtcatctgcagtcccaataccaatttgggcatggatctacttgcagaggtctttgatagattgtgctggatatttctgtattcctataaatatccttgagctttattctggaatatagttaagttatttggaaacagatttgtcctttcagttctgcttttaagatttgtttagcaggattggagcagttaccactctaggttttttgcctctattgaagcaaaaggggattgtgtgtctattcaatgctccatagatcttgagatttttttcaacctggatggtggaaggagggactcttcttggccctgtatgagcatcaggtactgttccctctaataccttgcacatggttcttctctcagccttgggtagttacttcacctgcaagagcccatcatcactcaccatactcatgctagtttctggattttctttctgtacactctcttctctctggttctctgtcttaggaattctagttgccttaatctcttcttgtctccatcaccttaactcaaggagtccaccagattcttcctgaattccccctctctgctgtggcctggaaactccctcaggggagggtgctgggggagtggtaggatacacctcatctgtttcccatctctcagggatcactgtcctcttgtcacctgatgcacagtgttttgcaaactgtggtttcatttattttacctgtttttaggttgctacgggtaggacggcaaaactagttctttactccatcttgactaaaagtagaagttgcccctgtcactctaaaacatgtgttattcttctttttaacttagtgttatctaatattattgcctgcccccctcatcatgctgtaagctccatgagggaaagtactatgtctgttttgttttctgttgcctccccagcacctataacattgcctgacacatagtagtactcattaaatattgaatgactgcatgaaagctagaccaggatggagatcatgagaaaacttgaatgatgaacaggaaaattgaacagattttgctgagagtggaggctcctattctgaaaccagaagaatgtaggccaagttctattcaattgcaaagtgaggatcttgagcactgcaatgctggtgactttactcaagctagtctgtctgtaaatctgccaaagctcttggcagattaggtcacatttttggaatctgcttggaattcaggaacatggcggtcataatgaatcatgattttgacccttcctcttaatctgattggctctaagcccttaacaaatattaattatgtctcacaatggaattgccaccctgacctcttttcttagactgctaacactggatactgcagtgttcagccctcctatcccataataacgtgcctactcctccttcccaaaaaaggaaaggatagggtactgtttctatcaacatccttaaattatttagtcagtatcctaaagatggacttgacaattgaacaattttcttaaaaacctcacttggtaattgcaaaagcctgtctactgttttttctgactctagtctccaagacagtcctctgaggtacaggaaaaaattttagaaatcacagctacatttaatttttgtcttttccttttgttattatggtaagtcaggtatataatttacaaagacacatatattaggactacatgctcgaagtccttaccgatgaagtatacaataaaaaatgtttggacatcacagatctcatctctgaattccctgtagttaaggctggcttactcttcctgtgaggcacctctaattgtgcctctttcttctgcaaaacaaacaaaacctcaacacctctgaggcttaagtataagaaaacttttgcagcaagctgaagttgaaaagaagggagtttttctatgtagattcaaaatccagtctgcaattgtttgttagtccccacatttatgtagcacattgtaattgtgtactgcactgaatatggctacagggcttccgatttcagaagaacatgagtctgctctcagccaagatttgtatatatttagttctctgtgaagcctctcaggtccactaaattatggacccagaacaagtacgaggccatgaatatttcctaggtgccatgttagcagactgaattgctaaagagattatagaaataacaaactttaaatatatgaagttatttaccatcaaagtagtttacagaagtagcaatagagtaaaaatgaatctacaatacactgtgtggggtgtgtctgtgtgtaggggttggggcagggaacaccaaagtgccagacacatgaatgaagaagatattttggaagaggaacctttggccctggcctccccatctgacaccaagtagactagaaatgaactgctcagttgagcctttactgaattcctaacacacacacacacatgcacatgcaacacacactcatgaacaaagtaaaaaggttattttacttctgtaagttttgggatagcagacctgagagttgtacacattatctgaatacctggctccaactctacctgcagcaggactacccctgggtttttcagtaagccagtccattgctttcagtgtgctcaggctagcacaagtggagtttctgtcctttgcatccaaaagaattgggaataatgcaatagcactctctcttttaactcaggtgcaaaagcttcagctaatcatttttctcagttggtgacttatgctcatttttgatctgtgcaatggccatctcttatttgattgattgattgatggttttcttttttttttttttttttcaaggcttagatctgctatttctctcccaaggatgtttatgctgatggttttcattcatatcctttttatgctgttcctaccccattcctttcctgctcatagacattctaagtctaatgtatatctaatttttatatacatctttttatttgcatgtgtccttacaaaacatataaaatttatttttgtgttattttaatggtactgtatactctatgtaggaagaatacttatgaattcttcaaattaaatgtcatggtggtctacaattttcttcctaagttatagatttcttctctaagaaatatacatcctaatagtgtctatttttcttgacaattgttttgtcttcttggcattttaaaaaagaacttttattctctgaatacctacttcttcagccccactgattgattccacatatatactttattttttaatagtaaatattctggttatatgggtatggtatcttctcatctctttgaaagtattaattatatattggacttttttcctgttctttctattgtctttattgtttcttttgcatttcctttcttctgtgtgttttaaaaccttctttttatctgtgtctttcatgttagcagctttgcttaaatgttgactgattcttggctgattctaattggaacccctttgtgtgtccagatcttacggagtggtgacaataggtaatagagcagagatttggctattttgtcttcagaactctattggtttctacagatttcttctctagggctagtcagatacccccaaaaggagatcagataccccacttggggttaaggggaggatttaagcctggctgccagccttccaggagtctggatgtctcatcatggtttttgcttgtttttaaggcagatattcacttaatcttcttgttttcagtacagtactctgtattctactgtttgatcattcacttattcattaaatatgtattgagtgtccccttaatactttgtgccaggaacagttctaggtgcttggggatacactagcaatcaaaacagatgaaactccctgtcctcatggagcttacattctaataggatacatgtccagtgttctgccagggttaagagagggatgagtggctggctgcaaaaggaagtagcagaaatctggagttccaaggggccctcataaagactttcaaccagtcttcctgctatggtttggatatttgatccttccaaacctcatgttgaaattggatcctcaatgttggaggtggggtctaatgggaggtgtttggatcatgggggtggattcctcatgaatagattaataccctccttgggaatgagtaagttccctccctattagttcccatgagacctggttgttaaaaagagcctggcacctcccccaacttctcttgcctcctctctcgttatggggtctctgtattcagcctgaggccctcaccagaagcagatccccaatcttgaaccttccagtcatcagaattgtgagcaactaaaccttttttctttataaattacccagccccaggtattcctttatagcaacataaaacagactaagacacctcctgttttcagcttcagcctacattcctattttcaaaagtgcctgatgcttctaatctctgagcctttctgggttttagtggaataagctagcttgcttttgttggcattccccctaacagactgaattactaaagagacatttagtaattcagattactaaatattctagatatttggatttcagttttccttgttctgctaagccagttgccttgccacttggatgttcatctactttccatctcttgtctgctctggtcctctctcattttcctccttctatagacttatacctttttgtttttcatttaatgttattttaatgggatttttttttaaaaggaggaatagagataatcctgtgtttggtcaactgtgtttaaccatgtgccagcaactttctatataggcacaaagttatttgcttgacgggtaaaaagcgggggcagcctgggtaatggtagtatcagattctgatttcttatagtcacatctttgtcaagatgtattgtctgaatttaggatgagatcacagaaaggtacataagcatcaatgtttctaggcctcccagtattatggctcattttcttcctttctctctctcattgacttgctttctctttgttcttagaacatgttttatttaactttcttctccctcaaattacatttttattttctcttctattactgactttcacgttatctcttattttaaatcaatgtagagagaatgtttttgactaaatttctagtcattgcatgcatgtattgtgatttacagaataaaagagtgttttttaaagaattgaaatgataggaacactagcggcaaacattaaacgcttactgtgtgcaaggcactatcctaagagctttatacgcattgccttatgaaatctctattatcaccttatgaggtatcatttccactttatggatgagatatcaagtcttactaccttattttataaaatctaagctaagagagagtaaaaacttgctaaaattcttatagcaaatgagtgaaattataaaaatattcatgaaatgaacatgttttatttattattagaattatatgtattcctcattaggagtttgaagtggggtttggtaccccaaacctttaaggctccctgctgagggagccacttatctaaagatcaatagctaattacaagacaaaaaaccagatgtatttgatagaatggcagagattgtcttgttagctgtgctggagggttgagtccggaagccaacatggagttttctgctcccttgagtggggactggctgagtctagaatggttaggcctgcacagcaggttctaatccactgacctaaccagctgtgcagtagagaaaggctggcttgcctcacccacaccactgcagaccagaaagctgggcagagagcacaagtattgctaggcctccctcaaggagacagcttgtgtctaggtgagattctcataggggaacaggatggggaaatgggcccactgcacatgggtgcatgtagtaggagaggacacaggacacagacaaggcaggcatcaggaagtgatccagtgtgagccaggtgccatccactgggattggcatcctcttgcttcctccttggggatctgtgagttggtctctagaagtatgggcagaaatgttctttctcctagaagctgggtggaagcgttcttttttctatgggttaaggtggaagtgtgagaagagaaaataggttcccttcttaacatttctatttagataaaaatttaaacattgcttatggctagttctgtattctaaattcaaaacaactttttttttttttactattgaattatctgaattattttttctgtttatttatatgtttatttattttttgagatggaatcttgctccgtcaccaggctggagtgcagtggcgtgatcttggctcactgcgaccttggctaactgcaacctctgcctcctgggttcaagcagttcccctgcctcagcctcccgagcagctggaattacaggcacgcaccaccacgcctggctaattttttgtattttagtagagacagggtttcaccgtgtttgccaggatggtttcaatctcctgaccttgttatccacctgcctcagcctcccaaagtgctgggattacaggcgtgagccaatgcgcacagcctatttttttctgtttataatgcattcagatgtttttttcttctattttatcttttaaatcgatgctgattgcaacccactcagggttacttgacccactaatgagtcaggacccttaatttgaaaacactcatctaggagacttgttgacataattttggagcaaaaagctgttcttatttgtaaaacatataagtggccctttgttattacatagagcaagaattagggcctagattagacaggactggtggagacaagatgcacagtttagtaaaactgcaaaggatgataaaatttaaaagatactcttcttgggtagagagattattttgaagttaactgagtcttattttcctgtgagtggtatgaaggtagtgccaaagatgcgatgttagggaaagacaaagactctgaggagaattgaagggaacactttgatcttaatggaagcaggtccagtactgaggttcaaatcagtgacagctaaggaggctttgactgttaccagggattggtctatggataccaggagcagcaatgtccaacattgggttttgagtagtactcttgcagtgcatcataattaccccaagatatcctcaagtctttagtgaggctggttaatcactacagcccagcatcaggctagtgactaagggaaggaaaggaaaagttgagtctgtagttgagataccaatacagtgtaccagtacaagacaagacaagacagtgcaagtcaagacagtagctaatagcctatagcagcagttatgagatggtaagaagagacaagcaaacctggatggggaagctatcttgaatgcaaggtggcaagtgctaacaaaagatgtgtatctttatcaggaagcctacgtcttcttcaggaatccttttttggaaggcagtacttttttagaagggtggttggatttcttgctgtcacagaggtttagggacttgatttatttatttaattatttctagattttaaagaaattgactgtgccctaaatcttgttttccccactagatcctgctctgtgccccagcagcctgaccagcgtggactgcaccaatgggctcccttgtcctctagcttctggcagggtttggccaatgggaggaaatcaaagaataagagattgggatatttattgccctaatttcttcccagctgggtgtcagtgggttcactgcatctccccagtgaaagccatagctcctatcagatggccgtctccacacagctaaactccccctcttctggtaacccttacctcttcaggcctagggtggtaatggttccccttcttgctagcttctagatactacgttattatttgctggtttccctgaacactgtccaatctttgtaagtagccactattaaactttcatcaaattaatgatctgtttcctgccagatagtactgagattagactcaggaaagagaggtctcctctatcatggctctttagcgtggaccccatgccttacagagcccactaatcaagatgaatgagtggagaaacctttggaaatgtcttaaggaatgcacaaggacctctttcacttgaatctgatgctcagtcctggcttagtacaacctgcattcataaacatgtgctttcatgactaacactgctcacgctttaggggaaatgtttttccacatctctttcctgtgtcctcaatacaaaaggccagtatgtctggatgttgtgagggtgtatggctcatgctactgccaatgttggagatgggcactgttttagcatgtggagatttgagtgatagaagcacttaggatgagaaaaaagacagtttgtcaaatcgtttctctcattaatatagtgaacttctgtaggaagtgcaaataacttaagctcttttgatacaacaaagagggccagaaggtgggaaataaactccacaaaacttcaggagcctgccattgtagtgaaatttctaggaactggagtgtgctggggtacccctcacagacaggacaagttgccacaaatggcaccttataccgctaagacaggggcaccacgtatggaagcctctttggatttttttttttttttttaatggcgataagttctcactatgttgcccgggctgatcttgaactcctggcttcaagcgatcctcccaccttggcctcccaaagtgctggaattacaggcatgagccactcggccttttttattttattttttttgtcaccagcaaagcattaaaatattttttaattgaaatttttattgagttaaaaattttttatcttatagcacacaattgtgagaaataatataaaaagatctcatgtgctcttttcctggttttccccagtggtgacttttgcaaagctgtagtataatattatgaccaggacattgatgctaatatagtcaagatataaaacatttacatcatcacaagtattcgtaatgtttctttttataatcacactcccttccaccatgtcctgaaaccctggcaatcagtaatctgttcttcatttctaaaattttgtcacttcaaaagttgttatgaaaaaggaataatacattatgtaacctttgggaaacaggctttttttttcactctacacaattctctggagatttatccaagttgttgtgtttatcaacagttgattccttttttattgttgagtagtattccatgggatggatgcactaaagtttgtttaaccattcactcactgaatgatatatggactatttctgttttttgactgttatcaacagagctgccataaacatctgtgtacaggtttttgtatgaacgtaagtcttaatttctctgggacaaatgtatctgagtacgttactgggtatggtagttgcatgttgagtttaaaagaaattgccaactgtttttcagcattgctgaaacattttacattcccatcagtaatttgtggatgatatagtttctctgcatcctcatcagcatgtgttgttgtcattattttttattttagccattttgatagaagtgtaatagtatctcatcatgttttaaatttgcaattccctaacaatgttgaacatcttcttatgtgcattttctatctgtgtacctctggtgaaatgccaacaaggatttttaataaaccatgtgttaaaagaatgtagggggtagtagtagtagtattcataatagtagtaatattgttcatagcatgatttctatctctctaccttaaaaaaaaaaaaaacccctgtatataacactctgtgctaggcaccaggggtacaaaggtaaattgaacagatgtggctgttttcctcatggaacttataatcttgaagtgggtgaggagttagaaaacttagaaaaaataaacacacaaaagtatataaaacaaacacaaaaagtatgtgccctgaaagaaaaaaacaaccaaacaaaaaaaccaaatgtcataaaaaaaagaataatggagactcaatttatattgagagtcaagaattttcaaattttacctgaaaaatggggaggtaatattcaagtgcagtgggagcaagaggaactcagcccaagagagcagcacgtgtgaagatcctgaggcaggaaagagctgaggatgttgtagaaacccaaagaagggtagtgtagctggaatgtagagtagcagtggaggagtgagatgaggtgagtttagcagtatgggtagggcccagaccagaaacagagaaattgtattagtccaagcaagagatggtaccaggggatggacagagaagtggatagttctgaggtgtattttggagatagagttgacaagacatgatgagaagctgtgcaggagaggagggagaggaagatggaagtatcaagaatgactcccaggttccttgattgaaaaacctggttgatggaggtgactttagcaagatggtggaaacaagaggaggacttggtttgtatggagaggtcggcagtggataacagtcctatttttaggtgaacataaattctgaagcctgatgcatgtctacgaaacgaataaaccctatttaattgcatagtacaaacaagagtcctacagctgaggctgaaatagctgaggctgaaagagacaactcaagttcaacatacatcacccttccctttgtttttaaaattgctcatgaatattttttaaaagtattggctgggtgtccaccaggtggcaacatttctttaaaaaaaagcccagatttagaagccataccttcttagctacatcaaagtggattcttgagggccacacaaccagagtctagtcaaaatcactgaaagtgcagcccaccctgctgagttcttctcttaatatgcataggtggaggcagttttatgagcaagatccttctgtggcctcttacaagaaggctcatgtgtgtcagtgtgtacctatgtgcatgtactatctaggacttatatcatatcatgaaaagccctttaatcctaaaggtacttagtgcaagcaactgagtaacattggaagccttagataacctctctgagcctctttcttcatctgtagaatgttgtatacgtattagtaccaacttctttggggtgtgagtgtgaacttagataatgcatgcctataatgtatctagcacagtcctgggacaaagtaagcacttaatacatggtagctcttattattatttccacagtgacccttatccccactttccctgctccaagactctattctttgccagccttagttgtgggcagcctgccaggcatgatctaatcagtgaagcacatgagtcatgagaggatgactgactccctttcaggttctcttagtacttggctcctggaaggtgctcctccttgataatccttcctcccaactgcattgacatagatggagtctttctgctattgactggtctgattggacaggcaagccatgaagatggagagggaggaagctcctgaatggaatgtggctgccggaaaatcagccccctcctaatacactgcaatgaattaaattactctctatttagtagcttttcctcatctattggaacatgtacaattgctatctgctatgatcatgtattcccagcctttcaggtgggataggtccaagcactcattttgtttggagcttcacacagtatgaatatagcacagatttacctagggaagaagttgacttgatgctagtgcctgtgattcagccacagggaatatttatacagcaaagccagccagctgtccccactgtatttatcttcttccccctttcctactagctcaggccaccagatacttcactttcttttatcaaagtctaaaatatttgggtgctttaaaaataggttttcagaaatgttaccaattaacactatatatatatatatatatatatatattttgtgacagggtctgctctgtcacccaggctcaagtgcagtggcacaatcatggctcactggtgccttgacctccctgggctgaagtgatcctcccgtctcagtctctcgagtagctgggaccacaggtgcatgccaccacacctggaaaatttttttttttttttgtagagacaagatctccctgtgttgcccaggctggtgtcaaactcctgggcacaaggatcctcttgccttggcctcccaatgtgctgggattacaggcatgagccaccgtgtctgacctaattaatactattattatctaatcacattgattttcagtgggggctttctatttcatgtgggggcttgcgaggggagggtaataagggtatggtgagaaatggataggaaatgtacctttatcgtagagggaaggaaacagtttttttggtctttcacctgtattgcgagtagcaaaacatgttcatgttttcagtctatgtgagagattgctaagcgagcagggtgttaaaatgtggtcatgtggaaagcaggttgtcattcttcctcacacgtgcacagcgtagctcagtttataaggcacactatttcattggccttttatgtaaattttatattgtaggcagggttgtttcctacatttttcttcaactgatgctcagaaatatcaggcaacttggctcattcaacaaatttctactgagagcatactattaatatgtgcaaggcagtgttgtaagttgtgaaggaaatccctgccctcatgcattttctgttttagtggggcgcacacacatagataaaatatataatataccagatagtgatgagtggcatggagaaaataaaacgggaactggaaaggggattatgtgtgagtgtgtgtttggaggtggtattgttgctaatttaaatatagtggtgagggagtgcctgattgagatgatggtattttggtaaagacctgaagaaggtgagagaggaagctctgtggatagcttgatgaaagagaattctgggaacaggcaaggacagctgcaaaaacctagaggaagaaacatgctagagcagagcaaatgaatgagacagccaggaaataagatggagaggttaggaggaagattgaggtcttcggggccatcatgagattttgaggaggggtacatgatctgatctagatatctaagcatcactcaaggcattgtgttgaagttagaatatagagggcaagggtagaagcagggagatcaattaggaggctatgacactagtccgggagagatgaggatggcttggatcagcgggacagtggtggaggtgtgagaggtgattatatctcgagccaacagggattgctagtggattagctgagagaggtgagagaaagacaggagcgaaagataacaccaaggtttctggaaggatggagttgctgtttcctgaatgagaagactatgggtcaggcaggtttggcagaggtaagtggaggaagagatttagacataagtttgaactttaagttagacatctccatggagatgttgagacttcagttggatacacgagtctggggttcagtgtaggggttctggctggataaataaagttggccatcttcagtatgccgatatttaaaaccttgagattggaggcactcaccaagggagcaagtacagataaagtgggagtctgaggcctgagccctggggccctccaggacttaagggtggggaaatgaaggcaggatgcatcaaagagaaggaacaactggcgaaggaggagaaaccatgaggacatgatttccccagagctgcatgaagagagtgtttcacagagagggagtgatcaactgtgtcaaaagctgttgatgttttatgtaaaatgaggactgaaaatgagcaactggatttagccaagtagccccagttattctatcccgtagcagtcttttcttcattgacagtatctggatttttccctccctccctccctctctcttttcttccttcccttcccttcccttcccttccttctctctttctctctttatctctctttttgtttctcatttgcctctttcactggatagtaacagtaacccctataagaacggggaccatgactgttgggggtatagtggctggcacatattaggagtatgttatgcaatttatctcttttggtttctgttttgaccacatattgtccatttccctttctcaccttcctaatgttccaaatcactttggggaatttcctctcttctgttgtgtgtggtcttgatgggatggcaaattctgtgtttgcctcctactgtggaagccaaagcaagcagatgctgccccagacccctacaccagggggcaggctgcgtccatcagaggctcctgagttatccatggacaagagaatgagttgaatcccagcatctctgtcctcaccagagagccctcctggtgagagctgttgccatggtttccatttcccaggccttggtgctcccctgcttcctgccatcaccaagcctgctgctccagcccctgtttctctgagctcccagtatccttccagtaaatcctctttcgcttatgttaaccagagccagttactattcctttcaacttaaaaagttcccaacacctaagcactcaatacacaatactcaatacacatttgctgaatgaatgaaaaagtatggttttcatttcatgaatggcgagtctgaagttcagagaggcttaccacatgtctaagaccacataccttccatcaattcttctatgctcccttttcacattctcagatctctgaaatcaggatgctttttacaattggcagtgtcttacaatcaagtggaagtatttttctgtttttagtggtatataaaataatgtatcttatattagcttagattcaatgaaatatggtagtcagtattgaagtcaaaattgaaacatatttcaaaagtctgtacatcttcgcttttcaaggagtttattatctagttggagaaaaaaataagtaggaaaactccacaaatctttctcaaatacagagtagggtttcatgaacactgagtggaggccctcactaaagctgcaggggtacatgactctgaagggctgagtggaggagccacagcgtgggcatttatgttgatctcagcaagaaagatttggatggatggaaatatgagaagaatggagaggagggaggactaggttctagacgatggcaaccctgccgactcttaaatgcaggtctgagccacaaggctgagtttggtggagatggttgcttggtgtctcccctctgactctttcccttctccttctccatggtaaattattcttccaattctccctgtgttcaccattataactgttttctgctgcaatctttttctggaaagttccccccttcctacctcctgcccattcctcccaatcagttcagctcttgtgtgtgctggacagaaatccctcttggcagcctaggcaacatagcaagacccccaactctatatatttttttaaattagccagcatgataatgcacacctatagtcttatctactctggaggctgaggtgggaggatcacttgagcccagaagttaaaggctgcagtgagctatgatggcaccactgcattctagcctgggtgacggagcaagaccctgtctcaaaacaagcaaacaaataaaaaagaaattactctgggatccagaaataagggaaaatgtatttcagggggaggaacagcaataagcatggaggtgcaatgcatgatgtatgtgaggaagagtgcctgaataccatgaaagggtaggctgggaagaggggtttactcattcattcagggaatgtttgagtatacaccaggtactgctctaggcactggggatagagtagtgaaataaaaattatgtttctaccttacaaggcttacattctaataagaggagataagccataagcaaataaatgtttaaatacatatgtatatacacctatggaaaaaatgtcagatggtataaaagcaaagaagaaaaatgtgaaaagggttaaagaagcaagagagttggggtgcgagctgctcattcaaatagaagggccaggaaagtcttttttgttaagataacatgtcaacagggaactgaaaaagtgagtcagagtcttttgaatcttccggtggaaagtgttccagggcgagggcacaggagatgcaagggtctggatggggggttgtgtttggcaggtttaaggaatagtatgtctaccgtggagtgagtggggacaacagagtggcaaatgcatatgtggtggggaggttagccaggccagaacaggtaggccttgttagcattgcaaggatttaaattttattccaagaggatgcaaagcctgtggagaaatttgagtgaaagaaaaggaatgagagatagatggggcctaatccttgtgaagctgcaatgctgtcccaaatagtttgaatccgattctcctatgttcccagaattttcatttctgaatcatttaaattgagcaggaaatctgttctaatgaataaatatgttttgttttttttttttttgaacacggagaggcctccgcttagaacagatgtaatgaagtcatagtttgttttgacagaaagaggctatggaaggttacacttcctccactctgcctttggttgtcaaggagatacccctggaagcctcttcttttgtagctaaatgtcactgtatagcacttagatttttcatgttctccttttattatgttattgtaaagttctctgtgtaattttgctcaggagttaacaatttcatcactgatgagtctgttcattgcaaactaccttttctggcattctgattgtctttctccatccagaggctggcttccgggaggggcatgcacctgaaaactcatcaaacctgtctttagaaaggtcctgagggtcagacaggctgaaaaaggcagattaattctgagaagctgatgggaaaatgtgaactgatggatcaaactacagaaagatacatggtgctgggttgctttttgtggagagcattatttcagctgctgaccaatcagggtggatgttgctatattcagtttacagaggggaaaactgagatgcggtggtaggagacttactcatgtagttacggtagccctggaacaagcatcttctagtttttagtgtgctttctacaacactgtgttttttcaaagatataagctggagatgataggttagttaattaattcattcaacatgcctttttattgagtgccttctgtgggctgggcactgttcaagacactgggaatactgaggcaaagagatgagctcctcatcctgttcacactcctcccgtgcccaagtagacattacttttgactgtcagctggatatagatgtagaatttattatagatcaaggttggccctttagatgaaaatctgctatccccggcttaggcatacatggttcagagatcaaaaaagctaaatctgaatcagttctctctgaaaggaagttaaggtttttcaataagctccagactaaaagacccgggaagaccgatatacacgttaagttggccatggatattgttggccagggatcagcctctttccaaagtgtttcacaactgattaaacaattctgatgagtgaaatgtgtttctcccaggttttgaaatcatgtgctttaaattattacatctctatgctgttgtgtgcaattaagagtaaacaatgcatcctgctatcacctcttttcagcacaagggaggaaacaggttgatttctttggactttgtggattgcttgcccacagtagcaatactcccttcttttgatgggagatctttagggtttccatctgctagcaatgtgcattaataaacatttttaactgaggagagggtgatggagtttttatatctaaatgtctttctgaaagctctgtcggtaaccaccacatttaaagagagttatactatttgtattcctgtctgcacatcttaattattcaagtcttccagggcttacctaaattagacaaagaggaaattagtaagatgtattataatgtttagacagatcaaatgaaaatgtgtcagatacaaatagctcacactgcattatctgattttgtccacagcctttgctttttagttaggaatgtctggatatatgtgttatcaagagaagcttgtctcctctctgctgtgctgtttctttagtggtccctttagtcatttaatacagggctataggcactcattattctggctttgggacatgtctgacttttgtcgattgcgattgcgggaacttgggaaactgatctgcaggaagatggcagttgatttgcataagacccccaggcattttgacacaagggaccaatattccaaactattccctgaggtctggttaggtaaagcttctgagaaaggttgaagggctccgtttaaaaccagggcaaggaaggcctatgaggttcctaaaataaaaatcaacctcaaggtagccatatctaggctgatgatatgggatcaaaaccttaaaatgtgtgaggtagggctggttctgacacaatgcatcattcatatcactatcccttctggacacagtgaaaagaatgaagggaagaatttctgagaatgagagtatcatctgaaagacttgcaacctcagagtccaggtgaagaggtgagcgggtagaactagtcccttacaatgacaccaggcaaaagacatgcagccctggatccattgaagcacttctctttcagcttggtgttgaaggacaggtctgaatattgttgccttgtgtaagctccagggagatggttggactcgttagagatgaagataacccaagatgccacttttgctaatagggcatgtggatatttaagtacttaagtaaaaaataaaagagatatggccatatctgtgctctgaattcatacaacagtacctactggttacgatgtgtgtgcatgtatgtgtatgcatgtgtgtgtgtgtaagaaaagggttcagctgcaattttacaactcattgggtaccagatatctgcctcatagactcatcaccccctagaattgtagccccttagtgatcgagataagggccaccatccttcttcctcttagtgagccttctctgattgccttgtttaaacttgacatttactcttcccctcccctgattgatttctctccatagcccttattaccctctttattgttcactgtctgtttctctaccaggatccaaaagggattttcatctgtctctttttcaccgcggcattcacaggtcatatgaaaacacattgaacagttctattgcacaggtgctacagatgcaggcagtagcactggggcaggcttcctgagagcccctgctgaaccaggcacgctgcctttggttgctagattgtgggaagtccagagttctggggcaaaggttggggcagacgtgaagtaaggggtgaggatgaggagtttcttaacaaccagtgatgttgtacttgtgagtcctggctgaatccccagtgcttagaatgatactcccacatagtaagtgctcagtaactattggttgcatgaattaactcccattttgtggatgaggagtctgagtcacagagaaattaggtagtgtgtgcaaagacacagctagtaggtgacagagccaagcatgagtccattccctgcaccagtctggctccagagcctgccctctgaaccattaggctctgcggttgcaagacagtccagatgaaaagaaagaaagaagaggaagctgttattcctgtaccagacatatcattcttatcaaattcttaaggacctttaagggttcttaaaatttttctaggacaaggtggaggtctacacaaatgaactaaaatacctttctgaaaaattggaaatgaaattgatcaagtcaggattttcacttggctcttcctctcacgtgggtagctactagagaatccagctgtatgacacaggatcaggcaacaatgaaaaaattacttcttatagacaaaacaataatatatgataccaaatgtggcaggcagaataatggccttccaaagatgttcttgccccagtgaccagaagctatgaatgtgttaccttatgtgggaaaagggaatttgccagtgttattaagttagaaaatttgagatgggggattaacctggattctctgggtgggtccaatctaattataattataagggtcctccaaagttgctggctctgaagatggaggaaggggccaggagccatggaatgtaggtgacctctagaagctggaaaaagccaggagatgaattctcccctagagcttctaacaaggaaagcagtcctgcctacaccttggtgctagcccagaagacttgggctagacgtctcacctgcagaactgtgtttaagctgctaagtttgcggcaatgttacagccgcaatagaaaatgaacacaccacaccaaggaaaggtaaagtgaaaaattcagtcaagttatcaaagtgttaaaagaattaaaaaagaccaaactgttgtttttcattgaattcattcaaaataattgtattcttatagtacatggatataattacttaaatatttttaagtgatatgtttattgatatcaaataaatcttcccagtcttttaaaagaatgtacgattttcataagtattatataaggaaaataaagaggaacatactgctatctcagttaatgaatctgtattcctttattaaatcactcagagtgtcatttataggaagcagacttcatataagtaggagaagatcattgccagattttgagctcccagagctccttcactcttgtggctcccccggcaaatctaatcagcctccaatgctgttatttctttcatcacaatgatccttgcatctgttccttcattttcctgccactaattcaggcttcatcactttccacctggatagataaaacaggaatctaactgaccactttggctgttgcttgtccccctttgatctattctgcacacaccctctagattcacctctgtcaaagcccttctccatcatgctgctctcctgggagaaaacactcacacctcttgtcattgggcataggagaggttcttagccatcagtaggaccttactagtgatgagggggctgcacatgacttatgtgcattcactaataatggttaaggtttgaagattattattttttttaaaacaaattgaggcatatttattcatttatataatttcacaaatacttattaaatatttatttgtgcctggcactattctaggtactggggacacaagggcaaatgagagagacaagagcacattccagtgtgggagagagatcatgctcaatgaaataaacaggaaatatctggggagtgttaaatgttatccaaaaacatcagaccaggcaaagtgatagaatgatggggcagctactttggactgggtgatcagagagacctgtgggaggaggtgacatttgatctggtgtctgtgaagatccggaggaagagcatgccaggaagatagaagaacaaatgcagagagtccccggcagctgtgatcttggcatattcaaggaacagagaggagagtgtggctggatggaggaggacataagcatccaggaaagcagttgttggatcttacaggtctcagaaacagaatactgcatcttgatttcccttttaagatggtagaaagctcctagagctttaaatcagggaattgacatatacaatgtttgtctctaaaagctcactttggtttttgcaaggtgaatggattattgaggaggccagctaggaggccattgctgtgatctaggcaagtgactacagtggcttgggctatgacagtgatggtggcgagaagtgtacagacagatccagagcatattttagctttatgatcatcaagacttgctgatggattagatatgtaggataaggcaaagatagtgacttctggatgtttggcttgaccgctggtgatcgttgatactatttattaagatgagaagactcaaaattatcattatgaacatctagtattataatgtgctttcttggcttgtgaggcatccaaggcaatttgcccttgcatgcaatggcacaagaccactatgctttataagacttgtttctattttttaataattttacagtgcttgcctttttgacaggattcctgccactagaagtttctcatttctccctaaatctgtcctgggctaggaaaccagatacaaatgctcattgaaattgtatgtaaaatgccagtaaacaggagctgaatgaagagatgaaaaattacttttgagtagaagatgtgtgttttgtttcgtgggctttatgacaaagattgctcagaaaccctttttgtttacttgctctgtgagagagactactgaataaatgacctctgcatacataaggagttattgtgccttttctgtgcttatgagttgcctgtctgcctttcccagagttctctaccaacagctgagccatcttgatctctatgtcagcaagtttagcccaattgcatcatgccatacttgatgctagttaaaacctgattatgtgtcccagttttagttgctgtgtttctaccctgctattatcacttggtctcccacaggtaccttgtttctgtatctgtatcttggccttgttgtcctcagtggctgcctggataacccagtctatatagaatgataactcttattttcctttttaatccttaatcatgtggagacacacattttattcctgagccaaagcctggaaactccactactattatcaatactgctagtactactagtaataggattactagctagcattggctgagcatttatgtgccatgcattgagataaacacacaacacacatggccacacttgattcagctatccagtgagatagacttttttatgcaacctttaaaaatgatgaaactgaagcaaagagaggataggtaccttttcttagatcacaaagctagttagtgggtgatggagtgaggatgagaacccagagcgactgaaaagtttcttctcttcatcatggtcctataactgcctgtatagactgatacacaaacttgaggcctgtgacttgctcagtgatttccctttctatgcctccctgcctctaagttgatgtccctctgtggtggacccagatccatgcccctttactgtcatacactcatttcattagctatgctacatggccaggaggctatgctaaggggacaattagtatttttaatttgctccaaactttataaatagtaagacagtagttaattgaagagtgcactggttagccagcctctaaagtaggtgtcattgttcttattttagaaataagataacagaagagagcttgtaatttgctcaagatcacgtagttactttaggatgggtcctggatttcaacccatgtctggttgatttcagtgtatcctcttaattaatttctgggaactctttcccaaatggctctagctttggggctaacaggctacctattttacatgcagcattctgttattttacttcctataaataaatgtctctctatgagttttatggtaatagaaatttttaaatgcatttttatgctcctgtccaatcacttggaacagtaaaattgataaattgtttgtattcctctcattttggaacacagttcacctttttcttattttgtaattgtgcttttttgaatgcttgttttgtctgatccatgccttgaaatattttgtaaatctgaatatattactatcttaggaaaagggagatttttcttaataaaattgagtagtgcaatttctatgataaaattgctcaattatactgaaagaaacacaatatatcataagttatgcatcattgaacaacttaaccacacaaatgctcaaaacccagagaaaaaattgtaaaggccaatttagtggaaaaccggaaaggatttaattttcctaaaagtgttttttgggaaactcattagtctctttaaatgctctgtcgaaaaatggtttcttggtaatataattgagacatgctctatattttatctcctatgaaggattcagaaaataagatttgctaattgaaggctctgagaagtcctactcctacagtaaagatatctgatccctaattaattttttgtgttggccatctgttgttattgcctgctcagtatgtgttcacttttctgggaatagcaccataattttgtcctgggaaactgtgcctcttgatttgacgcagtgcgaagtgggtgttaatcaggggaccttgccatgccctggccaaagtataggcatgtgacccaagatggaccaatcaaatgctttctctctggaatttatatcttgaatggaacaatgcagtgattcaatatagttgaaattcatttatcctggtgatggtgctctgcttcctggatctttggagctactcttcttcttgggcttttaacattctggttttccagccttcctttgtgtaattatacaggctgcgcactgcttaagggcaccatgtctaaaaagaaagaaaacattcatgctgtagatctatattaactcctgtgagaatgggggttgggaggggcggtggataatggagagtctgggatttctggctgcatctggaagtagtagaggagagttcctgatgaagttaggctgcaccagcattcaggaatatacattcactttggagacctacacgcacacttgttgatgcccatgtactcacaacctggttttgttcctgtgcaaccccaagaattccatgaggttttttctgtcatccttccactgctcttagataccctcagaaacctatctagacacagtccctttgcctagggaataggactgggggcatggagtgtgtctctgccaacagtgtgtatgttccagtataggacatggacaagcagccaggaatgtgggcacgagtgtgtatagcaagaccccatctctacagagcacctgtagctctgcctgtcagggcccttgcagtctttctttgtatggcctggaaaaccaagggtgtgtgtccaagcaagaggctttagttttactttcttatgagtgggacacatatatttgggttgccaattttaaagatacattcaatttatgaaataacagccatcattctcttgcccctcgttttatccattaatttattttccctccccttctcttcatttgcaggtaaggtagctacctgcctggtgtctacttttcccgggtggcctgaatatggtgcttggttgtgcaataatatactaatggaaccatctttcatttgagggaggagcatccttttaaatttgtgctagtggcagtcttgtctctgagctgccttgtatccttccaatatgcttcagctaattagagtcaggttaggttgtactttcccaaagcttaggtaatacattcctatcatcttttaatactcctcaagttcctcaaaacatttggaaaccctgatccagtggaaatagcacaggactagggaggaagaaacctaattttattgatgagaaacccaaagccctttaaagtgaatttcaggcagggctttcagtaatgcagagtggagaagataacaaatcctctttcccaaaaacaactggagaaaactgtccaaaccaacaattttagtcttctgggaatggacagaggtcaacaacaaactgggaaacatttattcatggaaccttgctgaactttgggtaagaacaaagttcctatctctgggtaagaacaatgggagtctgtgatgttcttgcttggggatgcctcataaccatagatctgttgtcacaatagtgttgccagggtagatctgcttgtgccagaaggcactgacttgatttagagtgaagggcatcgtcagtaaaatcagaaaattagaaacacacaagaagagcctacagttttgctagcctcagattgtggccagaaattcaacaggaagaccttgggaattaaatcagctctccacacatcactggttgactgagaggatatgcatgcacaagaagtccatgtggggcctaatggaaagtaaaagctggggccaacctgatgcccacctgaaacttgtatgcacaaagtttgacccacactcaggtccatcaacaatagctaggagtcttactggctgaaggcatttgagcattttctgaccaattactgactactaagctatgcagacacaggagcaacttctagaaaactagactaaaaagtaaaagtaaggattgaaaaatgcttccagtgctttgggaggccgaggcagtaggattgcttgaggccaggagttccagaccgacctgggcaacatagcaagatcctatctctacaaaaataaaataaaacaattatgtgggcataatatcattcatctgtggtcctagctatctggtagactttttttttttctttaaagacagaatttcattcttgtcacccaggctggagtgcaatggcatgattttgactacaacctctgcctcctgggttcaagcgattctcctgcctcagtctcctgagtagctgggattacaggcatatgccaccatgcctggctaatttttgtattttttagtggagacagggtttcgccatgttggccaggctgttcttgaactcctgacctcaggtgatccacccgcctcaggctcccaaagtgctgggattacaggtgtgagccaccgtgcccggcccccccagctacttgggaggctaaaatgggaggatagcttgagcccaggagttcaaggctgcagtgagctatgatcatgctactgcactccagcctggatggcagagtgagaccctatctctgaaaaaaaaaaaaaaaaaagctaagcagagacaactatgactgcatactgcagaggagacagattctacagattacatatgggtaagttactaaataaataatgaaaacaaaaatcaacaataagagtttagagaaataaaccagaaaacaaagttactacaatatattttgataatttttgattaatgtccagttgaaaaaataattgtgagatgtgcaaataccagaaagtgcggcccttacttaggaaaaacacagccaatatgcataatctctaagtgaacccagatgatagattcagcagacgaagacttcaaaatagctattataaacatgtccaaggaattaaaggaaactacctgtaaaggatttaaggaaattgtgatgaaaatgattcaaaaaatggggaatctcaataaatacataaatagatactataaaactggaaatctagagttataaaacacaataatgtaaacaaaaaatttactagatgggataaataacgaatttggtatcatggaataaggaatccggtaacttgaaggcagatagaaattatcccatctggaaaacatagagaagaaatattgaagaaaaatgtctctcaaagatctgtggggcaacactaactgtcaatatgcatgtaatgaaaatcccagaggtcaaggagagagaaggaaggcagtaaaattatttgaagacataatggctgacaaatttgcaaatttgataataaaaacattaatctggccggccacagtggctcacgcctgtaaacccagcattttgggaggcggaggtggaggcgggtggatcgcgaggtcaggagatcgagaccatactggctaacacggtgaaatcctgtctctattaaaaatacaaaaaattagctgggcgtggtggcgggcgcctgtagtcccagctgcttgggaggctgaggcaggagaatggcatgaacctgggaggcggagattgcagtgagctgagattgtgccaccgcactctagcctgggtaatggagcgagactctgtctcaaaaaaaaaaaaaaaagttaatctagagattcaagaaatgcaaccatcaccaagtagggtgaatacaaagacatttacacttagatacatcaaagagaaactgttgaaaacccaagaaaaccttgaaaacaagaaaaatgacttatgtacagggagacaattatatggttaactaacagacttctcaaaaacaatggagtcaggaggtcatggaatacacattcaaagcgctgaaataagaaaaaggtcaaccaaaaatctatattcatcaaaactatcttggagaaataaaggtgaaataaagacattcccaaataaagacggagaatttgatgctagcagacctgccttgcaggaagtattaaggaagtccttcaggctaaaaggtaatgataccagacagtaactggaatccacagaaagaaatgaaggacattagaagtggcaaatataaatgacagtataaacatataatttttaaataaaaatttgcttagaagacatagattgttcaaagcaatgattgtgatactgtatggctgggtttataaactatgtaagatgccatatagatgacaataatagcacaaaggaagaacacggaaatagagctatattgcagcaaagttggctatgttttaacaggattaagtcactgttaacctgaaataaattgtaataaaatggatattgtaatctctagagcagccactaagaaaataactaaaaatatatagttaacaggtgagttgatttgcatagggtcactacaccaagctagtgcaagtaagacactttatctacctgcctcaatttctccatatgtcatttcaggacattaataccagccacacatcctcactgttaggctctgtcctcccatactagatttttcttaaatttttgaagtaagcacccagcatactgcagactgcttggtctctggccaaagtttaaaaaatctgacatggctcatcagtgaactctcagttctttccttctccaagcaggacatgggcttggctgtgcctgctgaagttgaagggctcatcagtgatatcagggaagttaggtttctctggagacaatgtgagtatcctgggttttccatcctctttcagagcaatgaaacctagtagagaccttgcattatacttcaatcagctgatcgtagccacttgaatttcctgtgggttctagttactcatgaaatgaattttagtactatcccatctaccccatacacatacacactgtcccctgtccccacagacttcaccctctacctccaaatcttattctctgtagtccaacatatcaaaatctgttcctcagtgtcttagacttctccactagcaagatactacttgcggtttattactctgtttagactaagagtctgatgccagaagtcaaggcttctggactagcctacttctcactcattattatctagaatataggccagtgtttctgagactttaatgtgtatatcaatcacctgggaacttgttaactacggatcctgattcagtaggtatagggaaaagcctgagattctgcatttctaacatggtcttaggagatggggatgctctgctggaccatactttgtgtagctagtttctagactagagcataactatgttctaacacccttcttggagctaatattaacacagcattagtttgagggtacaaaagataagaatggaaaagaggattctaaactataaaaagcaaaacatttaagtagggttcatttaacttcaaaatgtaaagttttaaaaaactttaatattaattcgttttgttctgttgtgtctgagttttactataaccatgtttactcctgtctctctttcagcagaattaaatattatacagattcatcttgaagcccttccaaaggagtgtgttgattgagataacaaaaataacatatttatccatccaaccatctgtgcagccatctgtttaaccatccatttcaccatctctccattcatctacatttctagggtccactatgttacaactatgctgtgaaggatgtaggtgttaatgagacagttcttgcccccaaggaatttcatctcttatagaaatgacacaattcttggaatatattctcaaggacagtattaatgtaaggccctaaatgttgtcagagtgctagttaagtacttggctgtaaacttgagtccataagatcattcaacaatgcaaacagtaccatcaataaggtaaacaaaacagaattttatttcctggataatgaacttactcctgtctattttaatacagggtcaacttgattttttttaaaaaagttggaagtgtagcttcttcactttcagcaagacatattcttttctttagtgcaggcaaaaataaagagaatatgcagagatgtcttaaggaggtaggtattaccagcgtagaggctggtgttgatttgtttgggtcaggaagctctttagagatggcaaaaactctgagatgtttccagagtacagagtagactcagaacattttaaagttcatgtcacttattttcttccagagaggttaagtcaaataatctattgaaagcacattcaggatttctgctctcagtctcttcctcccagaaaaatctgtgtagtttagtagcgtttctagtagtattttttttttattttgttccctttctttgctttacatctgctatgattacatttattttatatgaaaacattcttttattttgttttattattattatactttaaattttagggtacatgtgcacaatgtgcaggttagttacatatgtatacatgtgccatgctggtgtgctgcacccgttaactcgtcatttagcattaggtatatctcctaatgctatccctccccccctccccccacccgtatttttttttttaagattagtcaagtgcagtagtgagaagggggtctactagtattttcattaaggccaattaatcctaaaaactcacaccatagcaaggatatggaatcaacctaagtgtgcatcaatggataaataaataaaatgtggtatatatacacaatggaatactatttggccacaaaaaagaatgaaatcttgtcatttgaagcaacatggatggaactggagaccactgtgttagtgaaataaaccagaaacagaaagactagtatcacatgttctcactcatatgcaggagctaaaaaagtggatctcgtggaggtagagagtagaatgatagttaaaagaggctgtaaagtgtgtggatatgtgtgggggcataaagagagattggttaatgggtgaaaacatacagttagctagaaggaataagttctaatgtttaatagcagagtagggtgactatagttagcaataattcaaaatagctggaagcaaggacttgaaatgttcctaacacatagatatgataaatactcaagatgatggagatgctaaacactctgatcattacacattctgtgcatgtaaataaaatatcacatgtacctcgtgatatggtttggctgtgtccccacccaaatctcatattgaactgtagtttgtataatccccacatgtcatgagagggacccagtgggaggtaattaaatcatgggggtggttacctccatgctgttctcatgatagtgagtgagttcttacaagatctgatggttttatgaggggcttttcctccacttcactctgcacttctccttgctgccaccatatgaagaagtatgtgtttgcttccccttccaccatgattgtaagtttcctgaggcctcccaagcccaacggaactgtgagtcaattaaacctctttcctttataaattacccagtcttgggtatgtctttattagcagcatgagaatggactaatataccccataaatatgtaccaatgtgtattaataaaaaaatgaaaagttaatacacatttgatgatattgatcaacaccttctgacttatcaatactgctcccacaggtcagcttccccatcaccattccttccttttccttcacacacacacactttcacctgttacaggcttgtacaaattggaaagtcttagctctgcaagtaacttcaaagggacagacaaaactgtaaataaatatacacttcatcaaaacacccatgatggggcagaagaagagactaacacatactggaggatattcaatagttcttacctctctgctctgcctggccagccccttctcatataccctgtgacttctttccatgctcaacccccttctctcaactccttgtttgttcccaccatggggagagaagttagtttgagtggtcagagtttgggactgtagattgagccatgtggactagtgagcaaggttactgtaccttaaaatgcatagacttctttttccctcctccttctcacagttggatgaattagcagattctagatgactctgttgtcttaccttctcttcaactgcctataccagttcttcctgcctatcccagccaaagcaataagatgttcagatggacatttggggtcaaagggcccattgtaacctttaccaggcattgcatttggtgttaacctgcgtaaaactagtaataagtggtattttgatttttatttattattcctttcatggacagctcccccaggaactccagtggaagggaagataagcagaacaggatttgggcattcctgggtctctggccatgaaaatgattcatatcctattctaaccttgctaatgctggggatagaaaatagaatagtgtatcagttagggttcagtgcaggaaaaagagccactttaggtattttatgcaagatgtgatttaatgcaggaaattagctgctagtaaaagtcattggaaaggtgggaggagaaaaatccttactccaagaataacacagcaactcctaacccctatggaagttaccatctctgaagctacccctggaaattttgagtagaagtagaagaactcaccaccccatagtcaagacctgcattgcacaatctgaatgacaccttcaaggatcagaaagccagattaagaaactacaatccccactgcctctattgccactactttctacacaacgaagctggataatagacactgcaaccttgctatagaaatagctcctgtctccaagataatgttggccagaagaaaaccagtctaaaaggggcagggaaaaggcctctacctcatttctgccttctgtattttgcacaagtgcatctatttggtgggacaaaatttgtatctacaccctaggtgcaaaaacatctggaaatgcagcttttaagttttccagattctgcggtgcggacaggcaatctgaaggagagaaaaaaaggaagtaaatgcaggataatgtggatatgttattttatacttaaaaatatgtgctttatttgtttcatgctcaagaacaacctagaaaataatcaacagtataaagaatgtgataaatatcagatgatttttgtaagtaatataaatcttctaaagcaacctgaagtcaaaaaggagtacttacgagaagggcatgggaatatctcctggaataatgagaaaatttagaaggagacaagggcagctacctgggttcttaatggtcttccaattcttgtttcaggctgctgtgaggttctgccattcatcttgtcctcttcctgggactgagtggatacttgtgccatttttcaagatcaagaatatggaaaaaatgactccttagctcttcctatccctgagattcctcgactttgtaatctatcaattacacaattctccaatgtttaataattttgagcctcaagaaagacatacattttgtaacttcaaaaatcatgcttacataaagctcaatgttttaaaaccagccaaacaaaaaataatatagcagaagtctgggatgggtgaggaggacagtcagatggtcagctgaaaatataataattcaggaccagagagatgggcctgggagcagttggcacagatgtggttgttggggcccactggggcttaagggagtattagaccatatttctctttctctctctgagttaaggaccaagacagaaataaatacaaataccaatagatggagatcaatatatctgtttcaatagtaacaaggctggcttagatctgttgccacagtggggtttcctaaagctctcttcagatttaaaattactaaagttattcctgttattcctcagacctacagttcagtgtagtatatagagaagagcagaatttgtgatttccacaggcaggctggtacaaaaagagagaggacaggccacatgggaaccatggactttaacatttcaacctctcccctataagggactatgtaaaaataggagtcagataaattacttctcccatgggagaaaggaggggttcattcagtagggttctttcaatactattctttcttgggaatggaagttctttatcctgaaacatgaagacaggagcataacatttcctctaatagaactgtaatcattgatgtgaatatctgggaaaccaagaatagaagaggacaaaataaagagtctggagaagtctccaaaatacactaatacaaaacattgacagaacaaatgtggtcaaagaagcaggtggagaaccagaaaggaaaacaaaaacaaacaaacaaacaaacaaaaaacaatgttcaagaaatgaagggaagaaagaattgaaggaatggagggagtagatggtggaaagtgtgagtttctatggaaaacagatggtaaaggattaagaagcttatgagtttaaaatctttaaattttaaaaagagctgtattgatgtatacttgacatataataaactgcacatgttaatagcacaagttttagccttgagcaggagtagggacaattcttcctctgacacagaaatggaggaaatgagggctagttctataaacaagtaagttgaaagtcaaaaggagcaatattagaagatttgagacttgatggtttctttcctagtgaaaaggttgaatcatcagattgaaatgagaagcattaagtgtgggattagaggggctaaggatatgtggtagagactttttgaggcttaacccaaatacgttatcttcttcatcccttgtaagagccttgattttgtttaggttggcaacaagcatggttaaaagactgcatttcccagcttttcttacaacaaaatgtcatgtgattaagttacagccagtgggatgtcaacagaagtgctgtatgggacttgcgagaaggcttcttaagtggagataactcagctttcagtgtgccctacttgctctgttattatttcaccttcttgctgtctagaatgtgaaaatgatgactggtgcactggcagccattttggatcatgagatcatcttgaggatagaagccatctgctgagaatgacagagcaaaaatatactaggttctgatgattttgtggtacctgtatagcacacttggattgtcagcctctgaatttctttcaacctgattgagaaataaacttttagcatatctggaccactgttatttgggtttcagtgatatgtactcaaatacaatcctagctgaaatatgaccatgttaaagttatggtgagtggaaaagggaacttactagggtccagtgaagggattcatgagctgaggcttcagctgacaaagtcatgaatctgcaaggtatgtgcttttctctactcttggcagtcagggatcagaggcagaggcacaggcttgctggattcccgaagggttcagagccattcaagcagatggagcagagtgatagttgagagaggaactgcagaaacagttgtcaatgggtttgaagaatttgatcttgggatccaggttggacaggaaagaaagtgaagccagatgaggagtgaggtcctgagaatactgaatccttgaaggtttggggacggttttatggtctacaggtaaaatttcatgacattgtggtgaggctgggagattttgaagtctaatatttttgtggtgaaatcaaggcaacggtaatgctgaggcctgggtgtggccatgggagtcaggagatggctgcagtggaatggagatgaagctattggcataaagcagggccagaagatgcgggccttgtctgaatggaggatgactgttcataaaaatgacacagtgggatatcaatttgaaatccgttaaagtaactgacaccaagaggaacaacagcttcagctctaatctcaaagcaggcaggtctcatggaaagattttgggaagaagttcaaaatagactgatgggtgatttaaacagggcagctagagggcatggtaagcggaaggcattaaccaccccctcaacaaaaatccaatgactgaatctccaattaagcaaacggagccgaaagatgtctagccaaacatccctaaggtggacagcgactttgcgaaaggcaccagcaaattacatttcacattttctgttcagccattttctgaaacacaaacaatatttcaattagtgtcacaaagaaaggttcattcctgttaaaataagtgattcttctatagctttcagggatatgatgctgaagaagaaaagtacagacctggaacagtaatgctgtgtgtgtttttggagaaatcatcattggttttgtattgatttgtgcaaaagaaagtgtaatttaatgaaatacataatgttctcagccaggataacacatcagcctggaaatggggaaaaaatagctagtagattaaattctacagatgatggctaaataagtgagctgtgcttctagagtggtggccattaacctttccatcatgaggacaccatgtctcagtgtaacatggggataacagtgagttctattatcagactacctgactttgaatccctgcccttttggatattaactaggggtccctgggcaagttatctaatctctacatgtctcagtttccttatctatagaagaagaataataagtcagtcaccttagtgaattgtagagagtaagtgctcagctacacatcacctatatctatatatctatatctacgtaaacattttatagattctaagatgagaatagttgtatattaggatctctagactgagaaaatatgtataatatctacttctggttagatgtaaaaataggaaccttctatacccatggtaactccaggatcaaacaaagatcataggtatgaacgggactaccaaagagtaaatgtaaggaagccttgatgaactgacttcaacagagaagcgttcttcaccggcaagcagggagctacaggggtttccaggtggcgaactctggatctgggtatgagtgggaagaaagaaagttgacaaagatcaaaagactttgctggggagaagagacatccatcaagctactggtgatggtggggcaagtatgacactggactctgaaagtgccctgaatgatcagccggatgcttctcctcaacccctacctgaattgctactaatacggcactggcagaactgaaaaccagaaggaattcatggattatttccatggttcctggaaccaggagactgcagtcattgaatccaaggatggaactgaaacccagccaccctggctcaaatgctaataaaagcaaagaagttaggtagctgctgctgcagctacagcacaactagggactgggctaactaaggtaagctcaatcttaataaagctgaggcctatcccagtgaaacgtgatgctgagtgaatactggatgctcacttcctcaccttagctaccagacataggaaagagcttgcacgcactagaaaaaaaatcaaatcttacaatctccactatatttttatatacaataaaaaataagacatgtggagaaaaaaaccaaaatggtcagtagcagacccatagatgatccacatgttagaactagcagagaagaatttcaaacaacctttatgaatatgtttaatgaactataggaaaaagaaggaaagaatgggtgaacagatgagtagtctcagcagaaagtggacactgtgaagaaagccaaatgaaaattctagaactagagatacactctttgagagaaaaaataaatcggatttgtttaacagcagaatgggaactgcaaaagaaaggatcggtgaacttaaggaaagtaagtagaaattattcaaaatgaataatggccaaaactttttccaacttttattatggaaaacattaatcatcaaatccacgaatctcaccccctgcaggataaatacagagaaagtcatacttacgtgcaccatagtcagattgttaaaatataagcataaagagaaaattccaaatgaattcagagaacattccagggaacaataagaattatagcagacttattaaaaatgatgtctaccagaatgatgtatttaaagcactacaaatacaataaagtaaggaaaacagtcaaaagattggaaaagaaaaaataaaactatattcacaaatgacatgattgtgtacatagaatatacaaaggaatctacaaaaagctctcactattgaatctattaagtgaattcagcaaggtagcagaatacaaggttaatatataaaattaaatgaatctcacacaattagaaataaaatatgccatttgtaatatcaatatatttataataatactaaatattaaaagaaacatgtataaaactaaatactaaatcctaaataatactaaatattaaaagaaacgtgtgcaaaacctgtataatagaaactataaaacattaccgagggaaattaaagaagacctaaataaatggcagtaaaatagtagatgggaaatcaaagagggagattctgggtgaaggaattttccaattagagtcagcatctatcctagggacatttcagaaattcttcaggaattgtgaagttttcaatagagtgcttcagagctggggaacacagacagggaccctcaatgactcataagaccacgaattctgttatacttctagcctcagtcccatattctcatttcagagtaaagactagaactaatggattttgaatttataagccgttgagagtggatgatccatccattcatccaaccaactattgaacatgtacttcctgtttcctttggagtcatttgaagaagggagctgaaaagagcttagcttatgtctaccccagcatcatcactggccatgacttctagtagtgtaaaacttaaggtttcctgaagggctgtgaccaaaaatttgtctcttctgctctatgtcatttctttttctttttcttttttttttttttttgagacggagtctcgctgttgcccaggctggagtgcagtggcgcgatctcggctcactgcaggctccgcctcctgggttcatgccattctcctgcctcagcctcccgaatagctgggactacaggcgcccgccacctcgcccggctaattttttgtgtttttagtagagacggattttcaccgtgttaggcaggatggtctcgatctcctgacctcgtgatctgcccgcctcggcctcccaaagtcctgggattacaggcgtgagccaccgcgcccggcctctgtgtcatttctgaaagctgacactgtaccattgagatttgactctgttgggtcaaggtattgttccctgctagtaaataagttttcctatcatgattaatatactgattttacattaataactaaagtctacttatataattttgcagtatactgagagcactgatcttcacaggaaaactcagcatattaggaatacttgttttaatatttaaatctatttaaaactgaatattatttttgaatagttaatgacttcctatggttcataatttggaagttcaaaatgatatatagtaaaaattctctctcattattatagacactgtagcttttctcagggattagcaatgtgttactggttttttgtgtttacctccaaacatattctatgcatttaacagtacgtagatgttcctttctttctttttttcttttttccttccttccttccttccttccttccttccttccttccttccttccttccttccttcctctctctccctttccctttctctctttctctttctttctttcttctcccttccttctttctttcttctttctttccttcttctctttctttctttctttcttgccttccttccttcctttctccctttcttccttccttctctcttctgtctttctccttccttccttctttttccctcccttccttcctttttttcttgctttcttcctttctctatctttttttttttttttttacaaaaattgagcattttttctgtacccctttctaaaaaaattaacaatactttcttggagatcatttcacagtattacacaaataacctcctcaactttactaaaacagctttcacatgcattatctcactgaaaatggctggacatggattaggcatgatttcctcttttttcccttgtgtgacaaacttaacctgctgatgcacagtgaagaagtgccagagctaggactaggacacaggccttccaattccatgtccattgttcatgtcttatctgtgatatcagcctgtctgtgaaattgatgtgaggattcaatgctttctctataatgagccacctggatgtttacatttagtggcaccgttgccctagcccagtgtctaactaaatataattgctctgtaaatgtttgttgtgtggaataggattggctaattcataaccctgggtgatgattcactttttatcatcaatctctcgtgtttcctaggagatatatccttatcatatgtggtgacagaaatgctgggcacggatgcaaatacaaaatgttctggtcccagccaagtgcaaattggaaaaatttaaacagtcctccagctagcacactggtgagtcagatagcacctttctgccctgcaaggcctccagtctgtaaatctgagaagcagaaatagcatctttagtctcctgatttttccctcttgtgattcccatatttattggacagaaaagcatgaactgggtaaactgtgctttgtttataaaccctcatttttaggaatctgcaaaacgtgcttgtttccttggaaagtgattatagaaattcacgccctagttgtgagcttgtgcaaatatgtgtagtaagaggagtgactctcatgtttagtgtgaacatatgcttctacatgattaaagaagcccaagcaatgattgtaagtatcctatttcactcagttttctgcatgtgatgggtaagggagccttctcactcagattatacttgattaggttccctacttgggcaactttttttttcccttcagcagtttttactgataattgaggggtacaagtgcatattagaaaaccaagtggggggccagcccagtggctcacgcttataatcccagcactttgggaggctgaggagggcagatcacttgaggtcaggggttcgagaccagcctgcccaatatgacaaaaccctgtctctactaaaaatataaaaattagctgagcatggtggcacgcacctgtcatccaggctactggggaggctgaggcatgagaatcacttaaacccgggaggtggaggttgcagtgagctgagatttgcaccactgtactccagcctgggtgacagagtgagacactatctcaaaaaacaaaaaacaaaaaacagaaaaaaaacaagtggggaaaacttgagcaccctatttgagccatgggttacctaatttccaagcaagtaattttacattattaatttttaacttaattccagaggacacactttgaataattcattacttcaaaattatttgaggcttggtttatgatccagtttacaaacaattttgatcatcctcaaaacaacattatgagatatatgttattaaagacccattttaagcataaggaaactagcactagaggggtaagaaacttgttcaaggttgagttgaaatttgaattcaggcattctggatcttaagtccatcctcttgaacactgtgccgtaatgcctccacccacgagaggggaaaacgggcagattcttaaaaaggcactgtgtctaaaatcttacgaaatctgctttgaataaaggcctttacttagcacagttgaaacataatgaacccattttcagcgttgtataatgggagggaggtatacacatacattggtgcttgttcgtatattgagaaggataggtccatgtggggtatgtccacttgtccagggatcttcatgtgaaggaacttaatttaagaaaagaggccattgaaagaggcaggcttggatatggacaaatgatccctattgggggatacttacaatagggcgtatcttacttactcttctgtgggttcttgcttttgctccaggaatttttgcccaagacctggaaaggggagtggaaacaagaatagagttgccttggaggtaaggagtatttttccacctggcttgaagtggccacatttcagaaggatagaatcatggaagactagtcagtgagctggacctgggttacctcccaggagctgcaacatagatcctagtgatccttggagtcaccagcaggtgtgtaagagatacacccatttggacttcagttgtgtactccaggaggagaagggtgccaagccagcaatggcagaaaagcacagtgatccagagacctaggatctgagcagaagggagtatctgcttaagtcccctaaaagtcctctaagcttggaaatcacaggtagagccagagaactactgcttggttacatgtccctacttcctctctaggctgataaggcctgggagatatgacatgcatgttgttctttctatggtaagcaaagcatcaaactcttgccaaggaggaaggagaaaagcaatacagtgtaaaacacaatttatgcttttcaacacaaatttgtggtgtaagatgttgtaatctatttgtaatataagataacaatattgtaaactcacctaattctcaaaattcattcttacttgctactgggagtacaatttatgagggtggtttatggtaatgtacttaattgtctttatattttcagtcttcagcttaaagattgtgagtatttaacacaatgcttaggatcatggtgttcttatgatggtaccagaacattcattcagtgttgtgtaataggagggaagtatacacatacaaattaagaaataatctagatgcctttaaataccttacatacaattcatgtggaaaggttgcaaatcaccacttgattccttgtatttttcttaagattctttatagttcacaaattgcctgatttgatcttcagaacaaccttaggtatggcagctctcaatattttcatttttcttatggagaaattgaaatccaaagaggtaaaatggcatatccaaggtcatatagaggggagtagaactggatctgaactccgttcttctgaatttaattccaaagttttttcattttgcctcacgttccctgaccatctatccatccatccatccatccatccatccatccatccatccatccatcttttcattatcaattcattcaacgaaaatttttgagtgcctattatgagccaggcattgtactaggtactgactcatagaaatatgagtcagtcatagatcctgttcccagggactttttaatataatagggatatcagctatggggctgagtaattctaaatggagacagaaagtagtaagtactatgagtgaatcagaatgccccacaggaattctggtgccagagggataacttagaactggagacaaatgagtaagggctggaacaggagggatttatgtgggagggggccatcttatagggatgctatgtgtagagacaaatcctttgaaattaataggctgggagaatggcccaagcttaacctgaaatgactcttaagcacaagtaaagaagaaaagagagtgaacatatctaagatggaacagaaaaggaagagttttagccagtgacatgaccttttaaaagaatatgcacagactttaaagttctgaaccaaagggagagaaactgaaaagtggaggaagagacttaaaagtaggaggatccagaggcacagtttttctagacgcagtgggtattttctgctcaacctgaatacttggagcatcttgtgggtaagagcaacataaaatcttgatatagctgcttctacaacaggttgaagagaatcaaaatcaacacatatacagcagaggtagaacagctaagaaacttggaaaccccagcttttggaagtgggtccaactgttatgagtgttagggtagcagttgtgagcagagtgagtgagttttagaaacagatcacccagggattctcagtgtttagatgtggtttgcatatttaatgtgaaatatatatcttataaaacattttctgttaagctgtattttagtatgatgttgtgatggttgtttgctctgtatgtgtgatttttttttttttttttttgagacatggtcttgctctgtcacccaggctgaagtgcagtgatgagatcatagctcactgcagcctcaaccttctgggctcaagtgatcctcccacctcggcctcctgagtagctgggaccacaggcacgtgccaccacccccagctgctttttaaattttttgtagagacgaggtctcactttgttgctcacactggtccttcagcttctgggctcaagcaatccttcggcctcggcctcccaaagggttacagtcatgagctaccattcccagttgatattttttattgtggtaagaaaagaaagtagggaatatttccatgaggaattatcccatgaaactaattgtctcaaggaattaatctaaaaactgccctgacttaaggtaacatgtaccttatcaaaggtcccaagtcacacctactagttcaggaattaggtgagatcaaccccaaaaggaccaaatgataatatttccacccttcgattcaaccagggggtttgtgtacagagagaaaatgtggctaaatttgtgtattccttcctagattataaaagcctacaaaaggagggaccatttcttgatcatctttgcattgtctatgcctagcattgcacctagaaggtagagatgtttgtctgatcacgtgcatacagccttgtctgcgagcatctctgatagtcatgacagttcttcacagactacagagatggtgggccatttaagtgatacagacattaagtgccacaggaattcacagtaggggaaatcacttctggctcgggaggtcccaaaagccttcttaggaaaggtaggactgaattagacctggtgagatttgtactagcaaagggagatggggagaatggtatgttccctcacccttcagtgtccacagggtagctggcacttcagagggtgcccacagaggagatggagctggagaaagagagctttgcaagccacagctacctgccagaattgtggagtctgcaacataatctctaagaccgtgcacctccaaatagaaatgaaaatttgagcatggggaaaatttgagctgaattgttgtcccttaagcctaagaaattgtctgaagcaagaatgtgatgccccttcagctcttttcttctcctcttccacatccccatcccaaagaagtgatctggcggggaaagaagaaagggaggaaaagaggaccagatctctggattaaacctcttgaaagagttggatagagagaagtcaactcagtcaaattcagaaagagacgaaagaggataaaagtcccatccaggccagaagcagtgctctgggtgaaagacgttttcagtgagatggtgtcagggaggaaaagctaatagggtttacttagaatgtattgtcttcttagtcccaaggctaaagtaaaaaaagacaaaagagagcatgttagaggaagcaactagagagagagaaaaaaagtcagaagacctccagtaaggcactgcacacgtccttgagtctgtgtctctgtgcttcttccacgtttccctgagcaatgattctccactggggcattcagtggaattcccttctttaggtggcaccaattcaccaagctctaaaataagcccttctgccaccctttaccattgcctcatcagtgctgtggggaaaaattattctattaaaatgcattttctttttggttgtctgttaaattcttgcagggctaaatgtacatgtattttaaaggagaagctgaattgttgtcccttaagcctaagaaattgtctgaagcaagaatgtgatgccccttcagctcttttcttctcctcttccacatccccatcccaaatccaatagggcctgaggttttccctgaagaaggggaaaacaggttttctttgagaagtgatctggccgtcagcaagcaccattactaagcatgatgaccagtgattgcttcttccccacagtggctgtggtggcactccccatctcagtgacttgagaaagaacagggcctctgtaatgttgatacagaaaagccgaaatcagggctcacagcctggttgaatggaggaggaagggacttaaaagtagtgctattcataagccaaggtggttgacatgaggccttccacagcagtgacagaggagacggaagatgtcattcttgagtaacaggaagttactgtaacaccagtttttattactaaagatgacaaaaatactaccaatgacatttatttgagtgcttactatgggacaggcactgaatagtttatatatattcattcatctaatacaacaactttatgagtaggcactatcattaagacaatgatgtccaaaaaaaggaattaaataatgcagataaagcagtccactttgaccactatataccagccccccgaagggtacagatgtttctcttttggcattcgatggctatttagatgtttcccagtttttctccattataagcagcatggcattgaccatactggtacctgccttcctgggaacttgcaagtcattctgcaggatagagacaaagaagaacaattgctaggtgggaggcaatgtgaatttacaagtttttttagataactccaaattgtcctccacagaaaggctttttcaattcatatcctcaccaacagtgcacaaggtatataccttttgctactcctcaggaaaacctgctgttattaatcttcttacattttgtgctaatctcctgtgtgaaaaatgtcttgtaattattttagtttgtttttctctaattgctagtgaggctgtgcatcttttcacatcttttgacactggctatttgtctttcttctgtgaattacctactcatatcttcttttatttctatttggggctatttgtctttgtcttgttgatttataggacttctttacatattccacatgtttatgatttgttacgtgtgctgcagatatttcctcccagtctataatttcttttatttttagtttatggagccttctaccatttaaaagcttgatgtatccaaatttattttcctttcctttcttgcttctgcattttgtaccttgatgtattttgctgtattttatactttcacgggtttgctttcatgtttggctctttaaaacatctgaaacacattaaacagacatagaacatcctcttttcttacccctagacacagaatataataaagaagatgctaattatagaactgaatcccaaaacaagagttaagtagaagtggccatcatcccatctggatgtgctgggaggtgctagcagtttgctagagagagtttcctaaggcatgaatctccagtgctccaaaccgcttagagaatcaaactcttcaaagggacttctcaaggtaaaccctatatggagtattttccagaatacattaatattctgggatattagtaaagtattaacaattatcacatgaggaaaggcttttgtggtcatatatggctgagaaagacttggttaaacaatattaaatgggtttatttgaaggcaacttaattaatgaacatctattttggtcagaggctgcaagttgtcttctgatagaagtttacagtgtgtttaaaaacccaagggatcatttagttcagagccaagtttctcaactttaactacattttggaatagccagggagcattaaaaaaaaatgcggaaattcaagtctgttagcttcagggactgtatttaataggtctatggtgtggtttgggtatgggaattttaaaagtttccctgatgatgccaatgtgcaacccaggtgaagaaccgctgattagcttcatggcttcatttagtagacagggaacacaagccagtttgggaaatagctgggaccagatagagatgtttggaaccctaggcctggcctttccctctatactgtgctgccttcctacaacacttcgttaatttgtaggtttcaacctggaacacacattacaggcattggctttggcatatatcagatgctaccttgtattgcttgttggttctaaagggtctcagttttcttttctgtaaaaggggcctaatacccccttttcctcgtgtcatcgttattctttgaattgaatgagcgaatgcatatgaaagttctgaaaaatgtacattatgcacatggaaattagagtgggcagataaggtcaggtgacccagtgccaacacagtgctccattcataaatgggtttgggagatgtttattgacagtaattgcttgtgggaataagaagcagctgctcttacagaacaacttcctcacaaatacacctggaattcctcacatcccagcaagctgtcaacatcacctccctcagggaactcttgattaaggttaccatattttcagctccaggcattcagaaaataaattctacataattaaaatgcacatgcatatgcatgaacgtgtatataattttgcatgctgtgttgaatagtctccaacttaataaagtagtacaccctgtggttgtcatcctgcgggtgtctctttccctgggctatcccctaatacagaggacaattgttcagggaccagagagacttaactaatggaaggagctgaaagaagctgcaggcaaaggaagaggcatccagggactggaatgggaggcctctctcctgctgacagcaaagcagcattgtggctttcccagagcatcgggcaatgctttcctgaagaggctttggaagcatttagggctctgtaggaatctggaaatccagcctgctctgtgcttgggagaccaccccctccttagccacagaaggaattcagagcagcctgaaagcggcataaatgcctccacggactttcccttcagtggtaggaaggaaacaatctcactaacaacccaggcagtctgtgtcatttgtaattaattcaaagtatgtatgtggtaggtcctggagacacacagtgggtgttcagaccctacccctgtacttgtggagaatgcagttgtatggaggatactgacaaaaagtcaatggaaaaatcaaagaatgacattttgtcatgttaggaaggaagcagacgaggggccggcaagggtggggtgggagggcatttgctttagtgatgatggtcagagggagaccaatgtggctggagagtgaggaggaacctggcagaaaagcagatgagacctgggcagagagcagattatgccagtgtgtgtgggtatgctgcatctattagacagccatgtccacttcgtgggtgataatcaagggcgatatttaaaatagtcaacacctggcaggggtggacctggttttgcttaaacattttggggagagggcctttaaaaaaagaaattttcaagtgtcttctcaatgactttttgtttttaaaacaaaacaaaactgatacggccttataaacatatggctaggatctttgaaaggtgttttgcatatggaggccctgaaacttaggcttcatcagattcacagtaaatccacctttgaaaatcattcagagcagatgccagcagtaagcactggtacagctgtcctgaggcatcccagctaaatgtcagatgcagatgcagaggttctttcagggctaagaagaaaaccttgaaaagagtggggaaggggtgttagggatatttgcatgtgagtgggggtaatgatgccctctgaatctaagctgcaaagttatagaagttataatatatataatagtaatatattataatatataataacaatgtatgcagacagaggaaaataatggaggagtcagtgggttagagatcttatagaagtcctagaattgtactagtggggtgccagagaaagtgagctaaaatgacaatgaaaatgagtccttggaatctagaggttagaagtggcccattttctggtgatggcaaagggcaggaaatgaccatgcagtgggtggctggagtagtgtggaggaaatgtcagtgaaattgagggttggagtgtgggatgactcacccatgtggaactttcagctacaaatgatgtcatgagttgggtagagaggaagacaatgagaattttttttaaaattaaacttgagaactctttattatgtaagaaacagctataactctcattttcttggttgctaggtgtgctgtccaggatctggaaagaaaagtgcacacaacatctaaatttttctcccagtgggagattctactgctggtattagaatcacaggcagacattactgcacttgtttgggcttggctgaatctctgatcagttacatagttatatatgtctgcattttccctttccttgctggaggtaaatgccttttgaatggtcatagtctctatagagaagtgtgttattaaaaaggaaaaaaaacagcaacagatattttatgatatataatggtttttgttttgcaaaagcctttcacatttatctcatttgatcctcagaacaaacccataaaacagtgagcattttcccatacaagacagaaagaaacagtctcaagttaagcaaaccacagagcttacacatgttatagaaaccagagctgaggcttgaatccaggtattctgcctccctatccagttctctttccaccaaagcatggccccatatctttgtggtaatgttgccatctcagctgcttctaccaaattgtttgttcctaatgttgcaagcctgttggtctcagagaaaaggggcaaatgagagaatcctgggcctgagccttcagacccatgagatatttgcttcctccaggctggagtttgcttgctaaatgaactgtgctggttgtaaagatcatgaagccaactgaaaaagatttataagctgtctaggtgatcatccttaatgggaatacataggagtgtgggaaatctctaatttaccaccttgatttgtgagggtgtgtacactggcatggatacgtgtgtaacccaggcagcctgctacaccagtttccaagctggcttgcttcagtgcattcacacacataaatcctgtcattgggaatatccttcctggcatcattgcatgtctcattcaatctcatgtcccagcttaaatactcaactctttggaccactcttgattttcctagataaatgtaaagttttcctcctctgaactctctgtcaccctcctgggacctcacttatggtacttttcatcttgaattagtgggagttgaaaaacaaccagtctttcgtactctattgtaaatgtaataccttaaggccagggaacatgtgtcattcatatttgtgtatctgccagagttaccttgcaccctgatgtaaaggagctttgtttgcagtctgcaatgagggactgctcatcgggcccccagtctgcacagcaaatcttgattcgaggcatccagaagagttgactgggggtgtctggagctcatgagagaaagaaggctgaattgtggtcctagagagggaaggtaaagtcacggagcgaatgagatcaccccaggaaactgtgagaactagtaagaagtgatgcagcccgaggactgaaccttaggcaaacacataaagggagaaaagtaaaagaggagcctctgggaaggaatcactgggattcaggataaagtgaagtcataggagccaggaaggaatggtgaacagtggaaacattcagagagataaaataagatgtttaaaagtgtccgttggattgaatgacagagaggacatgatgttctttgccatgatagcttctgtgaggtggtggctaaggtgatcagatgtcctccattgcttgggactgagggggtttccaggatgtgggacttgcagtgctaaaaccaaaaaaattctgggcaaactgtgataagttggttactgtaagtgagaaaaataaaaatcaaactccagggctgaagagcgagtgtgagggaagaagcagcaactgaagtgaagagcagtttttggttcacagcaaaattgagcagaaagtgcagagttcccatagacccctgaccctgcacacacacagcctcctgccactatccacatcccacaccagagtggacatttgttccaatcagtgaacctgcactgacacatcactatcacccaaagtccatagtttacattagggttcactcttgatgttgtatgctatatgagttttgacaaagtacaatgtagtttagaatgtcagtatgggaggaaattattaggtgtaaacagattggaagggaaaagagacacggatgcatgaaactgcatttgcctgtattttatataaggttgaaaaagtaccagttgtccacatcaaggaataaagggctgatggagatttgggaggaagttaaaccctgcctcaaattcaactcccgtgtagatctctaaggaaagccctattccttatgctacctagatgaagctgagatgccagaaacacattgtagcaaaagaaataaaattctcaaggatatatggattctggactaggtctattactcatgactcatttattccctcaacaatgcctctgaagaggtcttggaagacattgtttaaacagaacattaagatgaaatttctgtttctggaaggatggtatggaaaactagatgctctgtctggctgtcttaccaaaaacagtttaacagtctggataaaatattttttgaaaaagtaagtgcaagctggagctaggatgaaaacagtgagagttgagagtcctaaaccaaagtgaataaaaaggaacaaaatgttaatacacgcaacagtatggagtaactcaacaccattgtgctgagtgaaggaagccagacaaaagagaatacatactgtgtgactgcatttacataaaattcctgaaactgcaaacgaatctgtagtggtaggaactaggtaagtggtttcatgggagtaggagtagttggaggaattgttacaaaggagcagggggaagcttttggggtgatggaaatgttcactctcttgattataaggatggtttcatgaatgtatattgccaaaattgatcaaatatgtgcagtttatggtacttcaattatacagtaacaaagatcctagtaaaaatacccagactagctcaggcagaaaaaaaagtgacggtaggaactcaaatttgaacattgctttgagtgttttttaccctgagggcatacaccaaactctactgatcctaagcttcactctcacatcctgtcagggcaaggggaaaggagaaaaagcctgaagtggagagtttaataggagagcccctgtaggaaactgggacctccacatgctgtacttttaatgtaaggatgaccaaaacataagccagtccctcactccctgcccgcccagcggataagttttatgtttatctataattattttatctttttttttttttgagacagagtgtcactctgtcacccaggctggagtgcagtggcacgatctctgctcagttcaacctccgcttcctgagttcaagcgattctcctgcctcagcctcagctgggattacaggcacctgttaccatgcccagtgattttttttttttttttttagacagatgcatttgcatcatgttggcctgactagtcttgaactcctgacctcaagtgattcacctgcctcggcctcccaaagtgctgggattacaggtgtgagccaccgtggtgggcccctatacttattttatcttgatagcaaacacaaggtttctagattagtgatcagaccaattatttacctacagcagtaacattaatggttctccatgctccacttacccctttgtggtgatgtgatgagggcagatattccccttgcatgtacaaagggagtcagtccttttggagggaaacccagaaattatgaacctcagagtttatgaaggaactgctgccctttcctctgcagagaggaaaagaaaccattgctctctaatgtaaaccaatcctctataggaagagaaggggaaggtccctaggtgtccacatcctttgaaggtaaataaataatagtttttgggaaaataaaccttcaaatctctctggggtaataaacaatctcgaaattctaaggcttgtttaccattcactcatacttggccaggaatttttgctcatgcacaaacaggaaaatattcacactgtttcttgacagaggatacatgggaacactgcctatctcgagcttaaatacttactggagaagtgaaatactcagttgagcattaataaacataatatggcctcatgtagactgaattcatattatttggattgtaataataaattaaattagacacttaattgattatttaacagctgattagatatagctcaaaacagacctgagaaataaatctaaagagatcaaccagtatgctgcaaagagagacaaaaagatggaaaatatgaaaaagtggttaataggtatgggaaacagaatgaaaagatctatcatgagtctaaatggagtctcaaaaggagaaaagagagagaatagtgaagaggcaaatttttgaaaagataatgactgcagaattgatgaaagactgtaatcctcaaattcagacagaacaatgaattctgagcaggttaaattaaaataaatacattcctaggtacatcatagtgtatattaaaagcagcaagagcgattactctcaaaagagcacctagatcactgaccaagaagtcatctgattttttaaaaattgagatgtaattcatagaccattaaattcactctttttaagtgtacaatttagctatttaagtatcttcacaagggtggaaccaccaccactacctagttccagaacattttcattacccccaaaagaaacttgtaccatttaagcaatcattctgcattccactcccttcccccaacccctgtcagccaattctctactttctatttctatggatttacctactttggacatttcatacaaaaagactcatataatgtggcctttcgtgcctgctttctttcacttagcataatgttttcaaggttcattcatgttgtaacatgtatcagtcactacttcattcctttttgtggctgagtaatataatactaatattcttaaacattttctttattcctttatcagttgataaacatttgggttatttccattttttggctattattaactatactgttatgaacattcatatataaatttttatgtgaacatatgttttcaattctcctggaatatacctagaagtggaattgctgggtcatgtgataactctatgtttggtttctaataaagtgataaacagttttccaaaagtagccgcaccattttacattcccaccagcaatgtacgaggattctggtctccccacatgcttgccaaggcttgtttttgtccatgtttttgatgatagccattgtagtggatgtgatgtggtatttcattgtagtcttgatttgcatttccctaatgactaatgatgttgagcatctattcgtgtgcttattggccatttatatgacttccttggagaaatgtcccttcaaatcctttgcccattaaaaaaaattgattgtctttttatttttgacttataagagttctttgtatattctgcattcttgatccttattagatatacgatttgtaaatattttctcccattctgtgggttgtctttcactttcttaatagtgcccatttaaaaaaaaatgaaccattgaacaccaaattcaaaaaatttaaaaactattatagtgttatcctgatttgctggttacctccttttagccttcactgcgtaaatttggcaaacccaaatgtaagcttatcttggatgcctgcctttctctgccgtctctgacagttgcttaccactccccagaaatgtatttcctgtggagtggacataccataatgtttgtaaattctgagctactcattttttcctcaatatcagatattgccttgtggaatacagaatgactgcccctagacaacaacaatttaagggtggtcagtaagagtaagtagcaattcaaagatatttgcctcatgcgtgggcacatttgtatgtgagtgtgtgcatatacgtgccttgcagatccagagctaatgggataggttggtaaaatgattgatggtcttccccaggaggatgatcaatattaacgatatatagatggttttcctcagatttctcatgctttttttttttccaattcactttaccgggcaagtaggagagacatggagttgatcctctcatttccctccaaacaggttgtggaattcaccttgcatacctcctgtttcctcatacagcccctcctcataatccctctgcatccccaccctatgggtcactgagttgcattgattcagctaactcagtatctcccacctaaccatgttctgtttccatccacaccctcctagtttaaggcttcatggctggcagcctcctaacttacctccttgttgtagtccctcgaattccactctgatctctgcaccactgccctagcatccttctaaaagcctgtagcttgtcatttatactctgcaaacctaacaagagggaccaggtcttctcgtctttagaaataaaacataaatgagcatgtcacttttttgttaaaaatcttctctggctcccctctacctttcgcctgccgtctgaagaactcagcatggcatccaaagccgcttccaggtgctgctatcatcacacttcctgcccgactgcccaccattctcctttcctctcacatcctgtcctttctacaccacggctgccctgcaccactctgccccctatcattgagggcatctccatgtctctggtgcagttccagtgccaactgttctgtgcagactgccctggatgtttgaccagtattattccttcgctcccactgtgctttgtctgtatctcccagacaacagttatcgcatgcctcctgtctccttcctggaaggcggggattttgtgaattcatacataacctctcagggcctggctaatcattgatggtcaataaacatttgttgaattgagctacatttttatgtgcaagcttaactttagaaagaaaaacttagggagaaaaaccaggagaggaggtgggtgtgggtttcataggataacagtctcttgattccccagaatttcgagacgtttcagatgccaccaagctgaaactcctgcctcatgcggcccttgttcctgtcactctctttcttctcttctctcagtctccagcttgcctgctactcctcctccacgtggccaatggttgtggtatctgcctgcttcccctctggcttgtctgatggtcccacgaagaggctggaaggcgaacttttctgggactgtctccatggggacttggaatgtaatagacagtcttcctgctgcaggcaggcaggcaggcaggcaggaggggcaggagagggaggcaaggtctcaggtccctttcctctcttgccctggagtgaactgcatgccccatattctgggaggagagaattcagagcaggtgtttcctcctctgaaaggcaaaacattcctctagcacttcatcttttctctgccatctctgacatttgctcaccactccccagaaatgtattccctgtggagtaaaatctagagttcagctgaaggacaggaagaaaaaccataaaacccttacatatcaaactgtctgacctgctgatgtaattcatttgcaaggacactataagattgttatacttagatagagcttgcgtttggcaccggcttcggggaattgctttctctttttctgcacatagcaaggatcatccctgtccttatcctggggtgtgggacctaccttccttaacccctattacctagtttcctggccacttggggcttccttcttataacttcttgtaatgactgtattcatactcacataacttttctgtatagctttgaaaacagatctccccatccatccttcctgccccttcatgcctttcctaagctctccccaccaaaacacacaatttgagggctagcccagtgcatagcatctacttacacagtccagcatggtatctactcgttcttgtcagacccctattgacttcagtagggatggcactgtgttcaagaggctgaagagacccagagccagtgaatgagacatagggtttattgaaggaacttacacacagggagatctggtggcagtgggttagagaggagaactgccaccacttttaacaagtatgcaatttatatagcattttcacttagtatcctctccctagcaacctccacctggtaaccttcattcaacccaaaacaaagggccttgagcccctgtatgagctgcattccacaggatgggcagagggcatgtgtcggtagtggtgggggtttggatgttcctcatagataaggaatgaatctctgggttggtcactcccggattccttatcttggaactctaaacacattcttcttagaccatagggtcattcgcagggtatgcttacattaaggtattgctgtcacttatgtctgccatacactagtaatatgttgctacttaaatgtaaatgaaggaaaattttcctagccagagcaatcagacaaaagaaagaaataaagggcatccaaatcagtaaagaggaaattaaactgttgctgttggctgatgagatgatcatataccaagaaaaccctaaagattcatccaaaaagctcgtagatctgataaataaattcaggaaagtttcaggttacaaaataagtgtacacaaatcaataacactgctatataccaacaatgaccaaggtgagaatcaaaccaaaaactcaaccctttttacaacagctgcaaaataataataataataataataataataataataataataataaaatacttaggaatatatctaaccaaggaggtgaaagatctctaccatgaaactacaaaacattgctgaaagtaatcctagatgacaaaaacaaatggaatcacatctcatgctcatggatggctagaatcaatattgtgaaaatgaccatgctgccaaaaacaatctacagattcaatgcaattcccactaaaataccatcatcattcttcacagaactagaaaaaaaaatcctaaaattcacatgaaaacaaaaaagagcccacatagccaaagcaagactaaacaatcaacaacaaccacaaaacaaatctagaggcatcacattacctgacttcaaactatactataaggccatagtcaccaaaacagcatggtactggaataaaaataggcacatagaccaatggaacagaataaggaacccagaaataaacccaaacacttacagccaactgatctttgacatagcaaacagaaacattaagtggggaaaggactacctattcaacaaatggtgctgggataactggcaagccacatgtagaagaataaaactggatcctcatctctcaccttatacaaaaatcaacctgagatggatcaaagacttaaacttaagacctgaaaccataagaattctagaagataacatcaaaaaaacccttccagaaattggcttaggcaaagactttatgaccaagaacccaaaagcaaatgcaatgaaaacaaagataaatagatgggacccaattaaactaaaaagcttctgcatagcaaaagagataatcagtaaacagacaacccacagagggggagaaaatatttgcaaactatgcatctgacaaaggactaatatccagaatctacaatgaactcaaacaaatcagcaagaaaaaaacaaataatcccatcaaaaagtgggctaaggacatgaacagacaattctcaaaagaagatatacaaatggccaacaaacatatgaaatgatgctcaacatcgctaattatcagggaaatgcaaatcaaagccacaatgtgataccaccttactcctgcaaaaatggtcataatcaaaaaatcaaaaaataacagatgttagtgtgaatgtggtgaaaaggaaacacttttacactgttggtgggaatgtaaactagtacaaccactatggaaaacagtatggagatttcttaaagaactaaaaatagaactaccatttgatccagcaatcccactactgggtatctacacagaggaaaataagtcatatgaaaaacatgcttgcacatacatatgtataacagcacaatttgcaattgcaaaaatatggaaccagcctaaatgcccatcaaccaatgagtggacaaagaaaatgtgagatatatatatatatatatatatatatatataaaactcagagataaaaaggaatgaaataatggcatttgcaggaatctgtataaagttggagaccattattttaagtgaagtaactcaggagtggaaagccaaacattttatgttctcactcataagtgggagctaagttatgaggatgcaaaggcataagaattatacaatggactgtagtgactcagagtaaaggatgggagaggggtgagggataaaagactacaccctagttacagtgtacactgcttgggtgacaggtgcaccaaaatctcagaaattactactacagaacttgtccatgtaaccaaaacgcatcttttccccaaaaactattggaattttttaaaaaggaaaaaaaatgaaaaaaattaaaattaaaaatttatactagtcacatctttagaactcaggagccacatgtggctactggccacatattcatcattatggatttataacattttcatcattgcagaatattctgtttgaatatagtgtcactatgaggagcatgtttgtctttctgggacatgttcattgaattttatctgagaaaaatgatttttttattgaagcttttattattcatatattgtttcttcagattatcattttctttctttttttttacattttaatttccacagattattggggaacaggtgatgtttggttacatgagtaagttctttagcggtgatttgtgagattttggtgcacccatcacccaagcaatatacactgtaaacaatttgtagtatgttatcccttacccaccccttaccatttccccgagtccttaaggtccactgtgtcattcttatgcctttgcatcttcatagcttacctcccacttatgagtgagaacacactatgtttggttttccattcctgagttactacttcacttagaataacaaactccaatttcatccaggttactgagaatgcaactaactcattcctttttatggctgagtagtattccatcatatattatgcaccatggtttctttatccactcgttggctgatgggcatttgggttggttccacgtttttgcaattgagaattgtgctgctataaacgtgtgtgcaagtatctttttcttataatgacttcttttcctctgagtagatacccagtagtgggattgctggatcaaatggtagttctacttttagttctttaaggaatctccacactgttttccatagtttacattctcatgaaccatgtggaattattccctgttcactgcatccatgccaacatctattaagttttgattatggccattcttggcatgagtaaggtggtatcgcattgtggttttgatttgtatttccctgataatcagtgatgttgagcattttttcatatgtttgttggccatttgtataacttcttttgagaattgtctattcatgtccttagcccactttttaatggttttttttcttggtaatttgtttgagttcgttgtagattctggatattagtcttttgtcagatatatagattgtaaaaaaatttttttcactctgtgggttttctgtatactctgctgactatcccttttgctgtgcaaaagctctttagtttaattaactcccagttatttatccttgtttttattgcatttgcatttgggttcttggtcatgaaatccttgcctacaccaaggtttacaagggttttttcaatgttatcgtctagaatttttattgtttcaggactttaagtccttgattcatctcaagttgatttttgtataggtgagagatgaggatccagtttcattctcctacatctggcttgccaattatcccagcaccatttgttgaatagggtttcctttctccactttatgtttctgtttgctttgttgaagatcagttggctgtaagtgtttgagtttatttctgggttctctattcttttccactggtctatgtgcctatttctatatcggtaccatactgttttgatggctctggccttatagtatagtttgaagtcaggtaatgtgatacctccagatttgttcttttttgcgtagtcttgctttggctatgcgggctcttttttggttttatatgaatttcaggattgttttttccagttctgtaaagagtgatggtggtattttgatgggaattgcattgaatttttagattgcttttggcaatatggtcatttttacaatattgattccacccatccacgagcatgggatgtgtttccatttgtttgtgttgtctatgattttttcagcagtgttttctagtttttcttgtagaggtatttcacttccttggttaggtatattcctaagcattttattttattttattttgcagctgttgtaaaaggggttgagttcttgacttgattctcagcttggttgctgttggtgtataggagagctactgatttgcgtacattaattttgtgtctggaaacgttactgaattcttttatcagatctaggagctttctggagaagtctttagggttttctaagtaaaccatcatatcatcagcaaacagcaacggtttaacttcctctttaccgatttagatgccctttatttctttctcttgtctaattgctctggctaggacttccagcactatgttgaagagaagtggggagagtgggcattcttgtcttgttccggttctcagagggaatgctttcaacttttcctcattcagtattatgttggctgtgggtttgtcatagatggcttttattacattgagatatgtcccttgtatgccaattttgctaagagttttaatcataaagcaatgctggattttgtcaaatgctttttctgcatctattgagatgatcatgtgatttttgtttttaatcctttttgtgtcgtgtaccacatttattgacttgtgtatgttaaaccgttcctgcatcccttgtgtatgacttgtgtgaaacccatgatcaagtgggtttcatattgacttttgtatgaaacccacttgaccatggtggattatcttttagatctgttgttggatttggttagctagtattttgttaaggatttttgcatctatgttcatcagggatattggtctgtagttttttttttttttttaattatgtccttttctggttttggtattacggtgacactggcttcatagaatgatttagggaggattccctctttctctatcttgtggaatagtgtcaataggattggtaccaattcttctgaatatctgatagtattctgctgtgaatctgtctggtcctggacttttttttactggtaattttttaaattaccatttcaatcttgctgcttgttattggtctgttcagggtatctaattcttcctgacttaaggtaggagggttgtatctttcaggaatttatccatctcctctaggttttctactttatacacgtaaaggtgttcatagtatccttgaatgatctttcatatttctgtggtgtcagttgtaatatctcctgttttgtttctaattgagcttatttggattttctgtcttcttttcttggttaatcttgctaatggtctaccaattttatttatcttttcaaagaaccagctttttgtttcatttgtcttttgttttgtattttttttgtttcaatttcatttagttctgctctgatcttggttatttcctttcttctgctgggtttgggtttggtttgttcttgtttctctagttccttgtggtgtgagcttaggttgtctgtttgtgctctttcagactttttgatataggcatttagggctgtgaactttcctcttagcactgcctttgctgtatcccagaggttttgataggttgtgtcactattgttgtttagttcaaagaatttttaaattttcatcttgatttcatttttgacccaatggtcattcaggagcaggttatttaatttccatgtatttgcatggttttgaaggttgcttttggggttgacttccagttttattccattgtgctctgagagagtgcctgatataatttcaattttcttaaatttgttgaggctcgttttgtggcctatcatatggtttatcttgaagaaagttccatgcagtgatgactagaatgtatattctgtggttgttgggtagaatgttctgtaaatatctgttaagtccatttgttccatggtatagtttaaatccattgtttctttgttgactttctgtcttgatgacctgtctagtgctgtcagtggagtattgaattcccccactattatcatattgctgtccatttcatttcttaggtctattagtaattgttttataaatttggaagctccagttttaggtgcatatatatttaaaattgtgatattttcctcttggacaaggccttttatcattatataatgtccctctttgtctttttcaactgccgttgttttaaagtttgttttgtctgatataagaatagctacttctgttagcttttggtgtccatttgcatggaatgtctttttccacccctttaccttaagcttatgtgagtccttacatgttaggggagtcttttgaacacagcagatacttggttggtgaattcttatccattctgcaattctgtatcttttaagtggagcatttaggccatgtacattcaacattagtattgagatgtgaggtaccattccattcttcgtgctatttgttgcctttataccttttttttcaattatatttttgttttataggtcctatgagatgtatgccttaaagaggttctgtttgatgtgcttccaggatttatttcaaattttagagctcttttagcagtttttgtaatgctggcttggtagtggcaaattctgtcagcatttgtttgtctgaaaaagactgtatgtttccttcatttacaaagcttagtttcactggatacaaaattcttggctgataattgttttgtttaaggaggctgaaggtaggaccccaatcccttctagcttgtagggtttctgctgagaaatctgctgctaatctgataggttttcctttataggttgcctggtgcttctgtctcacagctcttaagattcttttctttgtcttaactttagataacctgatgacaatgtgcctaggtgattgtctttttgcaatgaacttcccaggtgttctttgagcttcttgtatttggatgtctaggtctctagcaaggatggggaagttttctttgattattccccaaaatatgttctccaaacttttagatttctcttcttcctcaggaatgctaattattcttaggtttggtcatttaacataatctgagacttcttggaggcattgttcgtattttctctctctcttttcttttttaaattttactttaagttctgggatacatgtgcagaacatgcaggtttgtcacataggtatacatgtgccatggtggtttgctgcacctatcaaccaatcatctaggttttaagcccccacatgcattaggtatttgtcctaatgctctccctccccttgccccccaactccccaacaggcccctgtgtgtgatgttcccctccctgtgtccatgtgtctcattgttcatctcccacttatgagtgagaacatgcagtgtttggttttctgttcctgtgttagttttctgagaatgatggtttcctgcttcatccatgtccctgtaaaggacatgaactcattcttttttatggctgcatagtattccatggtgtatgtgtgccacattttctttatccaatctactgttgatgggcatttgggttggttccaagtctttgctattgtaaataacgctgcaataaacatacatgtgcatgtgtatttacggtagaatgatttataatcctttgggtatatatccagtaaagggattgctgggtcaaatggtatttctggttctagatccttgaggaatcaccacactgtcttccacaatggttgaactactttacactcccaccaacagtgtaaaagcattcctgtttctccacatcctcaccagcatctgttgtttcctaactttttaatgattgccattcttactggcatgagacggtatctcactgtggttttgatttgcatttctctaatgaccagtgatgatgagctttttttcatatgtttgttggccacataaatgtcttcttttgagaagtgtctgttcacatccttagcacactttttgaggcagttttttttttgtaaatttgtttaagctccttgtagattctggatgttagccctttgtcagatggatagattgcaaacatgttctcctattctgtaggttgcctgctcactctgatgatagtttcttttgctttgcagaagctctttagtttaattagattacatttgtcaattttggcttttgttgcaattgcttttggtgttttagtcatgaagtttttgccatgcctatgtcctgaatggtattgcctaggttttcttctagggtttttatggttttaggttttacatttaagtctttaatccatctcgagttaatttttgtataaggtgtaaggaaggagtccagtttctgttttctgcatatggctagccagttttcccagcttattctttttactttgtctttgttggcttgggttaattcgaaaactttgtctttgagctctaaagttctttcttctgcttgtttgattctattgctgagactttccagggcattttgcatttctataagtgcatccattgtttcctgaagtttttattgttttttaattatgctatctatttcattgaaaatttctcccctcatttcttgtatcattttttttttttacttccttaaattgggcttcacctttctctggtgcctccctgattagcttaataactaagcttctgaattcttttgcaggtaaatcagggatttcttcttgtttcgaatccattgctggtgagctagtgtgatttcttggcggtgttaaagaaccttgttttgttttgtcatattaccagagttgtttttctgtttccttctcatttgggtaggctctgtcagagggaaggtctagggctcaaggctgttgttcagattcttttgtcccacagggcgttcctttgatgtagtactctctccctttttctcaggatgtggcttcctgagagctgagctgtagtgattgttatctcttctggatctagctacccagcaagtctaccaggcttcgggctggtactgggggttgtctgcacagagtcttgtgatgtgaaccatttgtgggtttctcagctgtggataccagcacagtatttggggtgtctcctgcgtcctgcaggagcaatccgtttccttcagagggtctgtgggttctgttagctttcctgatttattcctgcagttgttctggagcaaaagttcatgatgcaagactctatatgctgctctgcccatccgagtgggaggggaaatctagtcctgccttccgtctgccatgatttcctccttctgaagccagagtatcattttctaaattgggacttggtttcaccagcatgggtatacaaatggaggcaatttaagagtagcaattatatgtactgcctaatttgtacaatgtaccatgccaggtactttctatatgctacttctgattctcacaacaaccttatgggttagatttatttctatttacatatatggagactgaagctccaagaggtaaaaagaactcaaaactatacactagtcagaagctgggattccaacccatgtctgttgggctccacagtcttttctactatatgtctcagtgcccctccagcatgaaagaccattttatgtgaagacttaccaagctgaaacatttggacttggaagatttaatacgcaatcactgttctcagagatctttcagtctagctagaaaggcaaacaacttcattgctactgtcatcactttgcaaacatttctataacgctataatttacaaagggtgctctcattcttttggtatttcaggaagtattgtagagctggacttaactgacagaaattgaagtacatgcacctggataatggagatacttacgaaggagcaatcattaactgtgattgtgtgggagatgcagaggagatgtctcaggaattgaatcttgatgaatgaggaggatttctataggcagaagggtgctctgggcagaaacagccacattatgaatggtaaacacccatgctgcagcctcatcgccctctaatccaccccacttcctgcagtcagagtgagctttctaaaacacaagactgttgcttcctggcttaaaagattttcgtggttccattaccctgggatatagtcccaactccctgcgatggtttgggaggctgcacagtctgggtgaaatactgttctcacatttccacctctttcttatttcccaccctacagtgatttgtttccttgaatataccaacccttctctcaccttggggcttttattcagacttttcttgacttgactatccttcctttcactgaccacttgcttttcttgctaatgctttttcattccttcaagattcagttagttgcctcctcggtggtctgtggatacaccttgcttgcctctgtcataactgccatccacctcattgagacagcctctcctatgtgactcccacatcacccagacagtaaacaacttgagggcaaggactgtgtcttattcattacatacagagcatttagcatattgtgaatgatcaataaatatctgttgaatgaataaatgagaatattcccatttactaaggatgctgacctgcccttagggatatatcaagccgggtttcatggtgaatgcataagaaggactgtagagaaagcagtatattaaaaatgcatgactcaggatattactacaaaccaatttgtgtctcccatgttgctatacatttatttaataggactaattcttcccctaccactggattaaaaaaaatgtgcagtcccatgacttttctagtaatccttaagttatacaaaccatctcaatttactaattagaaaatcagcagtcaagtctgagcttccctgatgacttgctagcctagcccctcctgtttaattccccgctgttactctctatgataagtatccattacttttcaccttgagtattgcagtacctcttcactggcctccaagtttgtctctctgattttctaaaggacagctgaagttctttctgcagaaattttcagtggctcccaatcacctaaagagtcaaatccaaattcttaactttacattcaagattctccatgatctgactccagccctttctccagttttatcctcatcaaccttataagtctatgctgccattaaatttcccagtgttccctgaacatgcctttgctcatgctcttctatcagcctggatgcctgaccctcttctttgcctaacaagactgactccatcctacgggctgtggctcaaacactcttctctgtgaggccttccccagctcttcagttagaattactaaatcctttctcagtattcccatagctgcagtaggacttttaaaaagcccagtgctttccacctcaatgaaacacataattattaaatgcccaattgtaggcaatgcatcagctgttggctactgtgatacaggagttttatgggggttgttttaacaggaatttaagatctgtagattagtgaaccatgagggcctctagaagaaataggaagtaactcctcacctctttattgtgaggtggtgagggatatattacagaaataaataaggattcttcccagcgtagtctctttaaaaaagaaacatggaaatggccaaatgtctgtcaaaaacgaatggataaatttgtttttctgtaaagtcatacaatctactttacagtaatgaaaatggttgatgccacctacacacatcaatatggatgagtctcaaaaacacattattaaacaaaataaaattactcacagaagaatacatcaatatgatttcaggtgtgatgtaaagttcaaaaataggcaaaaatatatcctttgtatacacatagaaagtacaagttgaagagaaaaagggaatgatgaacacagggttcaggatggtgaccacctgtgggtggagaggggcagtccatgaggtggggcagaactgatgaactacaatgagacatcatcatcacccagaatctacagtttaacttagggggtcactcttggcattgacattctacggattttgataaatgtataatgacatgtatccaccattagagtatcatacagaatagtttcactgccctaaaaatcctctgtgctccatttattcatttgaccctccccctcctaaccctggcaaccactggcctttttactgtattcatggttttgcctttttcataatgtcatctagttggaatcgtacaggatgtagccttttcagactggctttgttcacttagcaatatgcatttagagttcctccatgtctttgccatctttgtaactattctgaatcatctgaaatgtgtcttttataagcagcattttttcccttcagtctaatgatctacgtatttcattgaaatatttattatgtttacatttactgcatttgcagatatgtttaggtgtacaactatcattttgccacacctttctacttatacccgttccatgttcctttctcctctcctttcttgccttcttttgagttatttgtttttattattcagttctttcctctttgtaaataagtttcttacacattattttactaattttaatggttagtctagagattgcaacaagcattactgacctattaatgtctaatataaattaatatttttaccatttcctgtacgaaataaggacattattttttatgctttatttttttaatataacagtcttaaaacacataggcaaatgattaaaaattgaagtacacatattctactgagggtaagcattcaatacattggctgataatggcaataaatactaaagtgtaaacatgaaaacgagtaactgcccatgtaaaggcaagttacctgctcactcactgttaatcaaactctagttttcttcaagttatgcccaaattctttcctaatagaaagcagaaatgtattaattcatcggatatttacttatatgcccgctgtgttttacattgttcttggcactgcagataccagtgttaacgatatggacatgatacaaacaatgtaaagtaattacgatggtgccttgagtttcataagcaccaacaacagttatattacccttattactgctactacacatacttagcctgaaagccttgaaactttgaagcagtttagcaccaaattccctcaagacagctttttccacctttgaaggtttatctctgtaatagtatgttagtcagattaagttgtttaattctacaggatcacaaccccgagagttttagtagctttaaacgagaatctttttcttgttcatatacagtcttctttgactctgagcttcttttcagtatgcctgtcctccatatgcaggctcaggacttcaggcattttgtacttgtcacactttatgtcaaagcttgctcctacaatcaccactgcagaggaagtatagctggagagtcttcaatcacattttgttggctaaagcaagttatttggacccttctaacatcaagagggctggataagagcaattttcctatcagtctggaaggaatcatgctacagtttgaatgtgttccctaaagttcatgttttgggaacagaatcccccgtgcaacagtgctgggaagtagggcctagtaagaagtgattgagtcagaagggtctgccctcatgaatggattaatgtcattatctcataaatgggttagttattgagagaccaggtttgttataaaataaagttcagcccccccttgctttctgccctgtcttcctcttccatcttcggccatgggctggcacagcatgaaggctgtcaccagatgctggtggtgccatgctcttggacttcccaacctccaaaactgtgagcccagtaaacttctattgtttataaatttcccagtctcaggtattctgtcatagtaacacaaaacagattaagacaagtgggtatcaaatactgatgaacgatggtgcagccatgggtaatctaattaaggtgcccattacaaagtgctctcacataccacccctacctccacttaggctctgaaccaccctacaaggaaattattgtttaatttatccagatgagagcgtacaccttgctcacccaaaatcattattactataagaagtagtgaaataatcaaatcctatgcttgacactagtaacattttattgcacctttcatatctcacataaaggaagaatcatgaacgtaatttatgctctgctttaaagctcccaaacattaacataatatgagtcatacatcttatacttaggaatgttcattaaagagcagccatctgattgctccaccacacatattgtacactttattatataaaggaacattattcgactgctttatcagtgcttacactcctaatttcttcttgtaaaagttttaaaatgctgagaactgcaacttgccttaataatttccattgtactttctttcctagttgaactaaacactggacaacagcatggtaggatgagtgacagtcccccctaaaagtccatgccttaattccagatacctatgagtatgttgccttatgtagcaaaagaaactttgtagatatgagcagtttaaggatctttagttggggtgtttatactcaattatgtgagtgggcccaaagtaatcacaagggtctttgtaaaagggagagaagagagtcacagtcagaaaagggaggtagaagaacagaggcagaggttggagcagtgctctctgtagatgtagtaaaggaccatgagccaaagaatgcaggagacctctagaagctggaaaagtcaaggaaatagagtctcctctggagcctccagaaaaaacgcatcccagccaacaccttgattttagccccataagactccacttcaaacttcagacctccagaactgctagatagtatatatttattgtttttgccaccaactttgtgataatttaatatagcaacaatagaaacaaatactttaggtaatcagaaatgcagcatcctggagttatgcctcatcctcagctctcctcaagagattgcttagttcttctccccatactggtcttcttcaaatttcattattgattcccttgcatcattattagtccctcctctcttttttattacctattacaacacagcttggggataaaaagtatttttgattcatgttagatataattgtaagatgcttcctctaatccattttaaagtagatagggtgtaaattttacataaaaggaaggagaaagaaagaaaagaagtcacatgggcttgggaatcagagtggagcttgaatacaagcaccactgggtattagcagtgtgtacttgggtgttatgggatgaatgtttgtgtttctccaaaattcacatgttgaagccctaatccctaatgtagtggtatttggagatgtggcatttgggaggttattagggttagattaagtcatgacagaaggatcctcattatgtctttataaaaagtgaagaagacagatctctctctctaccatgtgaaaacaaagcaagggagcagccatctgtaaatcaggaagagggccctcagcagataccaaatctacaggcatcttgatcttggacttcccagcctccagagctgtgagaaataaatgtgtgttgtttaagccactcattctacagtattttgttatagcagtccaaactgactaagacgttgagcaagtagcttaatctctctattcgttttttaatacataaacttgaaaataatgcttttgttctcaaagggctggtgtaaaaattagatgatgtatagagaaacagcactcatatagagaaaagcttaacatgttgcttggtgttatatggtaaattgtgtcctccaaccctacaatttatatgttgaagtcctaactgctagcatctcagaccatgactgtatttggagataaggtctttaaagaagtaattaagatctctgaattaggttggaccctaatccaatatgactggtgtccatatacgaaggggaggttatgacacagaaatacagagggaagatcacgtgaagacatagggaaaagaaacatctacaagccaaggagagaaccctcagaagagaccaaccctgccaacaccttgatcttgggcttctagcctccacaattgtaagaaaataaatttatgttttttaaaccacccagttggtacattgttatggcagcactagtaaaccagtacacctggaatctgctagacaagtactaaaataaaatgtaaactattaattttgattattttgtcagtagcctccacttccactgcattacaaccatctacttctgggcttgccactatttgaaaccacttcacctatgaaattttaaagtaggagaatccctttttctgatcacaagatgtaacccctctatcccttttaaactactggtcttgtagtctgtcctctttgagagaactcaatctcatcacaagatgggaggatcttgtggtgtgtcaacagtgtgtcagtactggcctggattcatctcattccctccccaccttggacctaatggcaaggaaattttgtattttcaccattcattccatttactctcccattctccttaccctacccctcataattggtcccctgctctggagatataatttgctttttttgattctattctcaaattattgtgtgaatggccaagaaaattttacagccttgtatcttggtgccacatctgcttaatgagtgtagagaatgcaacaaatgctgttttaggcttggctttcacaaccatcctatgtgacaattactctcattttatagttaagaataatctctactgcttaatgagtacaataactcttcaacattatcaataggttcttggaaacttcaactttaagcaaaacaacatacagtaggttcttgaataatgttgtttctttcaatgtctatataaagtcgattacttgtgcaatttggtgccctatgttaggatcaacatatctgtgattctcttaatcgttcccacccttgttatacaatggttataagatggctgctgaagcatccatgttcatgttaataagagaaaactttcgcctaacactatctatttcatggtctcacttcctttagtctactattttttttttttttgagatggaatcttgctctgtcactcaggctggagtgtagtggcacgatctcagctcactgcaatctccacctcctgggttcaagtgattctcctgcctcagcctcccaagtagctgggattacaggtgcgtgccactacgccagactaatttttatatttttagtagagacgtggtttctccatgatggccaggctggtctcgaactccttacctcaagtgatccacccaccttggcctcccgaagtgctgggattataggcgtgagccaccgcacccagccctccttagtctactcttaaatgctgggggtttcctctggctctatccttggttattttctgttcttgccacacacacacatacacacactccatgtatgatctcatcccatggcttgtatgaccagccacaccgtgctaatgattaggcagtctctttctctggctttatcctcttccctgagctccagttcttaatctctgcttaaatattcatggggccattcagagggaacatgatcaaaacaagattctttctctttcccttaagacacgtgtcctcctctcatactcttaattaatgacattgtcatcgtctcatcctcctatgctagaccctcccaaggtctctcttcagaaacctcactctgcctgccctttactctcaccaatgtctaacaagtcatcaaatcctgtcaggtctcctttagatagcgaggttcttctgccttctccccactgctctacttgaggtcaggtccttatcagcttgtctctccccggaagccttctctcccctccacttgggggagaggtgctctgcgggggcagtgccagcagagtggccaagtgtgaagctggagcctgagagcccaagctcttatcctggtgtgccacacaaccttgggcaagttgtttaacctcttgtgcctgagttttctcatctgagaaatggggataataatattacctgcttctttgggctattattgtgaagaataaatgaattaatgcatccaacgtattttgaagagtgcctggctcaaatgctgtgttaccgtgattgccattgaaaaccaggcatgtttacaaagtgcttagcctagtgctgaggttttagtgagtactcagcaaaggttaatattattattaatatttttatctgtgccctttcttctacctctacatttaagatcctttttaaatgcttccaactgtattttataatttatctcttaacatctgtctccctcactagactgtgtacttcccccaggcagaacacagaccaggtcttagccattgctatatgcacagcatttagcacatttgttagatgaataagtaggaatagcaaccaaggcttagctcctgatgggtgtaggcactcttgatggttaataagcaaactccttttaatctaattctgccttactctcaggcctcaaagctgatgttcctcctctgtgttttcatggcacactgtgcctaatttcttttattgtaaaatgattgcactttaaagtgattatctgtaacttgttgcctcccttaatagattgtcaatttctacagggcaggaagaatgtcttattcagcactatatgcccactgcacagcacagtaagtgacctgtgatactcaatttatatctgttgaataaatgcatgcatgaattaattctttcaatgctctgagataggaattaatattattgttcttttaacactggaggaaatccagaattaatgagataaaatacattccccaaagcacaggaagacaggttgaagacatatgaaatatggatattgaatttgtaagcatatacatgtagctgcatgtgacagagtcccaaagtaacagtggcttaaacaaggtagacattgagcagggcacagtggctcaagtctgtaatcccaacacttttggaggccgaggtgggaggatcacttaagcccaggggttcaagactggtctgggcaacatggcgaagccccatcactacaaaaaataaaaaattagccaagcatggtggtgcaagcctgtagtcccagctacttgggaggctgatgtgggaggatcgcttgagcctgggaggtggctgttgcagtgagctgagatcacaccactgcactccagcttgggtgacagacagagagcctgtctcaaaaaaacaaaaaacaaataaacaacaacaacaaaaaacaaataacaaaaaacaaggtagacatttacctctcatgtaaaagtctgagctggaatggcagctctgctccacaaaatcagcagcgaccctgctacctgctcttctgtggctttgccattcctgtggtgctgtcctgtttgcatggtcaccccatggctgcagttcaggcagtggggaagaagaatgaggaagaggcaagcatgcctctctccttgcagaacacaatttctggaacttagaaagttcaccctcacttctgcacacatggccgcacttaactataagggtggctgggaactgtcatctttatattggacagtcatgggcccagcttcaaattccattactttgaagaaggagagaaataatattggtaacaagtggtctctgctatggatattaatgctcccccttttctaggtagagaggggaggatggaaaggagagggaatgatattatcgttgtttttcttttttaaaatagctcaaccctttttcaacatgtcaatcaccatttaaaaaaggggagggaaggttactgctgtagattaaaagaaacttacgaactaaacgaccaaatgtagtcaccgtttttaatatcctgatttgaataaaataaccataaagaagacaattggagaatttgaaaataatagcatttcaaatgtgataacccactgaattatatcatactttgaatgagatagtttggctatttctttttagaaatgcatatttaagtacgcagggacaaaatgacatgatatctgggctttgctttaaaatatttcagcaaggctgggcgctgtggctcacgcctgtaatcccagcacttcgggaggccaaggcgggcggatcatgaggtcaggagattgagaccatcatggctaacacgtgaaaccccgtctgtactaaaaacaaaacacgaaaaattagccgggcgtggtggcacatgcctgtagtcccagctactcgggaggctgaggcaggagaatcgcttgaaacctccgcaggtttcactgagccgagatcgcgccactgcactccagcctggcgacagagcgaggctccgtttcaataaaataaaataaaatatttcagcaagagaaaggagtggggatagacaaaacaatgacatgattattgaattaccttactttgaggtatattaaaaatatttcacggtaagtttttttttttttcaactagctcggccttgttaatggagagatttcagtcgaaagatagaggtaataaatcaaggctttttctctaaagctccaggtccttgccgagctcagggaatggaggtaagaatcaatatctgtgtccttatgactaagcctctcaccaacggctcccctaggggcttggtttcttcttttagattacaatagcactgacattttagaaaagaaaaatagccccacaaaatacttaacatgctggacttgttgctggcacacgcccggagagaatggaggaaacgatggttgcaggctgtgtctctctagaagatagtctctccttttttccttagaatgtgaaaatcctctaaaacccagaagaaaaatgatactatctgcaaaatttgacccacagcaggtcatggctgctttttcttcttaaaggaatagctaaatgtaatcgatgtgtatttgtttctggggctgctctgtgctagttcacaatcagccagggtacaagggtaacatttgctgcccctccatctgttttcttgtagctaagaccagggcttggaagtttcagggcaggcacagccatgagagaaacaatttccatgctgagcagattacctgtaagtgcctctcagcctcagcagcagggctgattttcttcctcctgattacagtgttttggcttttagaggaaattagaaccaggaagtactatattctctgtgaaaatgataaaagcagttttttctgcctgtggcgctagaaatataatatggcaaaatgcttatgatgaatgaaatgaatgcggttgctcatgcatagaaacccatatgcccatgtaaaatcagcgatgtgtatgcatattaagacattacatttattttgacaaacactttttaaaaaaattttatttaccttttaagttccggggtactcgtgcaggtttgttacataggtgaacttgtgtcatgggggtttgttgtacagattatttcatcacacaggtattaagcctagtatccactagttattttcctgatcctctccctcctcctaccctcttccctccgttaggctccagtgtgtgttgttcccctctatgtgtccatgtgttctcatcattcagctcccacttataagtgagaacatgctggtatttggttttctgttactgcgttagtttgctaaggacaatggcctctagctccatcatgtccccgcaaaggacatgatctcgttctgttttatggctgcataatatattccatggtgtatatgtaccacattttctttatccagtctaccattaatgggcatttaggttgattccatgtctttcctactgtgaatagtgctgcagtgaacatacatgtgtgtgtgtctttataatagaacaatttatattccttttggtatatacccaatgatgaaattgctgggttgaatgatatttctgcttctatgtctttgaggaatcaccatgctgtcttccacaatggttgaactaatttacattctcaccaacagtgtataagcattcctttttctctgcaacctcactagcatctgttatgttttgactttttaataatagccattctggctagtgtgagatagtatcgcattgtagttatgatttgcattactctaatgatcagtgatgttgagtatgcttattggctgcataggtgtcttcttttgaaaagtgtctgttcatatcttttgcccgctttttaatggggttggacaaacacttcttgaatactaatttactctgagtgttgcctgaaatactgaggaagaaaacctgattcttattctcagggagctgaacatgtgctctcagttcttattcttcaaaggtcagtgccacagaatatcagaaaattcaagtttaccttttccctgagggacactctgtgcctcccccatccaagtctttattgccatatataacatcccttactggtaagtgcattgacaggcggttctggccaaggtcaaagaatcatctggaagaagattgccccaagtgtctttgacagaaggccaggcctgacagctgcttcttgaagaaagtgtttggttgatctaatacatactattcccttctctttgagatccacgtggcttactagcacttccatgtcattcagattttctacaataaagaaaaacattcgacctagtgtttcccagacttatttgacctcagaagccttgcccaaataactcttttatttgtgtttcatggaacatcctttgggcaatgtcaatccagaggcatcttgaaccattggaatttttggctctggtctgaattaaacagactaggaatgtgcccaaataggaactacttttgtcaccttctttgatttttgacttgcttaaggctaaaatctaagagactgaaaagcttataagatctttttaatgagtatcttgttatttagctttatccaagttaaaaatccatgcttaacttacctaaagctctgtttcaaagtgcattgaatgttagagttgagaaacttaaggcaggaccattcactgtattgcataattccttgcgcagcctgtgaggtggtttccaggcatgtattcataatgtgaacaatgttccctggctttgtgtgacacagacaacctgaagatttcctatacatcagaaggctgtgcccatgagtgaaaggaagctgattaatttacctttgaatcgctattgtgtaatacagtgtctattgcatagtaggaacttgataaatgaatgaatagattaagggatagtctagcttcaggtatcatgctcattcatttttttcttcagggaaaccaagaggttgatggggttcaggacacactgaaccacagaatatggtactttggcatattgaatattttaagctgaaggaatttgagaaacagcaggtgcaggaagaactctctgaccttcccctgaagcagccgtaagagcctcatgtgggagatgccctttcatgacttggaggaaaggagccttcttatctctgaagacagagggatactgagaggaatctgaatgaacaggccctgccaagtttgccccagtttactatacgtagctcatacctttgtcctatcacattcttccatgactgtcctctccatcaaacctagaatgtcaatgttcagttttaagctgttaaaagaaaatcttcagacaaatttaacagagtttaattgagcaactagttaaaactagttttaaaattgttggtaaaataggccaggcacagtggctcatgcccgtaatcccagtactttgggaggccgaggtgggtggatcagttgaggtcaggatttcaagaccggcctggccaacatggtgaaaccccgtctctacttaaaaaaaaaaaaaaaatacaaaaaattagccaggcgtggtggtgcacacttgtaatcccagctactagggaggccgagggaggagaatcacttgaacctgagggttgcggtgagccgagattgcaccactgcactccaacctgggtgacagaatgagactctgtctcaaaaaaaaaaaaaaaaggtaacataaaataggatatatgcatggagaaacctttaggccgaacttaacatatgtaaggaggtagttttgagctaaacttgatataacaatttccccattgtagatattaatgtcactctgtcaccatcacaaatggacttatatggtctcaactccctctgggtaataacagaacagtgggttttgtaaggtgggaacaaggaaacagaacaatagaaaaaactagttaatatcaggctacttcaggttacttttttataagagagcagaaaaaaacttccttattatgttgaaatcttctgttttcagagaaaacaaaactagtctgttttaggatctatctgcttccttaaaatttcgatttgattatatggcatttagcaagagtgactccattttgtttaggtctgctttgttagggcctaatgcatgaactcaatccaaaaaaatggcctgccataattttgtttaacaattccccccttttggtcaggttctcacctagatgtgggtgtgacagacttagggctttagcactactctcagttaccatcattttgagtttccagtcaacatgtcatttataggttacagggtccatccacaagatcatgtatttctttgagtttttgctgttccagtcaaaagagactatttggtattctatggatggctgcatggatacatttcaaacttttgagagaatacagcatatcagggagactaccattatgactatcaggaggataataacaatagtttggagtatgctccttagccagggtctccatgaaccaaaccaactaaagtcaaatagatcaaagaatgagccagataaaaagtttacttgttttaatcaagcagcttgtttgttaatctcctatacttgttttaatcaagcaacttgtttgttaatttcctacaactgagtctgcataatacctgatatattactcctccatgtacaacagaagtgttggcaactacacagatatttctctgtttggccagtagacaatctagagcaattttattatctactacaactttagcaagagaatttaaagaaatctgttgtgcaaccatagcctttgcagtagaatctgctctactgcatattatgagggataaatttctaaccattgcctcatttatatttattccaagccacggcaaaagggatcaaaaaatgatgcccactcagaaggacgaaggtctcctggaaatgttctctttaacttattatataggttaagaggagtggacaaatgttctgtctagctatgaaacaacaaaaataccattcaaattcctagcccacattggtccttcatctaccatccatcaagacataaggttgcccatgtataaggttgactctcaagtcctccacaaataaaagtgtaccccatgggcgtacacaaggtccccttttcagttcagttgctcataggggcagaagaaaggaaaaattaagagaggtaagagtttgatgatggcagagaaatcttgatctgggaaagctggccatatctaagatgccattgcttctggggagaaatgatttgttttactgtaagatttccaatgtgtttacagtttcaagagtctggaggggtccttctaagttgtgagattacagacccaaggtttgaggtcctgaagttttgctgcagtgtgggtggcaagggtggtcattttcttatgtcatttccagatgacccaatttctggattctagattgtgaaagatttgtccacggtcagtggatgatgaaaaacttcctctaccgggtgaaaatacactttggcataatacattaaagccatgtagcatttagttgtaacagaggttaggagagtgggagatatatgaggttctattattaggagcagaggccttccagtgactctttcataagtggtcaacttatcttttccactgcaggtagatctggttgtcatcaatctgcaatgcctttgaacaaggcaatccagttgatttagttagctctgccgaattttattgtatctgtaatacctcatttaactgtttaacaacttgttcaatgaaacaagtacctcaatcactggagatttctcccggaatgcttcataaagaaaacatttcctaataactttttagctactgtttagcattggccttcctgcatgggaaagcttctatacagttagaaaacatgcatcaaaaatggcaattgaatgaaattcctctataaatgttcaaatggaccatcatgtagcagaaaggtacctgaagttttgattgtgtgtcttctcaggattatgggtttgtcaaaccagacattggtcataaaccattttagctatttaaaacagtcatcacatcaatttttaaaaatataatttggatcattttatctctttcatgatgagccatagagttcagaacttttaataatggaagctttaagaactcaggaaggaccaggtggtcatgcaggctgtccctgagtccatactcaacattggatttctatcctcttaaataccaattttctttctccaattcaggtgcatagcactcttcattagatgggttatcataggtaatttgacttggaccacaaagttcattcaaattgcatatcaaaacaatttcagtaccagctaatttagcatgaaaatctggcaaagtattttcttggtgctcaattaattcttttcctgcttgagttaggagttttacaaaccaatcgttagagtttgaggattcttacccagtttgaatgataaaatcctacagttatcagaaacctgtagtcaagagtgcttgtcagggtcctttgtatatttttcataaaactccttgaagacacacactttagaattttacttacttacaaagagctttcagaaaatgcatcagaattaaggaattaactgtggaaataagacttaagacagtatagttaaaaacacaattgacaaggaacttgcttatttctatggccaacaataatttaacataataaccataattatgactgataacatataccatgtgttttttgtttgtttgtttgtttattttagagagagagagagagagagagagagatgcggtcttgctatgttgcccaggttagcctcaaaactcctggcctcaaatgatcctgtcaccttggcatcccaaagtataataaaacatttacataaatataactgaaatgttaaacatcatttcttattttatgttaaacatcatttcttattttacaatgcttcccatataatttgacatattaaataagttggtttattatctcttttggctgcttttggggccctttggaacaccctaaagttagtttaaggtaaaaaaagacaattttaaagtttgaaacatgattttgggaagcctatcaagaatgtcaagggtttagaacaatcagaataggattacaggtcactagagtcactagagtaaagtaatagtcattcatttagccaaagttataattaaaaggtttttaagaagcaaacatttttactctttaagaggaaactcagttttccaatcaaaagatctaagaaagacaatatgagaatctgtctctccttctctcctttttttatttttatttttgcagtttgcttaaaaggtgaacaaaaatcttttactgtcatgttaataccacacaaaaatcttgttcaaaagagaaaaccaaattttacttttgtattagtgtattatcaataccaaagctaatttaaataatactttataaaattcattctatcttagtcaacttttgaccacacaagatttccataaacttttaataacctcttacaatttttttgtattctttcttttcatacctttctatgttcatttagttttatctatataatttttattctttcaataggaagcaacctttaaataacttctaaactagacaaatttttttcccaaatgtacatttttatgcctttataactttcataatcaaaaacatatctcgcttttcttatataccttgcatatagaattatttcttttagtttagtagttttaattacatgtgttaatttgaattttaactcttagtaaccccagtttctagtgacaagctgggaggtaattttgaactgtttaatatgactatttgtagatgaaaatcatttaataattctttagaaagatgtttccccaattttttcattattaatagatctaaatatatttatcttttctatagcatttaaaaataagatgtcaaagtacataaatgtaaacttacatttaataaacaatgtttcactattttaggttacttagaaattactcagacatcttatgattatctgttacttaatttaacatgactttaagataaattactgaaaagaattttgaaactatgacacagttaccatccctaatatcctcccctgttggcctgccacatggcacctaggattgctgcgaaggacagggctcatctggatcctaaatttacacaccacatatagagcaccagacagaggacagaactgtgtagaggatgcctggaggatttgactcctctctgcatggacaggaggcatagctgtgtcagggaggatggaaccatatcgggtttggctctcccgtgcccaggtgctgtggcgacacatatgaacccaggcttcaccacggctctctagaccccagaattgaattagaggacacccgggattttactgggactatctaggatccagaaggcatgaatcatttttctgtttctgcactcccaccctgcagctttccaggaggcacagactaggtccatatctctctgtggctctgacacattgagctccttttgttctaggagccatagacctctctgccctcctcttcttccacccagcctgggctgtctctttgtgaaccggaggagagccttctcccttcgtattctctaggacaaattggctatcctggggagattttagggtgattctggcttcagtcctgccaaattcttccccagaggcaactagcacatacctactgtaatgtcaagatatagagaagttatatgtgatagattaagacatcaaaattgcaccccagttgcacaagaattgaggtatgagcaaaaagagaatgtcctttattttaaaaaacttaacacacaacaaaaaaaagcagctgctgtctcctctctcacatggaagtaaactctgctggccccagtcactctgtggtgatactgccattggatgcgtagcatgaataactggctcattcagcatttcttccccaccacttcatttctttatcctcaagagggtcattttccctcttgttgctttttttttttttcctgccattcattgcttttgaaccagtttgcttcatctcaagccatctcattctcacatgaacacacacatcttacccaggttcttttctgcctctaacctaattataccacaaaaattctttctctggacttgtcatgaacttaaaagtggccctaattataaatgatgggcataaggatgctctaatgacatacttcaagctaggaaaaagagagccattaagtgtgtggggaaaatgaagatattagactaacagtcatcacttgcaaagtcctccaaagtcctcagaagcctccttcagaatctttggaaaagtttctcttctacctcttcatctttctctgattgcaactgtccttcctcaagtagcattatacaagataagtaaatccaaatacccataccattttatctctgggaaggactttagagatattttatgctgagcaaactaagactcagagaagcaaagttatttgccaaagatcacatggctagccgatgttagaggatttgtacaaggcctccttcctctgcactgagtgctcattctaaaatttcatgttttcttcttatacttggatgcttaattgttgagtctgatttaattatactggcggctaatcgaatgcatccattcattcagttaatattaactgagcctctacaatgtgctagacactgttttaggcattggaggttcagaggtgaacagggtagacacagctcctgctcttgctgagctgacatacttttgggaaaaacacaaagaaaaacaactaatcaatgcagtgtataccatgaaaattgacagattgataatggaaatactcaatagtacttactgaggacaagcctctcaagtaaatgaaatttacttggcagtattttggccagatttagggttaagggatgtttgtgggctactctaaggataatacaaaaatgtattctgagttgcaaagaagaaacttagaaaatgttgggacatagtttattttataaggtaaaaatgaagcttgtttcctgatatattccttatgaggatttgaccacaggcatgacacagaaagaagagtcaataatgtagacgataacctgaaattcacaagagaatatactgtcaacattccttcaggtgtctacacacacagacacagactagcaacatagcagaattcaaaaagtattttcaaaaatcaatacatggagaaatttccataaaatttcaaatatcaataggtaaaagaaccatgagagaaatatttaccctatctttttactaaaaaggcaagactgggctacacactgtggctcgtgcctataatcccagcactttgggaagccaaggcaggaggatcacttgagcccaggagtttgagaccagtctaggaaatatagcaagaccccatcaccacacacacacacacacacacacacacacacacacacaaaaaggccaggcgtggtggctcacacctgtaatcccaaaactttgggaggccatggcaggcggatcacctgaggtcgggagtttgagaccagcctgaccaacatggagaaaccccatcctactaaaaatacaaaattagccgggcatggtggttcatgcctgtaatcccagctactcgggaggctgaggcaggagaattgtttgaacccgggaggtggaggttgcagtaagccgagatcgtgccattgcactccagcctgggcaacaagagcaaagctccatctcaaataaaataaaataaaataaaataaaataaaataaaataaaataaagtaaagtaaagtaaagtaaagtaaaataaaataaaataaataaaataaaataaatccaggtgtggtggtatgtgcctgtagttccagttactcggaggctgaggtgggaggattgcttagcacaggagttcaaggctgctgtgagctatgatcatgccattgcattccatcctggaggacagagcaagatgctgtctcaaaaaaagaaaggaagaaagaaaagcaagaaaggaagacagaaagcaagcaatcaagcaagcaagaaagaaagagagaaaggaagggagggagggaaggagggagggaggaaaggagaaaaggaaggaaggagaaaaaacaattgtttacagtggactattttcagttcattgcaagtataaagaaatacaatttatgtttgtatattaatttgtatcccacaaccttgctgaacttgctgattagttctagtggttttttagtgcattccttaggattttctatgtacaagatcatgtcatctgcaaatggcaattgttttacttctttctttccaatctgaatgcattttctttctttttctattgtactggcactgccagtacaatattgaatagaagaggtgcaagcaggtatctttgttttatccctgatcttagagagaaaacacgtagtctgtcactgtaagtatgttagtaggtgtgagttttttgtagttcctctttatcagggtgagaaaattatcttctatacgtacattgttgaatgttcctattataaaggaatgttgaattttgtcaagtcctttttctgtatctatagagatgatcatgtggttttatgttttattctattgagatgatgtattatattaattgattttcaaatattaaactaaccatgcattcctgggataaatcatacttgatcatgttgtataattatttttgcatattgctagattaggtatgcttgtattttgttgagaatattttacatccatattcataaacattggtccatagttttcctctgatgtctttgtctgattttggtgtcaaggtaatattgaccttactgaatgacttgaacgtatttttttttttgaaaagttgtgaagaattgatattaagtctctgagcatgtagtagacttcaagagttaagcaatctgtacctggactttttttgtgggtaactatgattactaattaatcttttcacttgttgtagtctcttcagattgtctatttcctctaaagtcagattcaatagtctatgttttctaggaatttgtcaatttcacctatgtcatctaatttattgggataacatttttcagagtattttataatcctttttatttctgtaatgttggcaataaagttatcacatttattgctgattctagtaattttaaccttcactcacgttttcttggtcagtctagctcaaggtttttatattttgttgatcttttcaaagaaccaactttttgttttatttactttattgtttttccattatctatttcattaatgctcactcttatccttataattttctttcttttgcgtgctttgggtttagtgtgccgttttttccccctgtgtcttaaggtgggaggataggttattgatttgagatctttcttctttcttgatatgggcatttctaaatataagtttccctctaggcatgactttagctgcatcccataaattttgatatgttgtgtcttcattttataaacactttatctccaagtgttttccaattttgcttttgatttcttctttgacccatttattaatttctacattttaaattcttttcccagattgctgttattgatttcttttttctctctttctttctttcttttttttttttttttgagatggagtttcactcttgttgcccaggctggagtgcaatggcgcgatctcgactcgctgcaacctctgcctcccaggttcaagcgattctcctgcatcagcctcctgagtagctgggattacaggaaactgtcacctcacccagctaatttttgtatttttagtagagatggggtttcaccacattggccaggctggtcttgaacttctgacctcaggtgatctgctcgcctcagactcctgaagtgctgggattacaggtgtgagccaccgtgcccagccgctgttgttgatttctaatttcattccactgtagtcaaagaatatattttctgttatatctatccctttaaatttattgaggtttttatggtctagtatatggtctatcctggaaaatattccatgcgtactgaagagagtgtatattctgctctctttggaagtgttctatcagtgtctgttagatgtagttcgtttacagtgttgtttgagttttctattttcttgttgatctctgtctagtttttctgttcattatttaaagtggagtattgaaattttcaaccattgttgaaatatctatttctccctttatttctgcaatttttacttcacgtattttggtgctctgttactaggtgcatatatgtttataattattttgtatttccgatggatccaatcttttatcactgaaaaaggtccctttttttctctaataatattttttaacatctgtcttgtctgatattagtatagtcacttcagctttattatggttgatggttgcataacgtcctttttcatccttttgctttcaacctatttgtgtatttgattctaaactgtttcctgtgaacaatagatagttaaaacatttttttaaatccagtctgacagtctcttccctttgaatggattgttttatctatttacattgatatgattggatttacatctgccattttactttttttatgtgtttttttttgcactaaatgaatattttttaatgtagcatttaaatttctttaatgatttgttttaccctgaaacctccgcctcccaggttcaagcgattctcgtgcctcagcctccagagtagctgggattacaggcgcacaacaccatgccaagctaatttttgtgtttttagtggagatggggttttaccatgttggccaggctggtctccaactcctgaccttaagtgatcctcccaccttggtctcccaaagtgctgggattacaggcatgagccaccacacccagcctgttttacttgttaaaagttatttcttagtggttgctctaggacttaacatatactatcttatcagaatcagcttcaggttcatactaacaatttcagtgagatacagatgttactcctatctagctctattcccctttctccctttttgtggcattatttttatacatattacatctataaatgtttaaactcaacaatacattgtaataattattactttatataactttatcttctaaagaagataaggaaggaaaactattgaatatttatagcttttgttatattaaccttcttatttatcatttctggttctcttaatttgttcttctggatggaagttatcatctgaagtaatttacttagctcagtgagcttaatggaaaccttcaggaaagttgtagaacataaaatgtataatatatgagcacttagaaaataaactgacatttgtggaacattatagattgtactaggggctttatacagtcatgctgcataacaacattttggtcaaggacagaccatatacacaatgatgatcccataaggttataatgaagctgaaaaatttccttcacctagtgacattgtagctgttgtaacgtcacagttcaatgccttacttacatgtttgtagtgatgctggtgtaaacagatcagatctactgtgtttccagtcatatcaaagtatagcacatacaattatgtatagtacatagtacttgataatgataatgactatgttactgctttatgtattttctatactattctttttaatcattattttagagtatattccttctacttgtatataaaaaagttaactgtaaagcagcatcagggtggtccttccagaagaaggccttgttatcataggaggtgacagctctgtgcattttattcccccctgaagaccttacagtgggacaaaatgtggagggggaagacagagattctgatgatcctgaccttgtgtaggcctaggctaacatgtgtgtttgtgtcttcatttttaacaaaaaagttcaaaaagttaaaaaaaataaaattttttaagtaaaaagcttatagaataaagatataaagaaagataatatttatgtatagttgtacaatgtttgtgttttaaaattaatgttattacaagagtcaaaaagtttaaaaaattaaaaatttataaagtaaaaagttatagtaggctacagttaattattgaagaaatagattttaaaaataaatgtagtgcagactaagtatacagtgtttataaattcagcagtagtgtccagtgatgtcctaggccttcacatccactcacagactcacccagagcaactttgagtcccgcaagatccattcatggtaaatgccctacacagttatatcatcttttatcttttttactgtatttttactgtaccttttctgtttagatacacaaatacttaccattgtgttataactgcttacagtattcagtacagtaatattctgtgtaggtttatggcctaggagcaaaaggctacaccatataagctaggtgtgtagtaggctacaccatctaggtttatgtaagtacactctgtgatgttcacacaatgacaaaatcaccttatgatgcatttcttagaatttatccctattgttaagtgatgcatgactgtatatgtttagcatgtaatcctaaaagtacttctaaatggctaactttaacttctgctagttagccatttaagatatgaggaaactaaagctttaagacttgatgcagctcttttctgatcatctgtactattacactttaccaaatatgttttaatctctctcacttctctgaaccagcatgtgctgattcttcctcctggaacttgctttgctgctgcagtcaaactctattgtccttcagaatggagctcaactgtcactccctggagaagcattccttgatctttcagtccatgtggaaaattgttaattgtctataatatttaggtcaaaagaaatatggaaagtaaaactgcattcagagtagctgctcgacaaatatttgtggaaccaatggcacatatcgtatatttaaagtgttggctcaactgtgtagttgttaagactctctgggttggaagtgattgaaatgcaactcaaaattgcttaagcaaaaaaggagagattattggatcttaagctcaaaaggtcaggggtggctggcttcatatggccacattttggttctcaaatgatgtatagttagttaaacctacctggaggcagatttcagctcaatgtaatgatgaattatttttaaccattagagagtcttaccaatgagaagtatgtggttataatagcaagagttttatttttgttttagtttgaagtacccccgaagctaaccctgagctgaggatttgggagccaatacagtagtctcttccatccaagggttcactttccacagcttcagttaccaggataactgtggtccataaatattgaggagaaaatttcagaaataaacaatcccaaattttaaatctcatactgtcttgtaatgtgagtaagccctcagtccagcatatccacactgtatacactacctccccttagtcacttaggaatcagcttggttatcagatagactttctcagtatcacagtgtttctattcaagtcacccttttttacttactaatgtccccaaagcacaagagttgtgatgatggcatattgttataattgtcttattagaagtaattgttgttaatctcttattgtgcctaattatagatatgtctgtataggaaaaaatacagtatatatagggtttggtactatttgcagtttcaggcatccactgggggtctcataacatatctccataagggaggactactgtagtttaggaggtaaagagggatcatggggagaagcatgaagaagagtgacagagaagcaacacagccaagaaagggcactttacaagccagccatcagtgtggatgactggtgcttagtcccagtggagaacctctgggaacagtgtaagccatacagctcaaggccatcccactcaagggtcgagggagcagggtctttacatactagccctgatagttagttgccaagggctgctcccagggagcatttgttccctggcatttcaggcctaccttcttggtgggaaggcaggctgcggcaggaggagaaaagcaaggaaatgcagatggtggtggttgggagttgggttggagtgcactgaaatggtaggggtgaggagatctgcttgaggggaggctctgacagcacctactgtacatttgttgagcactttatgatgtgccaggtgcttggcacacattatcctgtttgtttctcagtgcaacccaatcaagtaaatattattttactcatcttatacatgtagaaaccaaggcccccagaagataggtaacttatggtacagctaaaatgaggcaaggttcaaggtcaaacccaagtttgcctcattctatattacatgattattctataatgtcattgttgtagtcagggttctccagagagacacactgatggtatatatacagagataatatgaaaaggaatctgttaggggaattgactcatctgattacagaagctgagaaatcccatgatagactgtctgcgaactggaaaaccagaagagctggtacaggggttcagtccagactgaagacctcaaccagggaagttgagggtgtaactcttaatgagaggttgaagagcctggggtgggggggtgggagggtgtggtggggtggtgtgaatccttgagtccaaaggccagacaacctgaagttgtgatgcccaagggcaggaaaaaaaagggcatcctttctctgagagagagagaattcacccttcttctgctttcttgttctgtctgggcccccatatgattggatggtgcctgtccacattgaggttggctctttcccattcagtccactgactcacaagccgatctctggaaacaccctcggagacacacctggagctgtccaatcattctagtcaaaagcaaaaccacctgggcttccctttcagcagaagagggaagggctcattgcctactgaaacactgagaataatgaacacctcaccaggtatctgtgtatcccctaatccattcaggttgacaccacaaatcaaccatcagtgccaccgttgctgcctcttaagctgctaatactaagctgagagtacataacaaaccagcaggagtgttctagagggtttggggtttggggatatgaattcaacccccccacccaccaaccaccaacattaagcagccacaaaggagtggcatgaaggcagaatgtgggcagaaactggggagacaaacttcgtcctttgctgaagtgccagagagggtggcagaaagaagtgtgaccttgtttgtgagctgattataggtgtcagatcctggggtctgggtccagcccatgctgaagttcgagggagtgggtggatgggcagaaagaacacttgaggggccgtaggcagatgaaatgtagttttattcagcaactttctcatcaacagttttctcactagcagcttactttgacattgtttgccctgtctcggctgcttgagccggccgcccccacacacagctgcgtggctggctcacccctgccttcaggatcaccagcttaactctttctctctctgggcatgagcaagctgagctgtgtcctggctccttcctgtccttctgcaaggcggaaagctttggctctctctctttctctgggcgtcagtgcacccgtcatgttaagccatgttgagcagagccaagccccaaaagccccatgcacagtgtcagcaggacagttataccttttacagacaatagtgatgtagggccaagggatggccttcccatgttatggctacatggctgtggtaacaagtggagttatatgcctgcactctaaactcggtaagtcatacaggatatcaacatcctaccgtggcctatccttgaccaaagcaccgccatgctccttataaaaggtatatctgtctgctttagggctgttggatgccaggtcccagaggaacttttttctgagactgtgcttatggagcccaagaaggacaaggaggaaagtctgggctttagcaagacaggagtgaaggagcaatccccatggagaagggctaggtcccggaggcggcttagagaatggggtggaacatcatgcctgcctagcttatgaaggccccaaatgagaagggatagctattgtcaagggactaagtttctaggtttccctggacacacattcttgacaacagtttgttgggcataaagaagaccagcttcagacagacctacgcttccatctgagcttggttgtttacagctgcactaggttgaaagcatctgccttggaacctgcggatgtgaccttatttggaaatagggtccctacaggtgcatcaaattaagatgaggtcacacaggactagggtgtgccctgatccaatgaccggtgtccttagaaatgagggaaatttggacacagagatggtgctggggttggggggtgaccatgtgaagacagaggcagaggttggagttatgccactataaccaagatatacccaggattgctggcaactgtggacagttagaagggacaaggaaggattcttccctggatgtttctgagaggttggccctgctgacaccttgattttaaacttgtagcctccagaactgtgagaataaatttgaattgttttcagtagcccagtttgtggtatactgtttttctttttttcttaattgaaacaaatatactatgtgatgaaaatttctctgagcctcagtttcttcctttacaaactggagataaaagcggacacatgtaatagggttctctaaggcccctggttcaataaatgtgagttcccttcaaggagatgcagagggaaggggtgcctcacagtgagcctgcccatgaccctgtgctactctcagggctgtgtgaacagccagcagctcctgagaaaattagctgtggtctgctgatgtgaacatttttctcttttcactgctgtggctcccttctggctctttctttccagagaaagctgtctggggtcccaaattgctcctggaagccaggccggttttagctgatgctaaatggattgctgcccataggagagctgctgtctgatgtcagagacggctgggcactaattaaggggttactgtgtttacaggaagagggggaaataaatgtgaagactgcagtgcttcactgctgttttaatagggcagaggccaactatgacaccttttatctgagagggtggcagttcgggctgctcacagccactcaggtccctcaagtgtctgcggcaagcaaggcctgaggcccaagaggggtggtctctctcactttctctgttccctcagctcctcatcttttccccattttactttgttataggaggaggaaacaagaagtgagggaacgtctggctggttaaatagatacacttagaaagaagccacgtttccagtctttagcctggctgctcctgatcccctgcaatactgctgttgatatttggaactgataaatcagtttttctaaacaggtcctacgagactgcttggattttggagggacaggaaattaaagagccttgggggtgaggcagggtgggctatcagcctgctctcccacactgtccccttgccagacagcagctatgataggagaaagcaaatggagggacagaggagaaagcttgagcagatatttggccaaatatcatcgccaaagatccaggccggccccatccaggactgacaactgtgacacaggaactgattggccagagtttctagtttaaagctggctgcaaatcagaatctcatttctttctgccagactctcagccaggagcttaattagctagaagggtcaaaaggactgaacttccacactgtaatcctgacctatagttcctaactctggaagccttttggggtactccagccctggatatctaacaaagagcttcaggttcaaagggacatgggacaaggaggactgggaggcatgctgggggtgtgggaggtgccacccccagggaaaagcagctgccagcaggacacagtccttgcaaagggctctgactaggaaagcaacctggtggcttgtttacattcaactgaaatcagactaaaaaattaattgcagcaaggttcccaaaaatgtttctacttttttccatgaaggaggactgaaagctcagcaagaattaaaatggtatctcttatagctaccacttattaagtgctcttcacagctgcaagtctgcatacactttgtatattccttacaagaatcctgcaatgtatgtgtgattattcctactggatagatgaggaaactgagctcaaagatggtaattaaggtggtcaagagcacacaataagtacgtggaagagcctggaatcaaatttaatctttttctatgacccctatgctttctgctctctcagtgttctagttatctattgctgcataataagccacccccaaagtcggtggagtcagtcagcaaccattttattatgttcatgcttctgtggggaaggatttaggcagtgcactcatctctgcttcacaatgactggggccttagctggggtggccccaagaactaggagagctagctcaactagggccgtctgtcaagggcttcagttatactttctgctgagttcctccatttttcctcacattgcatctgctgatgtccaaagtggtaccctcacatatcaggtgcttggatttaaatggctggaacagcatctctttctctgtctaccaagcctctccacatggctagcttgggcttccacatatcaggagggtcttaggatagtcagactttttacatggtgactggctttccccagaccaaccaaaagagacagaaattagaagcttccagtttcttaactactgacaccagcaacaggcacagtatcacttttgctgtatcacattgaacaaatgagccacagagcctgtcagagtgatagcttgtcagactcacggccacagagcctgtcagattcccttagatgcgctgtgaacatcacctctgctctttaccaggcaccctgcaatgaaggagcttttcactcaaattacggtgttttgccgataatgataatgattcaattttgtctcaatttttagatttacaaatagcttccagctatttctctgatatgagcttcacaataggtctttaagacaagcagaacagattgtactaccctcactttaaggaaaccaagctttcaaacagcaaaaaggcccaccaggttatatggagggtaaactcccagcccacctgactccatgaagctcggctagctgcggttaagagctctctctgccgtacccctgctctgttaatgtgctctaatttgctgtatattattattctgcagctcttaagaaaactcatttccagagggctttcaaattaatagctctgttaataaaacatagggctagaaataactttatttcactgattttaatgatgaagaaagacgtgttttacttctactgaagttaaacatctatttttttagttgaagtaaaattcacatgacataaaattaaccacgttaaagtgtgcatttccgtggcatttagtacattcagagtgttgtgcaaccatcctctccatctagttccaaaacattctcatcatcccaaaggcccagtgttttacaaaacaaaatttatataatattcaccttctacttagaacaaaatgctttgtagataattattaatgtttggttctattaaaataaaataagctcagtctttggactcaggctaacttagatttaaatcacagctcttcagttttctaaccatgtgactttcagcaaggtatttagctaagcctggtttctcattcctcatacgaagaaataatgatgtctacttagatgggaaattgtggggaccagtgagataatggacttcaagcacctcttacagtgcctagttcttagtgtttgcttaagtgaaggtaggtgttattcatagtattaatgaccagaaatgtgttataggacctttggaaaaccatcatagccctctgggcctcagatccccaagtggaaactgaaagtatggccctaaacaacttctaagctctgatatttaagatgatgaaatatcttgcaggtttattctccattccaatgtttaaaaagcctcctgccaatttcctgttttccccacccctgacacacacacacacacacacacacacacaccacatacacacaaaaaatcctatttccatcctcattctgatgactttatttttaacagctttattgaagtatacttgacaacaaaaaactgcatgtattttacatatttgacatatgtataaacctataaaagcatcaccataattttgataatgaggatcttgctatccctgcaggtttcttgtgacccctttgtaatagtctctcccatctctccccactcctcagttaatagattgttgtgatgtgctcatatttgtcatttttgttgtccaacatttgcagagacatgggttccatagggcaggactatgtatattttgcttattgttgtatccctagcaactgtacaatacaagaaaacagaggttgctcaacaaatatttgttaaataaatgaataacccctctgttcctttacttttgatgcagtgatactttagcttttttctctgtctgctgtggtgatcaatgcctagacaggagggagctctaggggctggcatggttgggaaagtttcacaaagggagaaaattgctttgaggctctgatgatgaaaagggtttgttgaggaaggcaaagctaatggcttaagcacaggccaggaaggaatctgggaaagatgcaaaagtaaggattggatcagaggtaatatagtgactgacatagctgacaagtggcaaggattagacccctggaagtgagggaaactgaagcctttctgaaataggaaaacaaaaataaaaacaaagcaagagctgctggtaccttggctgggagtcataagatattagaattggcatggagattcaagattagacaaatacccttataatgcaaatggaaaagatgaagtccagagaagtgaaatgaatttctccaggtcccatagtagactagtgggagaatcaggaagaatccagtttcttattgcccactgggcttcattcattcatcttttaatgcttatttatttaattaattgattgagctctgacaatatgcaagtactatgctaggcactgggattacagagatcaaacatcgtttctgggctgggcatggtagctcatgcctggaatcccagcactttgggaggccgaggcaggcggatcacttgaggtcagaagttcgagacctgactagccaacatggtaaagctccagctctactaaaaatacaaaagttagccaggcttggcggcgcacacctgtaatcccagctacttgggaggctgaggcaggagaattgcttgaacttgggaggcggaggttgcagtgagccgagatcatgccactgcactccagcctgggccacagagtgagactccatctcaaaaacaacaacaacaacaaaactatatatagttcctttgaatgagctcatgatgtagtgaaaaaagggttaattatacactgtttaaaatacaatgcgattgataatcataggtagagcccaatgttttcgtgaggaaccatggattcaccaagaaggtcttctcagggagggatgtctgaactgtgttgcagggtgaataggaaggaacaacaagtagtagagagagaacatttagagcattagaaagagcacatgccaagaaacccaaaatacattggagaacttccactgattcaagatgatagcaggccgccgggtgtggtgtctcaagcctgtaatatcagcactttaggcgggcagatcatctgaggtcaggagtttgcgatcagcctggccaacctggtgaaaccctgtctctgctaaaatacaaaaaaaaaatagcttggtgtggtggcgggcacctgtaatcccaactactcaggaggctgaggcaggagaatcgctggaacccagcaggtggaggctgcagtcagccgagattgcctcattgcactccagcctggaggttgcagtgggccgagatcccgccactgcactccagcctgggtgacagagtgagactctgtctcaaaaaaaaaaaaaaaaaaaaaaaaagatgatgatggaggggaggctgagtacagtctagccatgaagggccctatacattaaggagtttgaccttttctcttaaagccatggaaaatctttgaaggattttgcttgagggctatgatgggatttgcctttaaggaagtttgctggttcaggagcatgaggaagagtggaggcagtcatgctggaagttgggggagagaggtggtggaatcatacctccatggaatgatctttctgaaatgcacatctgaccagtcacttccctgtttaaattttccagcagctccctgttctctataaaagccagtccaatctggggcttgacccacaagccatttcataatcctagcctcactgacttttctagaattttctactgcttcttacccatggcctccttccctatgcccccttatcctaagacccagctctactgctatttactgttctactaaagtaccaagactttttagtcttccatgcctttgcacttgctcttccctctttctagaatgatcacatctgtcttttctgctggcagaaccttcttattgccttctccaaggctccattcaagtgtcttctcccctgagaagccccttctgactgcgttaggaagatttcaccactgtttaggtaatgttcccatttaatctagtttctgtcttagtaaaaagcatttgcaatgctatagtgtaattgtgtacatgtcaacttattagattggaagcttcttgaggtcaaggatattttcatctctggaatccccaagcttcctgggctttacccccaggccagtgaatgggtctctggggtgcctaggcatctgaatttttaacaagtgcccctcaaatgattgaaggaagggaccaggacctgatgggtattataggaggacacccatataagatcctgactctccccgccccatctgaattctgtcccaccaaaattcatacattgaagtgtcaacctctgagtaccccagcatttgactatatttggataggacctttcaagaggtgattaagttgaaatgaaatctttagggtgggctccaattcaacctgacaggtgttcttataataagagaaaatgtggacacatacaaagagacaccagggttgcacccataaatgaaagaccatatgaggacacagtgagaaggcagccatgtgaaggccggggagaaaggccacagaaggaaccaaccctgccaacaatttgatcttggattttccagcctccagaactataggaaaagaaattgcagttgtttaaggtacccagtctgtggtactttatcatagcagccctggcgaactaatacaccattgcagctctgtcccacaggctggaatgcttgggatttgctctgtatctgctcaagacagtcattttctgatacacagtgggagttattagtttcctcaagatgtgttgcttataagggaattcgttttgagagacatatctaggactgctgggctgcagagagagtgagggtactttagccattcagtcatgcattttctcctcctccccagctacactcagaggatataaaaaaaccatctggcagatgagggccctggcggttaccatggtgaggcagagcagagccggggagactggggtatgtatcgctgtccctgacacttgagcccagtgaaatgtcagcctggcttgcgttcattttggataatatttttatctgactttttttcccccagctaagttatttaaaagacttgtgtaggtccagttctgatcactggatgttttcacctacagaaaaagctctttgagaataaggactaaatgccttcctattttattccctctttctggcgtcttgtctacccctcccgctatcccccacattccctgcagaattaaaccagtgtctattactgagttgatattcaagaagtatttgataggttgagttgaattaattaacctttggagaaactcttgttttcatgtttgcttctgatttttaaagccactgacaattaccttcactgggagtgtctagttaattcaagtggcaagttccagtatgtgatatatagctgccatcagggttgagacctgtgagcaaggtgcaggggtgccaggaatttagtacaagacaaaacctgagtgtcagggctctatactcagttggacttgggtttgaattctgggtctgttgtcaactccttatgtgacatggggacagagacttcatttccctggcctccttcattgtcttcaaaatggggatcctaatcatacctgcttcctggggtgcctgtgaggcttaatagagatagtgtgactaaagctttgtatctggcatcaatgagtggtccataaactatagccattattgtaatactattaaaagtttttatttcagttctgcccttaattctgtgaattttggtacttgtttcccaatctctaacatttctggaaatgttctgtctcagtaaggtaatgtctgggggcaggtgtggacagccacagacctctacctcctctcaggccatccataggttctcttcgataatcatagggtgtctgaggcttctagtggcagaaatgtctggggagggcgattggctgagcatggagaggtttccgagggtaggaacctgacagccaggagaggaccaactcagaccagcttggcccagactcaggaggctgcagccgccagcagggctgtgtagggagggtggcctcattggcatgcagtacccaggctctaggaagtatgagcccgtcagggggtagcgaacagcaacgggtgttgtggaaacagctggctttgccccactgtgattctagtccactttttctttccttccttttattctaaatcttaaagagaactaccatatgatccaacagtttcactactgggtaaataaccaaaggaaatgaaactagcatattgaagagatatctgcctcctcatgtctcttgcagcactattcacaatagccaagatatgaaatcaactgaaatgtccatcaacagcaatccttatcctgttttctccccttatgtttatttccaaaagagcaaaggcttgactgcagcttcgtgtaattgcttctaaatcataatggatctattttcctttttgccaagattgaaccatggtaaatttgtaatgatttacttacaaatagagccacaggattgattataattcaagctctttcattctttagctatgtggccttaagcaagttactaatttttgcattgtctgtgagccttgattttttcctgccaaacctcattcctccagtcttttgcatctccaaaaaaggtgccaccatcaatctatttgctcaagtaagaagcctaggtaccattttgaattcctttcttccttactccaactaccatccaattcactagcgattcttactgattccaccactgaaatacaggatatctcaaaaccatgtagttctcccgcctccaccatcacctggaagaggccaccagcatctcttgccttaactttaacaccctcctcaccagttgcttgctactgtctttgtccttcctccacttataatatgtctatctcaatgccagccagagtgatcttgttagaatgtaaattagactatggactgcctctgcttacaatccttcaacctttccactgcattcagaaaaaaatccaaactccttgtcacggtctatgtatctctgctgacctttgcagcttctttcttgtccattcccttctttgctttctacattcctggcatgtgagttgtctcacattttcccagatgtttctagtttctattgcctcagagtccttacacactccaattcctctgcctgcatcagtggaccatccacttttcacattcaagggtctttcttatacttcagggctctgcttaaaatttacctcccagaaagacctttctccatttcccccatgcaatccagagtagggccccttctcctcccccggcttttctctatatttgtgaccagttagtttcccttagagcacctatccccatttgtcatcgttctctgttgtttttttgtttgtgctttccagtggaatatgaccctaatgaactacagaccctgctgagtgcctactggaatgactgcaaatacataggaggtgtccagtaaaagaaaagaaaaggaaaggaaagaaaagaaaagcctcttagcttcctttccttaacctaacagatttaaaccttccctgccttcctttggttgagcttcaccacatacctttagacttgctttaaggaatacattcctgctaaagagattcattgaatttctaccatgtgtcaagcatggtgctaataaatgtgataaatctggaaggagaaggcattctggtatagcagagagaggagcttggcttaggagtctgaaagacccggatactgccagctcctctcaaccagcacaccactggtaaaatgttacttttcttggcctcatcccctcaaaaacaaaatccaaatcttagatgtcctgcttacaggtccccacaggaacattcccataccctaacatttatcatagtaagtaataatctgcttacccttctttattttctactaaactctcgaggattattcatcttgctcactatctccctcacccccttttacacatgctgtattggaaggcttaaaatttctggagctgccttgaaatctttgagcctcacagagtcctggaggcctaactttgtgtccccctcctcttgtcagatgtgccccttgccctgcacccagtagggaagattcttctatcagccagctcagttgcattaacctggccctcaacctaaaataacaggtttcacctccctaccagcccatggaattattcaaacaacaaagtacaccctcccacaggaatcaggggccacctcacccccttgtcacaacacagcctgcctcccaaagccctgtttgttcattctgttgagtataacccctgtgtggtcctgcagggtatgcagtgccttctaccccaggctgtcagtatatgtgactaatgaactgctgtcaatcgcatgggtccaacgtcaggtgttgtgtgcttggctattctcagagtcttagggcaacactccctctttcaccagcggggcaaagaggaggcaacaaaacactcatatcctcacatgcctgcactaacatacacacaacaagaagtatgatagtgatgtaggcaaaaaatagtaacccccataggtttgcagatgaaacagactcctgttacaaaaggcagcttaacaagagaaaaacaactagaagcttattaacattcatatgtcacatatatgtgagagatacccagagaatgagtagttcttgaagaagtggctttgaattccagcttaagtagcattttcaaaaaacagtacatttttagagaagtgacaagacaaaggaaaagggctttgaatctctacagctggcaatgtgcggaaaggtaaacaaatggcagataaaggctggtttgtaaagcttgttaatataaatccctccggtatcatttccaggtggtgaaggtctaaagctgtcttcagtggttaacctgtgttcaccctggtggagaggggacaaggtatcttttgcctttgtaaatctatgttttgcttttaagcaagtggagggagggcagagagctctatcatcctggaggaagcatctgacagactcctgccttgggatgacacactcttagccacagctttcaaagccctcctgagtcctcgacagacactgcaaattgatcatggtactctttcctgctgcacctggactttgccccagaatcattctccacttgctgaatgtagtcataagagataaagcctatttctcactcggccccaaacttcccgtgatcagtgtcctgtgatgaaggaaactctgcggcttataactacatttgtagcgctcagctctgcatcccactcccagtaccggggctcagatcatccaagcttcttactggagaagaatctcactctaggaaatttttaatgttttcaatgtcattggtcatacatctcaatttttccgtaccttaatggcttctttcacagactctcagcaatgccataccatctttctgttcctctgctggttctaaactgggttagactcacatggaaacaagcaaatataattgtaaattcataattatgtgatgtggtagagagaactcaaggtttacagtcaaggtagacttccctgcctcatccttgttgagctgtgtgactgcaggcaaatcatttgtacatctctatatcttggttttctcatttgccaagtgaggacaataataatatctgtcctcccaatatcatgtatcattacatatgtaacattaatataacatataatgttacaaagtagcataaatgaataacatttaaaaagttaaacctccaaggtgtttaaaagcagcatacgggtatttcttgccactgcaagaaaaaatctgccacttttctccagggtggctgaataaatagggcagcttttccagagaggcagccatagtagacattccattatgctactgcatattcaactagagtataaaatgtgagccctcagcctggaggtgttaatgagttgccacttagaaggaccagggaagcaaattaagtgcatatgcataaagcagtcagaactgccagccctccatgctgtctggaaactgagctgctcaggccctcatcctctgttcatctcatcccctgatttagcagctgtagttggtggaccaggttcatgtgaataagaccattggcttttctgcctccacttcccagaaccatctcactccagaccctgtctaaactagtgaagttgaacacatccagtacttgggctcatcatcagagagatggaggtgggttggtcaccaagaggtaggatgcccacttcattgttgctgaaaaacatgctttaaaagcttcctaagattaatgatagttacttttctcttttaagttattttttcctatatggtttctgttttctacaaattccctgtttcactgttgattagttttggtctgcatcatttaggtagagtctttcttcaagtatctgccaatcttgggctgtcagcatgtatttaagagaaggatattaaaaagccaaccagagacttgaaagagcatgagtggggctgggggcttcatggcagaagggtcacaatcagcaacatcagtatctctgtgtcttttctctttgactggttaggttactcaaagaaggctgttctttgagtctcccatccccagctccatatctagcctggagactgccagccttctgaggacctggtggagaagggaataaggagtccttagaattcaatatgtagattttcatcaaaccttactgtttccagtacattatccctgccctacacccagaatgggggctagatggccaccaatccagagtccatttggttcactgtctccagagagtcagtttctgtattctgtttcaaggaaaggggcacttgtcagctttgagaagcaatagaggttatccaggagtctaagtgcactgtaaatagatttccaaccgatcttgtggttttcagcccccacttctgtcccatctcctcacactttcacagatccctgatgctgccaattatggagtcctggatctctaaggtccctatcagcttgcttttggcctccctcactgctggctgaggattcaatgttctgaggttgctgagtcagttgccctttatccttttgtcttccagcttcaaagatttttttttttttgcttttttttccctctcatgttctcaaaggtttatacctttaaaagaaaatccctttcaaaatatttttaatgggactgaaggatcagaagaaagacacatgtgttcaatctaccatcattaaccaaaagagagaaaataccaacacaaaaaaaagacatagagcacatgtgacgtgtgtatcttggcaagatgctgctgccagggattcagagccaaaaggagagcccaggtttcttatatcacctgttttccttaatgcaatcccacaaagtagtactattttccatatttattaagaaggaacaagtaataataagaattagtattattgactctctagtatgaccagctgtatgtcttttagggcttccctacaaaataccactgactgagtgggccttaacaacagaaatttattttctcacagttttggaggttcaaagtccaagatcaaggtgttgacaagcttggtttctcttgaggcctctctctttggcttgcagacggccatcttctactgtgtcttcatatgatcttttcttggtgcacaagtatttctggtggttctccttctgataaggacagcagtcatactggattggggtctcacccatgtgatctaatttaaccttaattactcccttaaagaccttaactccaagtacagtcaaattctgaggtatagggggttaaagactctaacatatgaattttgggcaacacacaattcagtccagaactaatctggtcattttatttccatttcttcatttatttctcacaatcagccgagggttaagtattattattattattattgttattattatatatgaggaaacttctgtttagagaacttaactaactcttagactgcacagctagaaagagattatgtattttgttttctattgctgctgcaacaaattatcacagtcttagtggcttaaaattacacaagtgtattatcttacagttatgtagttcagaagtctgaaatgggtcttactgggctaaagtcaaggggccagaaggccgcattcctctctgaaggccctcaggaacaatctgtctccttgccctttccagcttctagagattgctcgtgtttcttgactcaaggttccttcctccatcttcaaagccaatgccagcaggtcaaattcatctcacattgcatcactctgaccttttctgcttctctttgtgattataataatatattgctaatatgttatttataactattaataatatatgatataatattgtaatttaaggacctttgtgattataataggcacaccagtgtaatgcaaggtaactccctatcttaaggtcagctggttagctaccttaatcctcttttgtcatataacagaatcatcttatgttggtattaaattgtatgtttctttttctttctttctttctttctttctttctttctctttcttttttttttttttttttttttttttgagttggcgtctcgctctgtcaccaggctggagtgcagtggcacaatctcggctcgctgcaacctctgcctcctgggtccaagtgattctcctggctcagcctcctgagtagctgggactacaggtgcctgccaccatgcccagctaatttttgtatttttagtagagatgggatttcatcatgttggccaggatggcctctatctcttgaccttgtgatccacccctctcagcttcccaaagtgttgggattacaggcgtgagccaccgtgcctggcccaaattgtgtgtttcttaacgtaaacattgggagggagtttgtcctaatggaaagaggaccaatatcagagttggggtatctgtgctctacttttgatctttttcaagacatattattttatatatattctgtatctttttggattgtgtactatcttcctatagcaatggtcctcaactgtggtgattttgtctcctagaggacaattagcaatgtttgcagagattttttattattacaactgggggagaaggaaggtgctactggtatcttgtttgtagaggccaaggatgttgttcaacacactaagatgcatggataccctcccaaccccaaagaattatctgactccaaatgccagtagtgaggttgagaaacactgcccaattatggtgtggaaaattgatgttagagttgcaagcgaaaaagccagaagatgagttaggagaaaatggccacggtctaggggagagatgatggtgctttagactaacatagaggcaatggaaatagaaaagtagtgagatcttacatcaattttggagataaaagtgatctgatattgagaggaattatgtgtgggaagtgaggatggtgtcaaggatgactgccgagttgctataatgaccttctacgtaaatggagatagagttactgaaatggagacttccagaggaataatagataatacttaaaatggatcttattttatgtaaattctggtctaagtatactaacccatttaatccttataacaacccagcaagataagtgctattaacatcccctttttataaatgagaataaagaggcacagacaggtcaagtaacttgctcaggatcaccagccagtagtaagtgggttttgaatgcataaagtcaaattccagagtctatattcttaaccactacatgaatccaccttttggaagaacagatctagagagaaagatcacatctctttccatgacttcatatccttcaatcctaagatcagagtgcatggtcaatcactttaatattttcctgtgtattttaacattttccttgtgaatattcccattgtattcacaaggaaaccctccctccccccaacttgaaccagtaattttcctgctctcataccaaggtgctgaacattgctggagaagtccacagagctttggccactgttataattatgaagtcatgagcacacctgtccatggaactctccatagcagatcattcttctatttctcaagagcatgttctgtcacactttccacactgccttccccaaattcactctgctcaagtcccccactccatcctcgtgcctccacacagtctgtagataatgctgtactttatttcatcacgaaaatacaagcactgagttgatactgcttcatcctctgaacactccctacctataaaccaatctatattcccatccatagcttctttcattcccaaattagtgaaaaaggtatctttcttcccaagtaaggtaaatccgtccctcatcttgtgctcaggattccttctcattcggcctccccatggatcattctaacactgtctcaactcttcaatttctctgacttgttctacacctgcccagcacttaaaggtactcaatgctgtgttacacaatcacaaagtgctgttcttatcacagctcttgcttagttgacatcaaatgtgagagaataatattcagtcactagggtaaacctgaaccacaaacatttcagctctttggctacaaggcaattttaaattttaacctatgtctgtaagagcatttataccatgagtaaaagttgctgctttcttttccagttccagagcaatcattcaagtcaaaacttttagaagataatatacaatcatatttctttcccaggaaataatttttacaatcacaaggaggaacaagccagaggcactcttgcccttaacataggtctactctgatgttgtattttccccatcccccagtatctggccaaatgaatacatgcaggagatgaaatatggagaaagaacaaaaggactaattccacttgtgagagatgaaggaacaggagcactctcatgtttcttaggtaatgtacattctttccttcatttactcagtcattgaaaaagggttgttgaattcctaacatgagtcaggcactaaggaaagcaaatgctaaacctgcccttcaaaactagtgggggcccaatacctttataaatcatcataacacagctccacaatcccttggccacatttccaaaatccaagggactctgaaaatggaaagttgattcagaagtttacaactcttgtttgacagtaaatctggccagactgatttgaaaccttttatagacttcatacaagccgggtattcagacatatccctcaaaaatagtaatatgttaaatttatagcatgctgccccagaaccaatagggctgctatgaatattaaaattctgaatttggaaatgcttctggctgcaagattttctgtgtagggagagtacatgcctgtgtagagggactgtgatgaggaagaaacatttattgggtataaatatcatgcaaattgctttatatacattatttcacttagacctcaagacagcccagtgaattaggccttgtggtcccattgtacagatcagtaaactggacccccattagcttaaataacttgcataaagaaggggcatagtgaggagtaaaacttatatttgttgctatatgcatgctgatatataaatcaaatcatttaggtgtgacagagaaaatttggatctgagcagggttactcactaactcatattatgtcataaaagacatgaaaaagatctgcagagccatatagactcatgtttttaaaagagtcagagaggggcactcagaggatgcgggcatgcatactgttttagggctttagggaacgtatcaagaggaggtggaatttgagctgattcttaagcagtaggcaatcattttgcatgtaagctgataagcatgtttagtcttccctgcttgatggaaaacagactcctggaatgggtttctggcatctgttcttatgggagcttccccagcggattcttccttatttcactctgtgagtggagactgagctggggctcatggttatgcatgggctgtttcctctggggttaggagtgggcctctggatttgggtcctgcatactgtgcccaggtgcacaggtttttgaagctcggcacccaggctaccagccaaaagaagcgctctggggatctcataaaatggatttcatttgagtagaaagcttatttttgtcctgagtggttgtacatcaaactcctttcacatgtcttggaacaatgaaaaaggtttggcttggcctttcagggcttgtaagagcctagtttcctctgggatttacagaacactggtcttgtcctctctgggtggtataggaaaaatgcttccatcacaagtttctctggtggcacatccatttttcacctgggaggaacctacaaattgaaatgtttggctcataatgtggaatagcagaatgttgttagcgcttctgtggtggggttggttgaaaggatattgtcttcatgctaggctctgaggtgttaaatgagaaaacggaacaaacaggaaaaccaggacctggtcagactcagcctataatcactgctgagaactggaaaaggaattttcagcaggacagtcctactctggggcattccctccaggctggacaggctgagagtcagaaatgctgggctattctagaggtaccactaatgggcctgcaaccattttatccttctctctgtccaatgagggagaagaactagataatctttcaggttccctctcgtttcataattcctgtgtctgtgattccaagtttttaatttcacatggaaaatatttgttgtaaaaccaagacagtatgtgattgtttaagtgggagccaaagagaggaaactggggagagggttgtgtcagaggatcaccaagtgtaatgagtgcaacaggagaatcagacagtaaggagtcaatgtgcactgcaacccctgctcagagctaaccacactctgaggagcagctctgatctctaataattttttttttttttgagacagggtctcactctgtcacccaggctggagtgcagtggcatgatcgtggctcactgcagccttgaccttctgggctcaataaattctcccacttcagccacctgagtagctaggacaataggcccctccaaccacgtctggctttttttttttcttttagtagagactgggtttccctgtgttgcccaggcttgtcttgaactcctgggctcaagtgatcctcccagcttggcctcccaaagtgctggtgttacaggtatgagccaccacacctggcccctagtgaatttaataacctaccctgtgcctgctccatctgtcaggccagggcagagtcagcagtcagttttggctgccagcctaggataatgattacctagccaattggagattggcctttcatgtgcacctgtaatggaaaaattacagagctgtctagtttcagagctgacatctagtggagccttgttccatcccactctaagtctgtttctttcaagcgatacatgttggttaataacaacagctgaaagccaatgtggtgtctttgtggatcagcattttatcgttttgggcccaaggctttgcaaatataccgtgctctttcacaattggggataggaggggatatcaagttgtaaagggaccctaaaagcatgagggtatatactattgcatttaaaatttcatttaaaaattattaaactatgcaaataacaccatgctcatttaactgcagggcttcagtaatgttgcatctgatcatagaagtagccaatatttaaaaagtttctaaaatgcatctacttattccccaaagatatatgagtcacctccatgtgttagggcagtgctagaagctgggattacccaggtgagctggattagttctctgccctcaaggggcttatagcatcaaggggagacagatgtctaacaaaataattataatgcagtataatgcaaggtggtgggtcctgtgacagcagtaaggacaaagtgctttggaagcacaacagagaaacaacagatggattaactgaaaagtgtgtgtgtgtgtgtgtgtgtgtgtgtgtgcttgtgtataacaagggagcgttcccttggtggagataaggatgccactaagggttaaaacaattacacgtttaattgatggcaagcacgggaatgaaattctataatttcaggtgcagtggcagaattgctaagccacagaatacatattgtgatggtaagtacagaagagaggttcattcattgggcggatggttattctcacctcctatgtcacagatgctgtgagaaggctgtgctttagcagtggcaaacaggaagacatagtccctgcccttggattttacattttggttcaggagatagtccagaaataagtaaacagataaacagataaaagttgtcaattatagtcaagaaagtaagcagagagtgtggatgtaaaccgtggtcaagtttcctatgaaggaaatttcaaaagagccgcagcaggattgtgggggaggcccatgggatagggtgccagctcctggggtgaagtttaagctgagctgggaagagtaggaggggctcaccatgagaaaagtggtcagcagaacgtctggcagaaagaacagcatcagtgagggctctatgcatgaaagatgtttttggaggactgggggagactaacgaatgaggcaatgaatgaggtagtgagagaggaggagagtggtataaggaggcttcgggaggagctctgtgcatcctactctccactcccctcctgatcctgctgctcctcagccatccttcttcctacgacttcccacacattgacaacaaaatacagggtccagctagggcccatgggcctctcccaaccttgtttcctgccactcttgtccttgctccctgcccttctggacactctgtccctcttgcttttactcaaactccctaagcaggttcccataccagaaattgggcacctgctcttccctctgctggggatgctctgctcctggtcattaccaagatgtactctctctattcacttacatctttcctcaaatgtcagctcactagaaaggcctcacttgaccacccatcccgacactagagtagatacaccccatcacctgacactctgtctccttgtcccgctttgtttttttgtaatacttcatgctcactcccaggcattttaagataccttttcttgtttatctgttcatgttgccgtgtcttccactggcatatacacttcatgaagtgtacatgtcaggtcagggctggcttcatgggtgtgtgatctgtgcagttgaccagggccccatgctctgaaggacctgtgcttggattcatcctctgctattgctgtcttgagattcttaataattttgtcttttaacttgtgtgtagtaagtgaagcccaatgtagcaatggagtgtgcacagagagcatgagcagaggcagtgcactagagaatggcacacatatgcagtgtggtcgagcagcaatgcctatatgcatgggcagcctggccaactgatatgcctgcacacaccatgaggcagctgctgtgctgtggagccctgagacagtgtccaggcttggattggcagtggtgatgcaaggccagcagcagaagcagcaataggcatggctgtagaagtgagagtggctctgcatggaggaaacttcctgaacccctgatgggaggttggcttgcctatccatccatccctggagcctgcttccaaggttttacgaattcttggccaaagtgctgggacagaaattgctggtgctcagccagtaaactttgtgggcaaataataacaagataaaagtccataaattgacattgcaagaaagcatatcagggagatataattcttcagagtctgaaatccttgattttgaaaactactataacattgctttactattcactagcttagaaatagaaactaaagtggaagattattgcattcaacagaaaacactgttttcacgtgaatcttcagacgaacccattatcaataaggaagacaattttaaaatgatttttttcttataattgaagatacagtgatagaatgtataagcatgcattttgaattatatacaaatcatggagccactttccgtttcttatacaacctccataagttaaaaagccagaagaaacatttaaatacgattatgtaaattagcatttaaaattaaatgtatagacttacatgaaactcatttgtatgaagagttaaacctttttaaaaaattgttccataagaatcatcagctctagagaaaataaaatttatatttaaaaacaatttgtctgtaatttatctccatggtgtcaccacctataaaatccttttaacagctccaggaatagctgcattagcagaaagatccttctcaaaattaaaaaaaatactaaaaattatttgcaatcttgtatttatcaagaatgatttatgtctctttaattatatgtattgaaatgaagtggctaaaagtataaaacttgatgacctaataaattaatttgtaaaaaagtgagctaaacaaaaattttatgattgatcaagatgttacattaatattatttatcgtataaagttacaaaaccagaaatattattgctttcaacatgtaagtttatattgttactcactactacacttattatattttataaataatgaaatatttttaaagtggttcaagagactaagtaaaggagtatttacagaatgagcagagttaaccaacaaggaacgttaaaggagcatagattagcagcagtagggagattttaccacaattggtactgtagaagcaagaagagagacgtgttacagatcccatggagagcttgggccacagaggagggtttacctgataggatcttgtggtctagagggatgcagccatgaccagaatccatggcccaaacccctgggagtaaggggaagaaataccctgatatctctcacctctcatcttccaatctcctgttgtactttctattggctgaatgccaccaaaagctggaaggcaagggaggctgggtggtaaaagtctacaatggacagcctcctggagtatagaacagggtagaggacgacagagaaaagatcgctctgtgtgtgtgtgtgtgtgtgtgtgtgtgtgtgtctgtgtctgtgtgcgtgttgcaaactgagaacaaggacttttgtctgttaaatccactgctatatccctagcacttagaaaagtgcctgacacatggtaagtgttcaaaaaaatacctgtcaaatgaatggaagataacctcacatgtgatttagcagtgctagaggcttcctgtagatcatcattcctttcttcctcatccctcttgtgaatgcttgctcatgaatgcatcttgttccactgggaaggatctgcaggaggaacctctgaggcctcagatgtcaggtgcttatccatccacagctgccttgcagggacagaagcccagatggcttggctgtcctctttataaaaacttctgtggctcaggcagtgctctcgtggtagacccagccctcctatcttagccacagctgatggccagatcaatatgtgacacaaagtcacaaaaagtcttctgtctctgaagggggcctggcaggatgtatgctcaataggagcactctcttttgagagctggtaaattggtaaaatccttcttttgaagaagcatacctgttgggtgagcaatgaggaagtggatcttttcctgctctttcatgccttgcgctaaggactggaaatgggcagagaaaggcactaacatttgtgagaacctactatgcgccagacattttgtaattgtgagaaactacacctaacatgttgtatccatgatgtgacaagtgtgtaaagacagaaaaccagtagactaagcatggctaagtgaaaggataaaaaagatttcattgatgttattgttctgcctctgtgccagtgctagcaatcaccaatctcaatttattgtcacatgaagaaaatacttacctgtatttttgttatacataaatgcttgttccctggtgccacaaataactagcacttaaacataaatttaattctttcagcaaggcaatctttatttctgcagaaagggtgctctcaccattatttcatctgtgatgagcaccctttctgcaggaaataaagattgtcttgctgagagaattaaatttatgttcaagtgctatttctttgcagcaccagggaacaagcatttacatataacaatttgtttctgctgatgttatttgggtattgtgttaatagcagcattcctaatggctatgctagtcgccgtttcaagatataactcttctctttcctcctcattctcttctgcttttatctgccattggcaaccatgagcattgctttgtttcactgggagctctttcttctgatgaatttgtaggagtctcatgaaattttattttcatacctagtatggggtttgaggacacagctattaagtgtttacagatacattattacttcttattactttattttattgctctatttggctgtattggaataatctttgtgtcatactcgtgttataatttttagagtggtaatttagttttagctgtgtgtgtgtgtgcgtgtgtgtaactcctggaactgtagatttatgagggacaatacagtgggaaatgtgcagcctaaatcttaacaacagggcatgttgggatgggaacataaagcacacaaataatcagtacaacacttttaaacaggagttttgtgaaagtgaagttgttttaaattaccctttagaaacaggagataaagtgagggagtagaaaggcaataaaggctgaaggatgaggaaactgtctcctaatgaaattagctgaacttttagcctttgtctccaattgccaaagatggttagctattacactgagccatgtgaaattgctgacagtcaacgttttttgacctattttatccaagataattatagccttaattagcaacaacccaagcttcaaaaaagaggaataatttcttactattactattatgtttttattatataagagacacatgttttctgaagaaaaaagaaatgcagataagtgatgatatggtttggatctgtgtctcctcccaaatctcatgttgaattgtcatccccaatgttgccggaggggcctggtaggaggagaatgaattatggggtggacttcccccttgctatttctgtgatagagtgagttctcatgagatctgattctttaaaagtatgtagcacctccaccttctctctcttcctcctgttctggccatgtaagatgtgcctgtttccccttctgccatgactgtgagtttcctgaggcctcccaagccatgcttcctgtacagcctggggagccctgagccgattaaaccttttttctttataaattacccagtttcaggcattcctttatagcactgcaagaatggactaatataagtgaaaacaaaaaatggtcacatatgcatatataatattgtatttaaatatgctctttttgctgcttttttagcatttcatctttctgtttatactgcccatctgttctcacatgctatctactttatccattagagcactttccatattaatcacagttattttaaagatttgctgtaaagcaactgttgttaataggcctttagtcatgtggtgttaagctgtctgggaggggaagcattcttgggccctataattaggtctcagccctttagtgagcttgtgccttggcctgtggacttcacagtacttcatcagtttccccccacctccttgcacccacttaggtgggacagaagagctacaaagggctggagttggttagactctggaaaaaaactcaatagtttaggcttggtaaaatattttctcttgaggttaggccttgctaagaacagaatgctctggtgtatttaaaaatggttccttttccccttctccctgccagacatgaagctctagggagtttttctctgatattcactgtgagaacctggttgagcttctggaggtaaagttcacaaaagtgtggagctcctctatgaatgagtccccctggagtttttaactcatggatttgcccacagggatcctgcagtaattcatcaattacacttcaggttttcttacctcctcactggtttccatggagatttctattcaggagtttctgctctggtaaattgtgattctcgattctctgaatatgtgtgtctgtctcttcagttttggggacaggggtatgtctgtgaccccacttctctgacagatctaagaacagttgttgatttttcattttgtttgggtttttacttgttaggagagagtgatgactgccaatctcctgatcagaaatgagaagtttacatgttatttgataacttgattttttaaaatttacaatatattgtgaatatatttgataccagttaactatattttttaaagtttgatacgtatttcattgtgtggatataccataattgattaaagaactagcaaaacttaatggttaaaagcacagttgctggagtaagactacctgaattcaaattcacctcttccacttattagctggatgattgtgggcaaattagttgacctccttatgcctcagtttcctagccaacaaaatagagataatactagtacctgtgtcatggagtttttgggaggattagatgagttagtaaatatgtaaagtctgtacaatagtgcctggtacatagtgcctctatgaatgtgttagacattaagtcatcttctgctgttgggtgtttctgttgtttccagttttttactatgataaataatcctgcaatgtctctacttagatcacaatctttgttcacattcttaactgtattcttagcatatatgtctattaggacaccattttgacaagtgacagaaaatccaactcaaaagtggctcaagcaaaataaataagtaaataaatagtgctatggtctgagtattcagaccaatttccccttcaaaattcatatgctgaaatcttaatcccagtggtgatggtattgggaggtggagccttttggtgggtgattaggtcataatggtaaaacctgtatgaatgagattagtgcccttacaacagagacctcagagagttgccttgccccttccaccctgtgaggacactgcaagaagtctccatctatgaaccagaaagtgggcactcgccggataccaaatctgccagagtcttgatcttgggcttcctagcctccagaactctcagaaataatttttttaaatttatttataagttacccagttcatggtattttgttttagcaggccaaactgacaaatacagatagatactttaaaagtaaataaaagtattggctcacttaagtgcaaagtccaggactggtgctgtttgatccaggtactgaaacatttcttgcaggactcagtgcctttttatttctcagccttaccctttttcatactggatttatcctcaggctttacatggtagcaaaatggctccaagccaagtcctcctggatttgattctagctaaaagaagggacagtttctctttcttagaactggatgaaagtcctgggccatactgggtcatgagcccatccttgaatcaactactatggctggaggagtggaaagtactgaatggcttagccctggagctggagaggtatcagtccaacgcaaatcatgggaaatagtcatatagaaaggatggcttcataatctgaaatactaacaaaacaaaacaaaaaaagaaaggagaaaggacactgcgtagccagaaaataaaagaaatattaatttcttagacgaggtatttctgggtgaggaggattctggattaagacttttgatacattttgccaactttttttactccaaaaagtttgtaccaatctgctttctcattagcagtataaaacgagccattttctgggattgtagccaacaaaatatttcttgtattgtttttctcaatcgtatttcttgatatggtaggccagaagaaagtatttaatttcaatttgtagttccttgtaaattgaattgcatattggtttgatatatttgtatgtgtttattggccatgtgcatttattcttttgtaaattatggcatttcattgattctaagacaccattggttataaaacagaccattattttgtgtaccaccaagaaattttaaagaaacaaaccctctgcgactaaagtattacagaaatacttctttttttatttaatttagaagaggtttgctgattttagagatgttaaaatatagaacatatgcatccttgaatcaatgaaatatggtacttattgggctgggggcagtggcacaaccctgtaattccagcactttgggaagccaaggcaggtggatcacttgagcccaggaatttgagactggcctggtcaacatggagaaacccagtctctactaaaaatacaaacattagccgggcatggtggcacacaactgtagtcgcagctactcaggaggctgaggtgggaggctcgcttgagcccaggaggctgaggttgcagtgagctgagatcgcaccattgcactccagcctgggcaacagtgagatcctgcctcaaaaaaaaaaaaaagatacctattaatgatctcttttttattattattacacatttatcttttacttattgaatttgttagtgatttattatagatatttttccatgtttatagttccacttataattttaattatggcattttaaaaaacatactgatgtttatatttttaggaagtaaaattattaatattttcatttattgtttcaacctttgatgtaatatttatgaaggtattttccattcttagactattcaaagatttacataaatttacttcgagcatttctactatttttttttactttgtatttaatccacctagaatttatttctttttatgaaaagaaaaagtttcaaaattttgttttttcaaatggttacctgctcatacaccatttattaattaggcatcctttctccactgatttgaaagattacctttattgtgtgctcaatatttctataaaaatgggtctatttatttatttaatttttagtttttgtgggtgcatagtgcatgtatatatttgtagggtacatgagatattttgatacaggcatacaatgtataataatcacatcaggataaatggggtatccatcacctcaagcattcatcctttctttgtgttacaaacaatccatttatactcttttggttactttttaatgtacaataaattgtcattggctgtagtcaccctgttgtactatcaaatactatattttattcatttctatctaactatatttttatacccattaaccatccccacttcccccacccttttcagcctctagtaaccatcattctaccctctaactccatgagttcaatttttattaattaattaatttttgttaatttttagcttccacaaataagtgagaacacgagaagtttatctttgtgtgcctggcttatttcacttaacataatgtcctccagttccatccatattgttgcaagtgacatgttctcattcttttttatggctgaacagtattccattgtatatatatgtaccacattttaaaaaatctattcatctgttgatggacacttagattgcttccaaatcttggctattgtcaacaatgctgcaacaaacatgagagtgcagatatctatttgatatactgatttactttcttttgggtatatacccagcaataggattgctggatcatatggtagctctatttttagttttttgaggaaccgcagactgttctccatagtgggtatgctaatttacattcccaccaacagtgtatgagagagtccttgtattagtctgttttcatgctgctgataaagacatacccaagactgggcaatttataaaagaaagagatttaatggacttacagtttcacatggctggggaggcctcacaatcatggcgggaagcaagaaggagtaagtcatgtcttacatgaatggcagcaggcaaagagagagcttgtgaagggaaacttcttttgaaaccatcagatctcatgagtcttattcaccatcacgagaacagcatgagaaagacctgcccccatgattccattacctccctctgggttcttcccatgacacatgggaattgtgagagttacaattcaagatgagatttgggtggggacacagccaaaccatgtcagtccttttttctccacatccttaccaacattcattattgcctgtcttttggatataagtcattttaactgggatgaggtaatatttcattgtagttttgatttgcagtcctctgatgatcaatgagggttcagcaccctttcatatacctgtttaccatttgtatgtcttcttttgagaaagaagacttgtatgtctattcaagtcttttgcccactttttgatgggattattagattttttcccatagagttgtttgagctccttgtgtattctggttattaatcctttgtcagatgagtagtttgtagatattttctcccattctatgggctgtttcctcactttgttgatcgtttgctgtgcagaagctttttaatttgatgtgatgttccttctatatccagtttttttagagtttttatcatgaagtgattttgaattttatcaaatgtgttttcagcatcagttgaaatgatcatagggtttttgtcttttatccagttgatgggatgtgtcacactgattcatttgcggatgttgaatcatcatagcattaaatcccatttggttatgatgaatcacctttttaatgtgtggtcgaatgcagtttgctagtattttggtgagaatttctgcatcagtgttcatcagggatattgccctgtagttttccttttttggtttgtctttggttttggtttcaggttaacactggcctcatagaatgagtttgggagtgttccctcctcttctactgtattttttggaatagtttgagtaggattggtactagttcttctttcaaagtttggtaaaattcatcagtgaagtcatcaggtcccaggcttttctttgctgggagactttttattatgtcttcaattttattacttgttattagtctgttcaggttttggatttcttcgtggttcaatgttgataggtgcatatgtctagggatttttctatttcttctaggttttccaatttgttgacatataattgatcatagtaatctttaatgatactttgaatttctgtggtatcagttttaatgtctccttttccatctccagttttatttatttgagtctgctctctttttttcttagtctggctaaaggtgtgtctattttgtttatattttcaaaaaaccaactttttgttttgttgattttttttagttttttttttttcatttcagtttcatttatttctgctctgacttgtattatttcttttctcctactaattttgggattgatttgctcttgcttttctaattatttaagatgcatcattagattgtttatttgaagttaatttacttttttgatgtaggtgcttattgctgtaaactttcctcttggtactgctttcactgtatcccataggttttggtacattttgtttccagaaatttttcaatttctttcttaatttcttcattgactcactggtcattcaggagcatattgtttaaattccatgtatttgtatagtttccaaaattcctcttgttattgatttctggttttattccattgtgatgagagaagatgcttaatattatttaatttttttcaatattttaagacttgttttgtgatctaacatacagtctatccttgagaatgattcatgggctgagagaaagaatgtgtattctggagccattggttgaaatattctgtaaatatctattaggtccatttggtctatagtgcaaattaagtctgatatttcttgactttctgtctggatgatcagtccaatgctgaaagtggagtgttgaagtctccaactattattgtattggcgtctgtctttctctttagatctaataatatttgctttatatatttgggtgctccagtgttaggtgcatatatatttaaaagtattatatctttttgctgaattgaccccttgatcattatgtaataaccttctttgtctctttttatagtttttgtcttgaaatctattttgtctagtataagtatagctactcttgctcctttttggtttccattggcatggaagatcttttttcatccctttatgctaagtctgtgtgtgtctttataggtgaaacgtgtttcttgtaggcagcacatctttaggtcttatttgttatcctttcagccactctgtcttttgactggagggtttaatttatttacattcaatgttattattgaaaagtaaggacttattcctaccattttgttatttgtttgctggttgttttatggtcttctcttccttctctccttccttcctatcctcctattagtgaaagtgattttctctgttggtatgttataatttcttgctttttattttttatgtatctcttgtatgttttttcatttgcagttatcatgagacttgcaaataatataatctactattttaactgatgacaacttaatactgattgtataaacaaacaagcaagcaaaaaggaaacaaataaaaactctactctttaacttcttccccctgctttttgctttttgttgtatcttattataccgtctatgtcttgaaaagctgtcaaagttattatttttgttaggttcatcttttagtctttctgctcaagataagagtagtttacacacaccaaaattacagtgttataatattctgtgttttttttctgtgtacttactattaccaatgagtttttttaccttcagatgacctcttgttgctcattaacatatttttcttttagaccaaagaactttctttagcatttcttgtaggacaggtctgatgttgatgaagtccctcagctttggcttatctgagaaaggctttatttctcctccatgtttgaaagatattttctttggatatactattctaggaaaatggaaatgttttttcgtttggcactttaaatatgtcatgtcactctctcctgacttgtaagtttccactgagaagtatgctaccagaggtattgaaactcctttgggagttttattattaaataccttgaggtggtcttctttgggtaaaatatgcttggtgttctgtaaccttcttgtatttggatattgatatcttcctctaggttttggaagttctattattatccctttgaataaactttctatccctatttgtctcttaaaggcaaataactcttagattcacccttctgaggctattttctagatctctatgtgtgtgcttcatgctttttttttatttttaaattttgtttcctctgactgtgtattttcaaatagcctgtcttcaagctcactaattctttcctctgcttgatcaattctgcttttaaaggactctggtgcattattctgtatgtctattacatttctcaactccagaatttctgcttgattcttttaaattacttcaatctctttgttaaatttatctgctaggattctgaattccttctctgtgttatcctaactttcattgagctccctcaaaacagcaactttgaattctctaagaggtcacatatctttgtctcaaacagatctacttacaatataatgacatacctctatattcttacaccagcaccacattgttcaaattcttacagacttacaatgtattctaataccacatttcattgattctaaggttttaaaaaacattttaagatctctgatatcagaatgtctcttacaatagaaaaaaaagaattatatcacaacttaactgtgagcatttaacatttttaatagtatgtaaaaaatggtttctcttatagtcaataacactttcaattgaataagttatggggtataaaatgtttatctacctgcttaatcatcctttttagtattttggctcttatctgtttactcttccatgttaatattagaatcactttgtcaaaatattttgtaatttattgagaattgtgataaatttattaattttaaaaagtataatcttcaaaatattaaatattttcaaattcttctttaactaccgtcaataaggttttatggattttttaaaaatctagcttttacatatttttagacttttttttgagacagggcctcagtacataccccaggctgaagagcagtggtatgatcacagctcactgtagcctcaacctccagggctcaagtgatcctcctacctcagcaacccaagtagctgggactagaggcacgcaccaccacacctggctaattttttgtattttttagtagagatggggtttcaccatgtttcccaggctgatcttgaactcctgagctcaagtgatctgcccactgcagcctcccaaagtgctggcattacaggtgtgagccactgtgcccagccttttagatttttaaaatatcaactttagtttgtaatatggtttggctctgtgtccccaccgaaatctcatctctaattgtaattcccacgtgtcagggaagggacttggtgggaggtgcctggattatggaggcagtttcctccatgctgttctcatgatactgagtgagttcttacaagatctgatggtttaaaagtgtttaatagttccccctggatctctctctctcctggtgctttgtgaagaaggtgcttgcttcccctttgccttccaccttaattgtaagtttcctgaggcctccccagccatgtggaactgtgagtcaattaaatctcctttctttataaattatccagtctcaggtagttctttatagcagtgtgaaaatgaactatacagtttgtgcatatgcatcactatgaatgggatctcttttgtattatatcttctaaattgttattcatcctgcatggaaaagctgctgatttttgtttgtttgggcatatggaatttatcctgagaacttagatatcagaaaagaaatcaggaaaaagtaagaagtttattataatcaactctctttcccccaaaatgattaggtgacagaaaaaggcattaagaaaggaaattaaaataatatacaaatgctttattttagccataagtttggatcatctttgtcaagcaacattttgttggaactatatgtgactttattaagtatgtgtcttggtcacttcaggctgctataacaaaataacttacacatcacaaaatgatatctattacaattctgaggctagaagtcccaagtcaaggcaccagcacatttggtgtctagtgagggcctactttctggttcgtagagggcactttcctgctgtgccctcacatgctggaattctggggcctcttttataagggcactaatcccattcatgaaggtttccgcctccatgatctaatcacctgccaaaggccctactacttaataccatcacattggtgattaggtttcaacatatggattttgggaggatacaaatattcaggccatagcaatggagcacagaaataactatgctgggaaatttcacattgctcctgaaggtctcagtgcctttttggggtccagagacttgggctctgggtctggctcagatcaggtgagatcctacaggagacactcatatttttagagctatacttcctcatctgtaaaatgatgactttgggccaaattattctaagatttttctgccctaacattctggggactattaatgagtaataaaattgactgatgaagtttatcccctttttgtcattacctatcctcagccagcaaaaagaaacattagaagacaaggaccaagtgaaggagccagagaaacaaggtgcccatataatatataatatcaacattcaaccctcgagtacctgaatgttgtatcgcactgctggacaaagcaccagagcaggcattgtcctctggtaccaggaaccatccagtttattaccagccttttgttggtagctcttttgccccagataatgtcctatttgattttgtcttgactaagcacctgcctgtacctactgccttgtaagaaacaaaatctgaaagaaggaaaaagaaacatggtaggagcataatagctggctgtttattcactgaaggagcatttatagatcttctttctatttaggacccagaatgcaccaaataccacgagtgggacttttgtagggaccaggtataatctttcctctcaacaatgggttacagatatataaacaaacattcatgcaaaggattattttaggtgctatgatagaaatcttaattagatattgtggggatagaaaagaaagagtttaattttgcaaggatgaccaagaaaggcatagagttgctaagcctggttccattttgaaaggcagaggtggagaaggatatgtccatatagggaatggcaagagcagaggggcaggggcatgacccagcctggagaggctgcaggtctaaatataggctacagggatgggcacaggaaaaatactaaaggtatgtttaaaccgtgtttaaaacattgcggaatttacctcttagtgaagctatggcaggcttttaagcaatggggttcagtgggcaaatttacattctaaagagatcattctatcgtatgaaacctgcatgatttgagaaggtttcaatgcactgacaaggagtctagtgaagagagagctgcagtagtccaggtgagaacaaagtccacattgacatgaaaaagtggagaaagtggcatgtctatgtgatgatggattagttttctatcatggcataacaaaacatcacaaacttggtgacttaaaacggcacccatttgttagctcacaattctgtagttcagaagactgggcctgctgtgggtatgttctctggacagtgtctcacaaagttgaaaccaaagcgtcagctagagctatagctctcatctggggccagaggtccacttccaacctcattcaggctgttggcagaatttattttcttgcagttgtaggactgcagtcacaattttcctagtagctgtcccacggtagccactctaagctgctagaagctgtccctctccatctagagttctcgacatggatcttcattttcttttagagctatacttcatagctcttcattttcttcatgttggctggattgcatctctctgatttccctttctgtgaccagcctgaataaactctcttcttttaaaggacttggatgtttagattacccagataacctctttccttaaagttatctatatgatattacctaacctaatatcaggagtaaaattattcatattcacagtcccagggattatgcatggtgtgtacatggcaggaaatcttaggaagggtcctcttagaattctgccccccacaaatggtacaaaacaacaataacaagagtaaaaagtagactagatagacactgtttccaattgcatgaaggaagaagaaagaggaaaagactcagtgattttttttggctgggtggtataattaccagggtaaggaggatgaaaggacaaaggggctgggattctactttgggcttggtgaggttgacgtgtctgtgagctatgcagttagtccaggagacagtaggattaggaatacaggaaaatagttgggaaagaaatacaagatttttagttagtagcagatagatgctaggaacaccatgggactggataaaatgggttttattttaattgtgtaaacttctctgcattcctaaactatatgttccttgatggcagatctatgtgtttccatttctgtatgttgggtgccttccatatagtatgtgctcaggaatgttatggatggatgaattgttgagattatgcaggtaaaacattctaagtaaaaagttaagggctgagaacagaaccctgggcaatgtcagcatttatggaatgagcaaaggatgaagagtccatgaagggggaaaagtcaggtggaaaatcagaagagagcagtgcctgcaaaagacaggaggagagtctcaagaggaaaagctaccatgaaaacaatactgaacattttactgaacaattactctctgccaagtaacgtgtgtgaagtttacttaatcctcaaaataatcccatggtgtaggaactctttttatacagaagaggaagctggggcccagagacgtaaaatttttcctggatcacactactggtcaacaagagagatgaactctaagtcctggacacatgaccccagagccgaagctcttaaacactaaattacacaggtgttctaccccttctcccttcttgctgaagagaaaaaactcctaaccaggacaaacagaaaacccagtggaagaaatagcatttggcccttgatagatgggctgtactttagcaacggagctggaggaagcccaggtaggtttgccagatttagcaaataaaaatacaggacacacagttaaatctgaatttcagattaagattttttcttagtataaatatgtccccattatatagcatgctccaatcaggctagaatttttactctccctttttacttctacgcttcatagctcatgctcttcatctctacggcacactgtaccctttctttttgccagtcttaatgttacccatcctcgaagccccatccatattaactgtcatttgcccagcattcctacctaaaaaatacattcatatggatgacctcatttgatttacaaagcactcttgcaagtaaacatggtatgcattattaaccccttgtgcagatgagaaaacaagcttgggatgcaacatttttttttcttttttttttgagatggagtcttgctctgttgccaggctggagtgcagtggtgcgacctcacctcactgcaacctctgcctcctgggttccagggattctcctgcctcagcctcccgagtagctgggactagaggcacgtgccaccacacccagctaattttttttttttttttttttagtatttttagtagagatggggtttcaccatgttggccagatggtcttgatctcttgacctcgtgatctgcccacctcggcctcccaaagtgctgggattacaggcgtgagccactgctcctggctgggatgcaactttcacagatcattcattcatgtaactgggaccccagggtcttatgacagcaactttcattctttttccacgaattcacactgaaactaatgtcagccttccactttgattctcagtgctcaggtacctctcctttttcttgacctctcagtttggctcttgatttaaagtttactcttgttgttcaagtcttacatttccaagaacacttatgttctctcaagacaggaatccgccttgtacaactttggcccctgcccttcatacatatccagttgaaactgattaattttctccaaatcctgttaaatgatcttgaaaatcactcaggtctgagcaatcctccaagtgttccgagttcttggcagagtgtgtcaccagtacttgtgactaaaactggtattttttttttaatttcatagaatgtaaaaaattgtggtcaaatattcttccctaatatccccagcttagtgatttcttctggatagacattcccatccaccacagaaatgtccaaaacaaatagccaaggaataggcaagtttatctaatagtaatttattcttccattcttcattcaacggcacttaataacacctgcaatatgctagctattgtgttagtcagtggagatcaaagatgagagagatgcggtcctccttttctaggaattcacagtctgttggaggtgactcaactttatacaaataccagaggacaaagcacaatagataaatgacgtgaaaattcagatgtgggaggtagttatctccagcttggaaaaggaaaggataacctcagcttttaaccttgattctcctctaaaattcatacagccagtcctgatatactaatcatgtggattttagcctcagaataattactgtgattatctcaagaattttaaaaaggactaaatgctaatgtgaaaaaaaatgaaaactcaacatgagacattagaggaaattgttaagtacagtggggaaggttgagaattcccaccccctctcatctttggctcctctgctccagtgagaaatggcatacctcattctctgctttgtattcattattcttttacttataaccatcttacagaatgaatctctttctccgtctctccttctccctctcttcctccccctttatgtgatagacgtatctgtctttcatatcttatttatcctagtatacttcagaaattgcctttcttgatttgtttcttgcaatttcctgttttgtatcattcattcattattcatgccagccagtgtttgtaattgtgatttggtaattgttattcaatgaatgagtatcagcttgaataactcagctacaaaatcataatactttatatcattatttcactttctagtttcttaaatatttttgtgtgtctacttttttttttaatctcaaagactttatgacattagtcatctttatattacgtagaccacaggagagaaacttggacctatctacatttgatttggggccagcaccctctaagtctaatctcctgcctgtgtccattgcctcctgcacaacagttaataaggtgcactcaccaccactcctgccacaagcacaggcatgctgttgttgcttctattaagcttcaagacaataagctgccctctggctggtgggactatagctccataaaatgatacacttgctatactctgttctgcaccttttcccagagaaccatttctctgctcctcaccttgggagtaatacatctttctttgcttttaccaaagaacggctgttgtaatatagcttgagaccagggatttaacctgctaggaaattcaacatttatttaaggattatatttagcggaaagatgaaaaagggccctactcaaccggtatatgaaaagatgctcagtgtcactgatcactagggaaaggcaaattaatatcagaaggagatataaccttatgtctgttaggatggccattattaaaaagatggaagataacaagtgttagtaaggatgtggagagaagggaacccttgtacaccattggtgagaatgtaaattggtacagccagtgtggaaaacagtatggagttttgataaaaattgaaaacagagctcccatatgaaccagcaatcccacttctggctatatattcatgaaaataaactcagtatgtaaaatagatatttgcactcccgtgcttattgaataattatttataatagtcaagatatgaaaagaatctaagtgtctgttgacagatgaatggatagagaaattgtgggagtgtgcatacacacacacactggaatattactcagcctcaaaaaagaaggcaatcctgcaatttgtgacaacattgatgaagctggaagattttgtgctaagtgaaataagccagacacaggaagaaaaattctgtgtaatctcacttatatgtggaatcttaaaaagtcaacttcatagcagcagagcagagaatgggaggcaggtgggggtggggagcaggaagatgttggtataaagtttcagttatcttacgtagggttaataagttctagtcatctaatgtatagcctggtgactatagttaataatactgtgttatctacttgaaatgtgctaaaagaacagattttaagtggtctcaccacaccaaaaatagtgaattatctgaggggatggatatattaattatcttaactgaagtaatcatgaggtataagcatatcaaatccaattatatttcataaagctgatttttttaaagggggaactattgattattaaatgttttccatacaggttcagcactcaacataacctatcctgataatagacaaatggccagtgtctccgcattagcaatctatcgagatctctgacctagctcctcaaacagccagcccaaacctctcatgctgggtgggcagccttagctgctgaccttctcttccctccagtgggtgttggtagcgtgaaagatggcccatctaattgccactgtccctaatgtgcatgtcctcagtagtcaaactaggttagaggaaagttgcaaataattacagaaaacagacattgctctatttggtcctattgtgatctatcattatagcaaattccctgaaggaacagaggtccttgccagccccaaacagtcccctttagactcacacatcctccagctattcttacaagtatctcctcccatagattgagcctccttattgcatttgataagccaggccaccaggctgtaaacagatgagaactactggctgcacaggaacctgtgacccagatgccaccatataccaaattcaaacacagtgttgccccagtaaaatttgtaatatcacaatgattacaaaaataaaaacaaaggtcttacaaataatatccccatcaagaccccattccaaatgtttggcactgaaggctcaggggtttaggattctctaatgatttgattttgggaaagtccaccagtggcaagctctactccaacaggtcattttattgctccttgcttctaatgctattctatttccttgtattgcgagggcttctccagctccatgccaacaactgctacaacccaaggccctcctcctataggccccagcaaaccccacatctataccaaatgccttctctgacctccaccaatggaagccccttgccttttgccttccttagcgacctgaaagtcattggataccctggccatctcttgtggacacatgctcatatatttcattggtgatatattagtctccacataattctcaatttttaacagtcctcattgatgctggatcctaggtcagttttgtgctcagcaaaacttcaaaatttaaaaaggggaaacaacaactaggggtgtcactggacattgagtccaaggaactcaaacaccttgggaatatattgctgctcaggcctcacacattatagttaaaatctctcatgtctcagcttatggcaaggcccccacagaagaggcagtctttaatgaaatagatgaccaacttgctcaaatttttcaaataaattcagatattaccctatgctcttgtccttggctggatgggcttatgagatctctggttatcatagccctgggacccaagtaactttgggtcaagcatcatgacactgccatgctactggctctagcccaaacccaagtcccctaatgttatctctattccctgtcccaccactggtttcataccaagggaaatggggattgccaatggggatccataccaagagatgggcattccttctctcattggcaagatgattttattgaactgttgccccagtctgctggcaaaaattactcttcctcaatgatggctgatatttatgtatgcatattcttgtcttatcctttccagcattctactgccaacaccacaattacaggtgtcaccaaaacttagatagctctctttgtgcccccagatatcactgactctgaacagggtacacatgttgctgctcattcatttcaggtgtgggctttacttacaacacggcatcatttggaactttcatttgtcctattgtccacaggcatgtggcctaatagacagacataatggcttactcaaggaaattctcttaaaattaccaaatggataatggtctcccaaattgacctctcttttgcccactgccttagttaatctgcaatttcaagctttagagcctatgacatcccaccaacatgtaacaagagctcttcttctcccccttaaaaccacaaaagagtatgcttctcacctatgagtccgtaatatttaagcaaaattcctcttctcaattatacctctgattctgctaccccttttcaatcctggcacaatccacactagattgtcttctggatcagcagtgaatattatggaactcaccaaaaattgagaggacttgttccccaaacatgtaatactgtgtccctgaaaactctctgccaaagcttgttgtccttccctaatatgatagttttgaaggtttgctagctgtaagtccctctttgctaggaatgaaaatcttggtgccttgtcccatacctacaattgtgtggatcttccggtaagaaaaataagattttaaattagtttccaatgccaacatttctaaataggatgcatctctggctccattccattatatttattttgaatgggtgactactgcaagacccaggatcataatgaccatgactaccatcataataaataggcattccccagcatgccagcctatgccaaaagcccaaaaatatcaccatggaatatttttgtttatcttggcctggctgtgcttcatttggctcaagcctgggtctgggattctgtgactctaactcaatgtcaaataccataggcttctttctgccgatgctgtcatccctacttgtgtggggcagtcactcaatccacagcttccctgtaaaaggtactccttaacttcttaaggggcaaagggatactcatcttcaggcaaatttgtaataatttatcaaatgtatatctttgcctcaagatcttggggctagtcaagggttcatatcagaaaccctttgccccagccacactagggcccttaagggtaccatccacaggtcacttgtagtcaacagcacagacaatggccatcgtctcaggaataatgacctcagaccagcagaccaaagtgtcccaaatgataatttcagtgtgacttatagtcctaaccttgacactggtaactcgagtgatgacacaattccatggtgaacactgccaagtcaagattctgctccctgaccccttcttttctcccaaacctaaccatggttcttccatactcttgcctcatgacttacccttggccccaagtttgaatctatgcaacgtgcttactctctgctcccaacctaactgatgacaatgtcaccatagttattgtgattgcttaattacaggtgtcatccactctgcttatggagtctctgtgactccattcctctcctatacaatttctctccattcccctttcctacaagaagctaatgcttattggcaggaccttacctgcttagactataccgaagcctgaggaatgactctatacaggggtctgtctttgcctattacctaacctgctgcatcaaggaactcccatttaattatttagatttgtgcttgactcactcttttctcttttcatagggttttctcctggtatgagctatcaccctgcaaattagctgatctatacccactggtcttaccattttatttctccccttaatatctaaaacctgaatcaggattcccatctccactatccctactcttacagccacatcagctctgattccccctcatccaactatccatccttcactctccactacttcgctgtcaccatctccactccctactttcctgaacctgatggacaatatctatgtaacagtaacagggtatgtcacccgagagctaaacttccagcaacactgggcttgctaccaagggccccagcctggaccacaacttattcaactaatttctgtccctttggagatctatgatacttgtactaaatacttgtcatcttctccatcccctgtacttcccccagcactcccttgaccttcctaggtgcttcctcattaatcttcacttcaaggaccccttgccctcctcaacttcccctaccaaccaatatatccagctgtgtctcccctactccacccccactttgaaataagttggctatcacacatctgcatcggtataaatttgctcaccagaaatccccccttttaagacctttgggccactcattctcctgggacgatactcctgctcaccaggcactcatactctgctcctataccccactttcttctaacctatgtagcctggcctgtgtcctagggccacatagtagccaggtcaccctgcatccaactagagaattcacatttctcatacagccttccctcaagagggaagggtgtttttttaacctattatgttgggcctcatcacaatctttagtataacaggcataaatttaggcatttttaattctctaaaacaggctcaactcagaggagccacacagacagtgtcacactcccagaagaccacatatgtcaagaagcccaagctttagatgctgtgaataagggacaaagctctgtggttgccatggtagctgagaacagcttagcattagactatctactagcatctcaaagtggagtttgtaccttgatggaaacctcctcctgcatgtgggtcaataacacaggaacagtcttcagaagagttcaacaaataaaacaacaaagcaaaatagtcaatcttattactccaagagactccgtggattccactgatttttctggatgtctccttctgcctggggcaattgactccccactatctttcagaaagcttataataataattgctattttaataataattatgataataactattattttgagttagctttgcaaattttttctgtcaagtacaagtttgtttacgggaatccttggagtttgccgtgctaacccaaatatcatggatgaattgtgaagacaataagtaagaaataggaaaaaagcttggaaccccaactgacatttgatttagtgccagtgaagactgtctcatctcccacctgtgtctgatgactcctgtacaatgagatgtgtattctttcactgtgccctgtatgttcaggcgcagtcttactgcctcttttaaacttcctgatgggagctgtcctccaccagcaggacttcccctttacaaaagactcatgtagtcactaccctctctcttctggaccctctccaggagacccctccccttcactcctttcctttggacttccccatctatgtgagcaatcagacttccttcgattacacgaaaggactgctcttaagagttttcacatccaaagctaaccttgggagggggcttcctcatgttatgatggagttgtccttatgtatattattacagttgttttgctgaactttgaagccattctggacgactagaccctgcctgacagctaactctaatataatcactgctcttagaaacaaaattgtttatgataaacttaagcctacaaatttttagtgtgtggtggaatatgttgcagaagatttctctaactgggaatgacttttttttttttttttttttttgagacagagtcttactctgtcacccaggctggagtgcagtggtcctatcttggctcactacaacctccacctcatgggttcaagcgattctcctgcctcagcctcccaagtaactgggactacaggtgtgtgccaccacgcctggctgatttttgtatttttagtagagatggggcttcgccatgttggccagtctggtctcgaactcctgaacccaggtgatctgtctgctttggcctcccaaagttctgggattacaggcgtgagtcaccccgcccagcctgggaatgacatcttatatctgtggcagaaataacaaaagaagcttctaaactaccttaacgtggggtggggtgggtggggacgagccttgtattcgccctgaagccctgatgtgcttgtgttaggggatggccttccaggaagtcattcttactcctgctcattgtggccaaattcttgtgatcaatttgtgtaaccgtctatctcatgggagaaaatacttcagctttcttactccctgctaaatggttttgtgagtaatcaagtatataataaaaccacagtcatcagaaaactcaggtcatgacgacattctggaagataggggttgccagcagagcagaagaaccatattgctcaatcttcgctatttgcaaatttttctaaaacgcattcatctgctttcctgcaaagaaaaggtcagaatgctgaacatgattgatagtctctttatactctcctggtacaaagtaaaccatagtacttgtttctgttttagctgtgatgttacagaatcctaggatggcaaagtagtatagatagggtccagcctatgccaagaaatagtaaaataataatgaattctcctgtcctgagcatgtacatttgccaggcaatttgcatgcattatctcttaaatccttaaagtaggcctgtgaagtagctaccgtaaccaaatagtctagattgcaaatgcatttgaaaatctcttttcctttttcttttttccctagtctcaagacataaccttgaagcttactgcagaaacatttttcctcctccttagccttaaaatatagccttgatgtgtactttctttgaaacaccaagtccctccctttctcgccatacactcccttacaccatgcacatttattaataattgtatgcttgtgtctaattatgtgcttatttagaacttctaagggggccaatcttgagacagaccacgcatagagacccagctgcaagattccagagattctctcaaggaagttagtcaataacgtggccattgttgagatgatgccagccctcactccagatgccagaccgtggctccagatagccatggaacaagacacacagaccttgtactcagcacccatctcgcataatttccattgccagttcccccttttaagcccctcttcccagcctaaggtttgaagtgattacttttaataggaatccagccacttcctcatgactagttttggttaataaagtcactttctttttttgttgttgttgttttaacttttgttttaagttcaggggtacaagtacaggtttgttacataggtaaacttgtgtcatgggggcttgttgtacagattattttgtcacccaggtattaagcctatacccattagtcattttttctgatcctctccctcctcccacactctaccctctgacaggccccagtgtctgttgttctctatgtgttctcatcattcagctcccacttttacatgaggacgtgtggtatttggttttctgttccttcattaatttactaaggataatggcctccagctctatctatgaccttgcaaaggacataatctcattcctttttatggcttcgtggtattccatggtgtatatgtaccacattttctttatccaatctgtcattgatgagcattcgggttgattccatgtctttgctattgtgaatagtactgtaattaatatatgtgtgcatgtgtctttataatagaatgatttatattccttccggtatagacccggtaatggtattgctaggtcaaatggtatttctgtttctgggtctttgaggaatcaccacattgtctttccacaatggttggaccaatttacactcccaccaatagtgtataagcattcctttttctccacaaccttgccagcgtctgttatttttttgactttttaataatagctattctgactggtgttagatggtctggcattgtggttttgatttgcatttctctaatgatctgtgatgttgagtttttttttcatatgattgttggccacaggtgtttctaccataccttgctcttgctattggactctgcaagcagtgagcagttggacctgcatttggttacattactaatgccattcctattttacagaagagaaaagtgagataaatttcaatgtcatttagttggcacaagacttagctggttttaaagcccctgtcactctctgaatccaaaattattgccagtgtctctccttcctttgatgacagtgataggccaaatgatgaccctccaaagatgtctacctcctaatttccagaacctgtgactatgttaccgtacaagtcaaaagagacattacagatgcgattaatgtatggatgttgtgatggggagattattttcaggatcatctgagtgggcctaatacttataagagggagacaagaggttctgggtcagagaaggaaatgtgacaatggaagcagaggctgggctgataaagctatgagccaaagattgctctctagaggctggaaaagtcaaagagtggatgctcccctagaacttccagaggaatgctgtcttgctggcatctgaattttagccctgtaagactcatttcaaacttctgtcctccagaactgtaaaataataaacttttattgctttaagcccttaggtttctggtaatttgttacagcaccgtaggaaattaatacaatgtcctattacactttaaatggactctctgatgataccactttttatcttgcattatatactttttataattatataaattttaaatttttaagctctttttttctctatatctagcaattttttagtgcctatgttataataggcactatacaaggcactttacaaataaaggcttatttaatttttctaacaacctgtggtagagatagctagttttccacatgaaatgtgtacttcccttccatagtaaggagtggtttctagaaattggccgcccaacctgaacaatatttcttgtaagtatccctataagtttatctaggcgtggccatgtgattagtttttgccagtgaaatttgagcagagctgatgtggttagacagcatatatgcctccccaccctacctttccctttccacagcaacttagggaactatgtgttaataatggcaggaccataaagtggtccattttcaccactgtaatcttttacgagcaaggaataaacttcttttgtgtaatcttgtgatacttggggatttatctgtcgcagcagctactggtaaccatactccaactctgtgaagtataacctcatgaagtatgaaggattcacctcatgtttaatgatagtgaaactagggctcagaacaatgaagtagcttgaccaaggtcacaaatttaaaagaggcagaggcagggatgcttaaacagtgaaactagggttcagaactatgaaatagcttgaccaaggtcacaaatttaaaagtgacagaggcagaattctgactccaaagaccattgtatttgcacgatgttacatagcattttattgttcaatagtctgttgaaaatatccatttaaaaaacaataaagtctctgaatcatagatattagacctaaaaggcactttacagattatcttccctaaaatctcctacagtacttcaaagatgagaaaaaggaagcctaaaaatggcaagtggctggcccatgtgatgagacacagccaggactggaactgaagcctccttttcattacctaaattgctcctttagatgagcttgtataggagtcaactctttttcataaatggttttcaaatatttgatataagatcattcatggccataaagacagagttttctttttagaatgaaaaatggaaaaaaaatagttatctttaggaataaaaccctctgaggctattgcatataataatttatctatatattttacagatgtagatatgccatataataattacattttatatatatatacacaaaaaatacagtttttttggtttgtttgtttgtttgtttgagacagagtctcattctgtcacccaggctggagtgtagtggcctgatcttggctcactgcaacctccacctcccagattcaagcgattctcctgcctcagccttccaagcagctgggactataggcgcataccaccaggcctggctaatttttttgtatttttagtagagatggggtttcaccgtgttagccaggatggtctcaatctgaccttgtgatccatccaccttggcctcccaaagtgctgggattacaggcgtgagccatcacgcccggccagtatagttctattcttaatctcttgttctattgagatggaaatatcttcatgttataaaaataaaagtggcagagcactgaacagatggagagttaaatgaatgaactgaggattccacatcttggctgcctgaaaatatgttctactacagtaaacatatttttagcaaacaaataatggcaacccatgtgttgatctctcaccagtattctctagcttggctcatttattccctgaggatagctgaacttctttgcaagaaacagatatttcccacacttttcaagcctcgaagcgaattcgagaatgccagagaactgagtaaaactgtaaaactacacttaggattttgcactgggtgaaatgtctctagtgaaatcaggacatttgtatagaatggaccattctgatttctgctactgtcttaattcattaatttaacatggaaattctaatatgtgtgtaattttctcagaaaacccattatttaataatgacaactctgagcaaacgaggtgtgaaattttaaatatacaatgtgccatgtgttactggtagacccactgcctttgtgattctccatgttaaattttgatttcaatgcagcatcttagcatcaagaaataccaaccctgggatagaactagagggcatataacaaagagtatgcccaacttctattatctgagaattgtcttcaagctctacctgcatactaatgttattcatttgttaacagtttttctgtaaatgacttttaagttgagtcattcttaaaaattaacgactttcttgaggtataatctatgtaccatacaattcattcattttaaatataaactcagtgatttttattgaatttgctgagttattcaactataactgcattcaaattttagaacattttcattatctctgaaaaattccttgtgcccattttcactgctggttcccattgtgggccccaaacaaacaataatctactatctgtccatatgtatttgccttttcaggatatttcataaaaatggaatcatatagtatgtggtcttctgtgcctcacttcttacattccctcagagatgtccattagtctgtccaaccaaaaactggggtcaggtgaatcctgagacttttgcgggagcctgtggcaacccacaggtgaggtcgccctgcatgttccttgattacagtcagatcacagctctacaccaggtccatggagaaagaaagaactgattttgatccttctccatgttcacctatgaaaacctcattacaatgactttaacttcttttacaaagtcaaatttgaccatattctcagaactcaaccagggtcatggcctttgcagtggagtcaatccaaaggcctcactaaaccatatacagtcatccctcagtacacatgggggattggttccaggaccacctgcatttaccaaaatccatggatactcaagtcccttatgtaaactggcatggtatttgcatataacttatacacatctgcccacctctagattactagattacttctagattatctgtaatacctttgtattataatattaataataataattaatattatacaataatttatatacatatacatttatatacatattaaattattataatagtatataataattatatacataatatataattatatacataatatataattatttatatacataggaattataatacctatgtatataaatgctatgtaaatagttgttatataagtgaatattgatgaatatattgacgaacatagatgcaaatatcttcaacaacattctagcaaaccaaattcaacatcacattaaaaggatcatataccatgatcaagtgagatttatctttgagagaaaaggataatttaacatttgtaaaccaatagatatgaatacaccacattaacagaatgatcatctcaacagatacagaaaaaaattttgacaaaattcaacatcctttcatgataaaaagtcatatcaaattaggtatggaagaaatatacttcgacataataagggccatatgcgacgaagccacagtcaacatcactctcaatggtgacaactgaaatctttccctcttagatcagaaacaagacaagggtgcctgttcttgtcacttctatttaacatactactggaagtcttagcctgagcaattagacaagaaaaagaaataaaaggcattcaaattggaaagaaagaagttaaattgtctgtttacagatgatataatcttatgtaaagaaaaccctaaagactccaccataaacttttagaactaatacattcaataaaggtgcaggacacaaaatcaacatatgaaaattagtgtgtttctgtacactaagaacaaattagttgaaaatgaaattaagatatcaatcccaattacaataacatcaaaaagaataatatgtttatgaataaatttaacaaaagaggtaaaaaatctgtatactaaaaactgtaagatattgaagaaataaactatagaagtcacaaataaatggaaagatatttcatgttcatgaatcagaagaatttatgttgttaaaatgtccagactacccaaagtgatctacagatgcaatgcaattattatcaagattacaatagcatttttcacagaaatggaataataaatcctaaaatttgtgtggaaccacaaaagaccttaaatagctagtgcaaccttgagaaaaaagaacaaagtgggaggtatcacactccctgatttcaaaatatattacaaagctgtagtaatcaaaacagtatggtaatgacttagaccaatggaacagattagagagccccaaaataaactcatgtatatatggtcaaccaatctttgacaggtgaaccaataatacacaatgaggaaaggaaaatctcttcaataagtggtgttgagaaaactagatatccaccttcaaaggaatgaaattggaccccttttacaaggctgtttttatttaaaagaaaagaagaaattggacccttgcctttcaccatatacaaaaattaactcaaaatggattaaaggcttaatccattaatcttaaaatctgaaaccataaactcccagaagaaaatatagggaaaaactttctttacattggtcttggcagtgatttttggatatgacaccagcagcacagacaacaaaagaaaattaaacaagctggattatattaaactaaaaagcttttgcacagcaaaggaaacaatcaacaaaatgaaaaggcaatatattagaatgggaaaaaatatttgcgaatcatatatcttataagggactaatatccaaaatgtagaaggagctcaaacaactcaatagcaaaaacaaccaaaaaacttaattaagaaatgcgcaaagcatctaaatagacatttttccaaagaagacctaccgatgaccaagtatatgaaaaagtgctcaatatcactaatcatcagagaaatgaaaatcaaaaccacaatgagatatcacttcacacctgttatgatgggttttatcaaaaagataaaaaggccaggcatggtggctcacaactgtaatcccagcattctggaaggtggatcacctgaggtcaggagttcaagaccagcctggcccacatggtgaaaccatgtgtctaccaaaaaaatatatatataaaaaatttagctgggcatggtggcacacgtctgtaatctcagctacttgggaggctgaggtaggcagaggttgccgtgagccgagatcgcaccactgcactccagcccgggtgacagagcaagactctgtctccaaaaaaaaaaaaagattaaaaagtaacaagtgttagtgtatgaagaaaagggaacccttatacactcttcatggcacaatcattggtacaatcattgtggaaaacagtatggaggtttcttttttaaaaaatagaactaccatgtgatccagcaatcccacttttgagtacatacccaaaggaagtgaaatcagtatctcaaaaagatatctgcaccctcatgttcatttcagcattgattaatgctattgtgattacaatagcgaagattttgaaacaacctaaatgactatcagcagatagattttaaaaatgtgattacacaggcacatgcacaaacacatacacactagaatattattcagccataaaaaagtaaggaaattctgtcatttgggacaacatggatgaacctggaggacgttatgctaagtgacaaagccagatgcagaaagacaaatactatatgattttacttatatgtagaatccaaaaaaagtcaaactcatagaaacagagagtagcacagtggttaacaggggtttgggggtggggaaaatggggagatgttggtcaaaaggtaaaaagttttaagctgtaagatgagcaagttttgggaatctaatatacagcatggatggtgatggatgttttaattaatttggttgtggtaatcattgcacaatgtatccatgtatcgaataatcacattgtacaccttgaatatatacaattttgtcaattaatatatttaaataaataaacaataaataaataaaatgtgactaccagaaagttagaaaaaaaaaaagaagaagggccaaggaaaactgtcaattctgtctgtgtctgggctgggccaggatcactgtatggagtcaaagtaagctgcaggggccacttctggggaaaactcttttatcagtttttttcaagtttcagctttgcacccatacttccatcagaactgaaaaattttgatttcctggaggccaccctaagagtcatgagaataacaaggtcacatggcctagtctgcactggttatgattgggactacaatgcagctatctgatcactataggtatctgatcaaacctctgatgaaatttcctctttgattaaggaaaacattcttggcaaatgttttcttctggttcttctgggctacaagaatttcacctctagctgcacaatgccaagcatccccagttgtacctctaagcctggctccagttctgaaaaccaataaaacagagctgcagtcttattactaattgtgagctttggtatccatgtggtgtgagactgctttgaatattcttttgttttctatttgtttttaacaataaacactctgggccccatgagacactcagctaagcacattaaaaaggtcaaaaggactttgaagagtcaggaggtagaaatagtatgtttttgagcttcatccatgttgtagcatgtaccagtatttcattaagttttattgctcagcaatgttctgttgtatgtatgtgccacaatttaattatcctttcaccaactgacattgtaattactcattcaccatttggtgggtattagaattgtttccccttttgattattatgaataaagctgctatgaacatccatgtctaagtctgtgtgataaatatatgtcacatttctcttgaatatatacctggaaatacaatcactggatcatatgttttaagtttatgtttaattaaaaaaaaattccaaacattttcagtgtacttgcactattttaaattccccctaacaatgtctgaataattcagtttctctacatcctcgcagcatttgctgatattattgttttttattttagccatttttaggggtgcagtaatatttcattgtagctttaatttgtgtttctccaatgactaatgatgctgaacatcttttcacatgattatcagccatccgtacatcttctttaataagtgtctgtttaggtatttgcccaattcctaagtagactttttaaagtactgagttttgagagttctttatatattctagatagaaatacttgtcaagtgatttacaagtattttcttcaagcccataatttgtcttttatccttttagtagggtagttcgtagagcaagaatttttaattttgattatcgctgataaaaacacactaatttttcctttaatagatcaggcacttagtatcagatctgaagactcttcactcatttctaggtcccaaagattttcccctatgtttctttctaaaaggtttatagttttgcatttctcatttaaatccatgatatattttgtgttaatctttgtataaggtgtggagtttaggttggggttttttgttgttgttgttgttgttgttgttgtttgccaatacatgcctacattagtcagcttgggctgccataataaaatattgtgcagtgggtggtttaaacaacaaaaatttattttctagcagttctggaggctgaaagtttgagatcagggtgccagcatggtcaggttctggtgagagctcgcttccttggcttgcagatggccttctcactgtgtcattacatgctgaggagtaagaggtaggagagagggcgcagggagggagacagctctcccttttcttataaggccattaatcttattggattaggattccacccttataatcacatttaaccttaattacctcccaaaagcctatctcaaaatacagtcacattgtgagttacagcttcaacatatagatacggggaaaataaaattcagaccatagcaatgtccattgttcactcctgctccacgtagaaaaggctatccctcttacattgaattgctttcaaatctttgttaaaaatcagttgagcatatttgtatgggtctatttctgaattctctatgctgtttcattgatctatgtgcctttctgccaggactacatattgattactgcagctatatgttaagctttaacatggagaagactgattcttcataattttctttatcaaaataattttgggccgggcaaggcggctcacgcctctaatcccagcactttgggaggcctaggcaggcagatcacctgaggtcaggagttcaagaccagcctgaccaacatggtgaaaaccccgtctctactaagaatacaaaattagccaggcgtggtggtgcatgcctgtaatcccagctacttgggcggaagaggcaggagaattgcctgaacccgggaggtggaggttgcagtgagccgagatcgcaccattgcactccagcctggggaacaagagtgaaactccatctcaataataataatatattattattattatataattgtatgtatatttttatatattatatattataatagtagaataatactattttattattattattattttgggcgttctagggcctttttatttttatgtaaattttaaaataagcttgtgtctacaacaccatgttggggtttttataaggattgcattaaatctatagatcaatttgcagagaattgacagctttatcttgttcagttttccagtccatgaacacggttaagcatctcttaggcttctaagcaagcctaaggccttgctttgatttctttcatcagcattttgtgattttgagcatatagctcctatacatgttttgttagatttatacttaagtatttaattttctttggagcaattataaatagtatgcttttgatttcagttccatgttggcatatagaaatgtaatttattttcttgttaatcctgtgaccttgctcaattcacttattagttccaggaaggggtttttttggtggatttcttgggatttttgatttaggaaattatgtcatatttagacagagaaagtttaattccttccttttcaatctgattgccatttttttcttgtctattgtgctgcctggaacttctagtaccacattgtatgagaatagtgatactgaatatccttgccttgttctacatcatagagggaaagtattcagtttttttactgttaaatatgatgttagctgatactgatttgattatataatctgtcttcattagcctattaatatggtgaattacatctattgattttaaatattgaaccagccttgcacaagtggaataaatcccacttagttgtgatgtattattcttattacatattgctggacctgattttctaggttttttttgagacagtctcgctctgtcacccaggctggagtgcagtggcacaatcttggctcactgcaacctctgcttcctgggttcaagcgattcttgtgcttcagcctaccaagtagctgggactacaggtgcctgccaccatggctggctaacttttggatatttttagtaaagacgggttttcgccatgttggccaggctggtctcgaacccctgacctcaagtgatctgcctgcctcggcctcccaaagtgttgggattacaggcatgagccactgtgcccagccctgatttgctaaatttttaatgaggtttttgcatataagttaataagaattattggttcatagttttttttttttgtaccgtatttgcctgatttcatctcagggtagtaccaaactcataaaatgaccatgggagtgcttcctcctcttttattttctgtaacaaattgtataaaattgtattaactctttaaatgtttgatagaactatccagtaaaaccatatggtcctgaaaattttctttatggaagctttttaattacaaatacatttctttagtcgtatagggctagtcaggttatcctctctatcttggtatgttttgtaatttttgggattttgaagatttggtccatttcttctaagttgtcatatttatgatgaaaaattattcataatattttcttatgttttttaatggctgcagggtctgtagtcatagcccctatttcattcctgatattgatgattcatggttttttgatcattttatctttttcagtcttgctaaaagtttttcagttttgttgattattttcaaagaaccagttttttgtttcatttattttttcctttgttttcctgtttacaatttcatttattgcttctcttcatgattttcttccttttgatcttctttgggtttattttgctcttcttttctagtgtcttgagataggatgatatggcttgaatatgtgttcctgccaatgccaaatctcatgttgaagggtaatctccaatgttaggggtggggcctatgggaggtgattggataatgggggtggatttctcatgaatggtttattagcactatctccttggtgctgtcctcataatagtgagtgtgttctcacaagatttggtcatttaaaagtgtgtagctccctctctccctctctttcttgctcatgcttttaccacatgatatgcctgctccaccttttccttctgccatgattataagcttcctgaggcatccccagaagcagacaccgctatgcttctcatacagcctgcagaaccgtaagccaattaaactacgttttttttaaataaattacccagtctcagatacttctttacagtagtgctagaatgacctaggtattgagttgagatctttccactttactattataaatacttagtgctataaattttcctctcagcactgctttgactgcatcccccaaattttcatgtcttattattttcattcagttctactttttaatttccttttagatttcctctttgaaacatgaagtagttgtttaattttcatagatttgaataattggctgttgtctttctgtaagtgatttctagtttgattttactatgatcagagaagtatatcccttcttatttccctccatctctcctcaccctcccatactccttcctttattccaggttacaggcttctccaatgcctggaaaaaaccaagaaacttacctcaagaaatatctacctttttttttttttagatggagtctcactctgttgccaggctgaagtgcagtggcgcaacctcagctcactgcaacctccacctcctgggttcaagcgattcttctgcctcagcctcctgagtagctttgactagagtcatgtgtcaccacgcccagctaattttttgtagatttagtagagatggggtttcaccatgttggccaggctggtcttgaactcctgacttcaggactaccggcgcttgccaccatgcctagctaattttttgtatttttagtagagatggggtttcacatgttagccaggatagtctccatctctcgacctcgtgatcggcccgcctaggcctcccaaagtgctgggattacaggcatgagccacagcgcccagcccagtctaccttcttttttacacctttcagagacctttcatgattgcctgctgaattattttaagggtagttaattgtatttaaagaggaggaacagggaaaagtgtgtttatgccatctttacaattgatttttatatattgattttctccctctcctgggacttttactatctatatttgtatgcatgaggactttcttatgtctctgaggctctatcctttctcctcctccttctcctccttcttttctctttttttttttttttttgctcttgagattggataatttctactgatttatcttcaagtttgctgatttttttataagcacaaatctgctgttaaaccttctttcataaattttttatttcagttattgtacttttcaactgtagaattttcattttgtgtttttaaaataatttttatttattgacattctctatttgatgagtcagtattgtcatacttttaagtctttaaagatggtttcctgtagttctgtgtaaatatttatatgtactgctttcttggctaagtccaaaatctggaccctcagagatggaatcttttttctgctttttttcctattgatggaacacgcttttctatttctttttttttttttttgtggataacttgatattttgaaaatatattgtaacaattctgaattctgattcccccagggtatctgttgttgttgttgtttttatgaagaaagaggtttaattgactcacagttccacaagctgtacagaagcatggctgggaggccttaggaaacttacaatcatggtggcaggtgaacgagaagcaagcacgtcttaccgtggcagagcaggagagagcgtgcaaagggggaagtgccatacacttttaaaccatgagatctcatgagaactcactcactatcacaagaatagcaaaggggaaatctgcacccatgatttaatcacctcccaccaaacctcttctctgacatgtgaggatcacagtttgagttgagatttgggtggggacacagggccaagctttatcaaccaccactgcagttggcagtgttcagcagataacaagacacctgagaggtggaggcatgagaggcatcttgtctcctctagctcctcatgccttacacaacaggagagcccagtctgtttcatattaaggaagaaaacatgggaaaagctactaaacaaatgattaaaaactgaaatcaagacagctgccattacaagccatttgaaagcccccagagttgttaaatctcaggctgggaaaggagttctgttcaccgtcacttcactcattgcctcactaaattttctggttttttttttttttttatactttaagttctagggtacacgtgcaaaacgtgtgcaggtttgttacataggtatacatgtgccccattggtttgctgcacccattaacttgtcatttacattaggtatttctcctaatgctatcccttccccgtacccccccaatgacaggacccagggtgtgatgttccccaccctgtgtccaagtgttctcattgttcaattcccacctatgagtgagaacatgcggtgtttggttttccgtccttgtgatagtttgctcagagtaatggtttccagctacatccatgtccctgcaaaggacatgaactcatccttttttatggctgcatagtattccatggtgtatatgtgccacattgtcttaatccagtctgtcattgatggacatttgggttggttccaagtctttgctattgtaaatagtgctgcaataaacatacttatgcatgtgtctttatagtagcatgatttgtaatcctttgagtatatacccagtaatggaatcactgggtcaaatggtatttctagttttagatccttgaggaatcaccacactgtcttccacaatggttgaactagtttacactcccaccaacagtgtaaaagcattcctatttctccacatcctctccagcatgtgtgtcctgacgttttaatgatcgccattctaactcatgtgagatggtatctcattgtggttttgatttgcatttcgctgattgccagtgatgatgagcacttttgttggctgcataaatgtcttcttttgagaagtgtctgttcatatcctttgccccctttttgatggggttgtttttttcttgtaaatttgtttaagttctttgtagattctggatattagccctttgtcagatgggtagattgcaaaaattttctccctattatgtaggttgcctgttcgctctgatggtagtttcttttgctgtacagaggctctttagtttaattagatcccatttgtctattttggcttttgttgccattgcttttagtgttttagtcatgaagtccttacctatgcctatgtcctgaatggtattgcctaggttttcttctagggtttttgtggttttaggtttaacatttaagtcttcaatccatcttgaattaatttttgtataagatgtaaggaagggatccagtttcagctttctacatatggctacccagttttccctgttagccatatgtagggatttattaaatagggaatcctttcccgaagtcttgtttttgtcagatttgtcaaagatcagatgtttgtagatgtgtggtgttatttctgaggcctctgttctgttccattggtctatatctctgttttggtaccactaccaggctgttttggttgctgtagccttgtagtatagtttgaagtcaggtagggtgatgcctccagctttgttctttttgcttaggattgtcttggcaatgcaggctcttttttgattccatatgaactttaacagttttttccaattctgtgaagaaagtcattggtagcttgatggggaatggcactgaatccataaattaccttgggtggtatagccattttcatgattttgattcttcctatccatgagcatggaatgttcttccatttgtatgtgtcctcttttatttcattgagcagtggtttgtagttctccttgaagaggcccttcacatcccttgtaagttggattcctaggtattgtattctctttgtagcaattgtgaatgggagttcactcatgatttggccctctgtttgtctgtttttggtgtataggaatgcttgtgatttttgcaacattgattttgtatcctgagactttgctgaagttgcttatcagcttaaggagattttgggcaaacagggacaatttgacttcctcttttcctaattgaataccctttatttctttctcttgcctgattgccctggccagaacttccaacactgtgttgaataggagttgtgagagaaggcatccctgtcttgtgccagttttcaaagggaatgcttctagtttttgcccattcagtatgatattggctgtggatttgtcataaatagcgcttattattttgagatacgtttcatcaatacctagtttattgagagtttttagcatgaaagactgttgaattttgtcaaaggccttttctgcatctattgagataataatgtggtttttgtttttggttctgtttatatgattatgtttattgatttgcttatgttgaaccagccttgcatcctagggatgaagccaacttgatcatggtggataagctttttgatgtgctgctggatgtggtttgccagtattttattgaggattttcgcatcaatgtttatcagggatattggtctaaaattctctttttttgttgtgtctctgacaggctttggtatcgagatgatgctggcctcataaaataagttagggaggattccctctttttctactgattggaatagtttcagaagtaatggtgtcaactcctctgtgtacctctagtagaattttgctgttaatccgtctggtcctggactttttttggctggtaggctattaattattgcctcaattttggaacctattatttgtctattcagagattcagcttcttcctgatttagtcttgggtgggtgtatatgtccaggaatttatgcatttcttccagattttctagtttacttgcatagaggtggttatagtattttctgagggtagtttgtatttctgcgggattggtggtgatatcccctttatcattttttattgcgtctatttgattcttctctctcttcttctttattagtcttgctagcggtctatcgattttgttgatcttttcaaaaaaccagctcctggattcatggattttttgaagagttttttgtgtctctatctccttcagttctgctctgatcttagttatttcttgccttctcctagcttttgaatttgttttctcttgcttctctagttcttttaattgtgatgttaaggtgttgattttttatctttcctactttctcttgtgggcatttagtgctataaatttccctctacacactgctttaaatgtgtcccagagattctggtacgttgtgtgtttgttctcgttagtttcaaagaacatctttatttctgccttcatttcattatttacccagtagtcattcaggagcaggttgttcagtttccatgtagttgtgcagttttcagtgagtttcttaatcctgagttctaatttgattgcactgtggtctgagagacagtttgttgtgatttctgttctttcacatttgctgaggagtgcttgacttccaactatgtggtcaattttggaataattgtgatgtggtgttgagaagaatgtatattctgttaatttagagtggagagttctgaagatgtctattaggtccgcatggtgcagagctgagttcaactcctggatatccttgttaacgttctgtcttgttgatctgtctaatattgacagtggggtgttaaagtctcccattattattgcgtgggagtctaagtctctttgttggtttctaaggacttactttgtgaatctgggtgctcctgtattgggtgcatatatatttaggatagttagctcttcttggtgaattgatccctttaccattatgtaatggccttctttttctcttttgatttttgttagtttaaagtctgttttatcagagactaggatttcaagccctgcttttttttgctttccatttgcttggtagatcttcctccatccctttattttgagccaatgtgtgtctctgcacatgagaagggtctcctgaatacagcacacggatgggtcttgactctttatccaatttgccagtctgtgtcttttaattggggcatttagcccatttacatttaaggttaatattgttatgtgtgaatttgatcctgtcattatgatgttagctggttattttgctcattagttgatgcagtttcttcatagcattgatggtctttacaatttggcatgtttttgcagtggctggtaccagttgttcctttccatgtttagtgcttcctttaggagctcttgtaaggcaggcctgctggtgacaaaatctctcagcatttgcttgtctgtaaaggattttatttctccttcacttaggaagcttagtttggctggatatgaaattctggaatgaaaattcttttctttaagaatgttgaatattggcccccactctcttctggcttgtagagtttctgcccagagatctgctgttagtctgatgggcttccctttgtgagtaacccgacctttctctctggctgcccttaacatttttttccttgatttcaacttggtgaatctgacaattaattgtcttggggttgctcttctcgaagagtatctttgtggtgttctctgtatttcctgaatttgaatgttggcctgctttgctaggttcagaaagttctcctgaataatatcctgaagagtgttttccaacttggttccattctccccgtcactttcaggtacaccaatcaagcatagatttggtcttttcacatagtcccatatttcttggagcctttgttcatttctgtttactctttttttctctaaacttctcttctcactttatttcattaatttgatcttcaatcactgataccctttcttccacttgatcgaattggctattgaagcttgtgcatgtgtcatgtagttcttgtgtcatggttttcagctccatcagatcatttaaggtcttctctgcactgtttattctagttagccattcatctaatcttttttcaaggtttttagcttccttgcgatgggttcgaacatcctcctttagctcagagaagtttgttattgccgaccttctgaagcctacttctgtcagctcatcaaagtcattctccgtccagctttgttccattgctggtggggagctgcgatcctttggaggagaagaggtgctctggtttttagaatttttcagcttttctgctctggtttctccccacctttgttgttttatctgcctttggtgtttgatgttggtgatctacagatggggttttggtgtggatgtcctttttattgatgttgatgctattcctttctgtttactagttttctttctaacagtcaggtcctttagctgcaggtctgttggagtttgctggaggtccactccagaccctgtttgcctgggtatcaccagcggaggctgcggaacagcaaatattgctgcctgatccttcctctggaagcttcatcccagaggggtacctgcctgtatgaggtgtcagtcagcccctactgggaggtgtctaccagttaggctacaagggggccagggacccacttgaggaggcagtctgaccattctctgagctcaaacaccatgctgggggaactactgctctcttcagagctgtcagacaggtatttttaagtctgcagaagtttgtgctcccttttgttcaggtatgccctgcccccagaggtagagtctacagaggcagtaggccttgcggagctgcagtgggctctgcccagttcaagcttccccagccgctttgtttacctattcaagcctcagcaatggtggttgcccctcccgctgccaggctgctggccaatcttagactgctgcactagcagtgagcaaggctccatgggtgtgggacctgccaattcaggcaccagatataatcttcaggtgtgccatttgctaagaccattggaaaagtgcagtatttgggtggaagtgtcctgtttttctaggtaccatctgtcacaacttcccttggctaggaaagggaaatcccttgaccccttgtgcttcccacgtgaggcgacaccccaccctgcttcggctcaccctccatgggctgcacccactgtccaacctgtcccaatgagataagccaggcacctcagttggaaatgcagaaatcacccatcttctgcgttgatcatgctgggagctgcggactggagctgttcccatttggccatcttgtaatggaatccatttgttgttgtttttgtttgtttctttattttttgaattaattctttttttttttctttttggaagtgttgttttgctcttgttacccactctggagtgcagtggcatgatttcggctcactgcaacctctgcctcccaggttcaagcaattcctgcctcagctttccgagtagctggaattacaggtgtacaccaccgcgcacagctaatttttgtacttttagtagagacggggtttcatcgtgttggccaggctggtcttgaactcctgacctcaggtgatccacctgcctcagcctcccaaagtgctgggattagaggcgtaagccactgtgcccagacattttttgaatgaattctctggagtctgtttctctcatagtatagtctctgctggctgctcagctgctctctaaaaaattgtttaaaaaattttacatctggctttcatgggttcactgctgagttggcatagctcagtggccagccaataattcatcagaagttttgcttaaacacctttgccagggtcaaaaaggcctctaccctttgaatctcatcttatgagttatgatgagtgtataaatcagtgttcaatcacagaaacagaaccagtaagatatatctatctatctcaataaatatattaagagatttaatgcaagcgattggcttaagttattgtaggggcaggctagacaagccaaaacctgaaggacaggctatgagaagagaagcctggaaatctagggaataagctaaagcttctgtacatagaaagagtttcttcttcatcagggaagccccagttctgttcttacagcctttcaactgattgaatcaggcccactcagaagagctgggataatctccctgattcaaagtcaactgattatggactttaatcatatgtataaaataccttccacagcaacacctagatttgtgtttaattgaataactggggagtataggctagtcaaataggtaaaatagaatcacagagagccattgaatggtttaagcaaggtagtaatatgatcatgcttgctttagataaatacaccctctggtggctaggtagaggaagaaggagctggaggttcttgtaatagacaaattaaagagatattaattgcctgaattagcactataacactgagtttgaagaggagggttgaattaccataaatattttgaaagtaaatatttataaatgtatttatatataattgtaggttcagttacacagacagtgtagggttggtatatagagtaagagtaatactctgtctcacattttacattacatccgtctaccgatcatctattaacctcttggagttgccattttcttatctgtacctttttccctcaataaatacgtttttttccaagttctgacaataagccccatgctgaaagccctggttatctgaattgccttccatttatccttgtatttcctgcacaaaacaaagaccacaggaagtgagttagaatactctggaagatgagcatatctcatttccttaggagtatattgcaaaaacctgtctaccgaaaagtaacacttatggactgactaaatgcatgcccaagcttagagaagctgcaagaacaggagtaagcaatccaagaggcccaggtggcctagaatgcatcaatttgtatttatcagtaggagctctgctcctggatgaatgcaggagttgaagctgactctgcttccctgcccgtgcttctagagccttttgtgggctcctgtgttagcagtgccaatgccccagagaaatcaatcacaagacctgaatttgagtcctcctgtttctttatgtggtcctgggaggtggcaactctaaactttgggacaaaggacaatctccaactaccgctgaccttggactgctaagtttcaagggcaagatacatagaaaatgaacctgaacaaatggtttcttttcattatcagctgtgatttgaacctaatttctctgtagagctcttagtcccaatgagcagaactgggaaaatgttaaggactctctttgcacttttagcttaaggtctaggctaggaaatgcctcagaagacaaatgaagcctcccttcccctgatcccctatgttgtggtacccttgtggtgtctacttgaccttcccaggacatggataccccttccttagcctcatgagagaagagatatttccaaagccaaatgtagaagacaaaaaagggaaagctgaagatctaacattcagattccagggttgttttttttttaaatcattttccttatcacactgaaatctctgctccaaccctgagcctctatcctccttggtcttgatccaaatcagtactttagtgctccacagagacggagtcggggcgatggagggggtagtcttggcctctctctagaggctgcctttcccccaaaccctctctaactgtaactaaatctgtttgcttgtattagtggagaaattgagtttcagaaatcattatgcagttcatgtgggtgctaacatttaggtaagctgcctgacagcagagctataacaaatcattgcttattgctatgctgctctgtagagtcctgagagaaagagtctataggctgctgtgtgtccttggggcagccagagccacagcttttgcctttcagtggctttgtgcaggttgctgtcaatttttttagagggacccctctgttcaccaccaaacccagcccaacccccttctgtgaagtcttcaccgcccccattgctgctcccccagcaaaagtataatgaatcacctccctcctctgccattgctctaatagcactcttttattattgtgcttcaagcatgattgttttcattctttactgagctactgtctgcttaacactagataggttatttaagccttaaaagagattctctctgccctcacaaaagtccacagtctttagcatgactcatctgccagcctcatcttgtaccatgcctccctcactctctgttaacttaacttcaggcaatggggagccagggaatgtttcaaagcagaggagaaacccaatcatgtttgtgctttttccagatgactctggtggtaatggaggatgcaatagttgggaggaagaccggagtctaagttactgtaaagtggttcttatcatgtgaaagatgatgaggttggatccagcacgggggcagtcagaatagagaatacatatactttgattctaatatgtttagtatttttcatgtaaaaaatgccacttagatctcttaatcagcaaaacaggaaaggaattgctgtgtatggatgaaatgagataggggatgaacagcacctggcatgaagcctggcgcatagtcggtgctcaggaactgcttcttgtctgctcccttccacctgcagcaggcacagctctgggctctcatccttcttctggaggagagaagaagggagaaaagcgatgtggcagcaaaccagggcagcgacctcatcagttacaggtgaaaaagatggacctaaattgttcgagcaaatgaatgaatggccttactgctcttgcagaccagtggtatatctattcatccaagattcagattttaactaggaacagcaggaggataagtttctacagtaaagacagttgttagaattcacagagcagagaagctctttaagagacaagattcctgatagtcttttcacgaggaagaagaatattgattacaagagaaggttctatgtgtgttaggccctatgccctctcctgcctcaggagaggagaggatgccctgtgagcatcagttccatttggtgatctttttcatttctccctgtttccttcattcatggctgcttcaagccaggacaaggcaaaataaagaaattctgaccttcagcaacttctttatgctctcagaatctgctttttcaatctgtagtttagaaataatcatatttgccccacaaagtttttgttagaattgaggcagaggaaaagaagctctgcaacattatatatccaccttaaatccatgcattggctacagaggttcctccaaaaacactgaacaggttgcttaacttaaaatataattttatatatatatataaaatatatatataaaaggaaattgctaaatcaaaatgaaaaaaaaaaaagaaaagggcttctcactgcccttaaaaaagtcagcagtcgacagcataactcatctgccagcctcatcttttaccatgcctccctggctgtctgtgctttggctgtattggcctttgtcatttgtgagagatgccatgctcttgccagcctaggcctttgcacatactgtacccatgcctggcacattcttgcctcttctctccacctgaccatctcttatccctcttttagaattgatatggtttggctttgtgtccccacccaaatctcatctcaaattgtaatcgccggtgttgagagagagacctagtgggaggtggttggatcatggcggcagtttcccccatgctgttattgtgatagtgagtgggtgagttctcatgagatccgttggttttacaaggggctcttcccccttcactctcttttgactgctgcatgtaagatatgcctgcttccccttctgccatgattgtaagtttcctgaggcctccccagccatgcagaaccgtgagtcagttaaacctcctttctttataaattacccagtctctggcagttctctatagcagtgtgaaaatgggctaatacaaggatccaggttaaattcacttcagtcatttaaatcacaaatatttattgagtgcctactatgtgccaggcacttttctagacaatggggaaagtagcaaataggaaggcaaagtcctatgaatctcgtattctagcactggggagacagagggaaaacaagcaggcaatgaaggaacaagataatgctttaacggtggtattgagaggcaatacaagggtaatcagatgggtcaggccaggctctctggagggtggtggttgggtgggagagggtggtatacattagattagatcacttcttagtgatatgagctgtgagctgaaagattaaaaaaggatactcccaagagaggtagcagcaaatacaatggcctgaggcagagatgagctttgtacagtcaaagggaaaaaaggtcatggttcctagaacactgtgatggagttagagaagcataagataaatcaaagaggtgggtggagcagaacatctagggccttctaggccatgggtcagggctcagatattaagtctaaatggaagctattggagcattttaatttacacttacatttaaaaaatattaccctggatgctaaatggagaatgcctggtagaaatgacagggagaaatcacagggtggcagggagagggagagggagttaggaggagtggcaaaaacttttggatgatctgtacaggatgcaatgtggagatattggtgactcagatgatactacccttgaggggttaatatcaatatcttcatctggtagataagggaattgaagagaagtggggtacactttggaattaaatcctatagatcttgttcatggattgggtggtaaaggtgaagaaaggagatgagacaataggaagagcaaggaaggaaaacacgctggggagaaatgaagattttggcatctgctatattaaattactttcttatggaagacttccctgatccccagtcctggttagagctttacattggttgctcccagagcaatgtgtagctctcctttgtaacactccaaacattttatcatttgtcattatttgttccttcactagacctgatgggaggaacccacctttcttgtttaatgctatctctccagtgctttgcacagtacctggcatgtaattataatataatataacaaaacatattattataataatctgacatctaatataataatattaataacaaacaacacttaaagagtagtttctctgtgtcaggtcctattctgagtgctttacaggtgattttcacagcagtcccctgaaatgggtactgttatgtttgacagatatgcaaactgaggcacagagagagtaagtaaacttgaccaaggtcacacagctagcaaatgccaataagtgaatattttacaaacgatacattgtttatagttcacaccaccacagtgaggtatgtttttgtgttcctattttaggtttgagcaaagtgagacataaatctgtttgaggtgttgatactgggaagtagggttggcaggatttgaactgtccagagacaggctcactcagtttgtgaatgttgagagcgttcactgtggggccaagctgactcagtctgaaatgtgtccctgccacttactagctaggcatgtgagactttggctgaattaaatgctttgtacttcagtttcttcatctgtaaattgacactattaacagtgcttgtcttcaggaggactggatgtaatatttgaagagcccttagaatacatgtagactttatggaaaggacctacagtttgcctatagataaagccaaggaaggaaggtccactgctccccaagtcttctccacgggtcattcatcctggattaagatgttagaactaaacaatcattgtggttacggttgacactcatctaattcactgcctccgttcattatatagataaataagctggggcgtgctgcgagggtaagtgaatgagatgggacaaaatcctggggagcctcccggaaaaacatgataccttctgtatgttcgaggtttcataaagatgagttatataatctccagagctagaaaatcaggcaggccctttttgtgattgaaagaaaaaccttcctaatcatttctaagacaagctctcaattttctttgatttgggaatcaaagagaacagggaatattatgctcttcactgatgttctattttttttccttctgccaatcaaaaaggaggcctaggcagcgttgattttttttttcttttactctttcttccagacctctggtggaggtgttaataaaaagtgaatcagtcaaatcccagcttatcaggaggagacagaaaagggataaaaattcagggtagtcaagcgccacataatagggattacctattttgaagctaatttgacaataaggtgtctgaaaagccagtcttcccatttctttaaagtgctttgtctgagttgtatgcctttctgtcaggcagtgaactaactcaatgacgtcagacttcgtttctacttccaaaacataagtggtaacttacccagtccctggtccactgagcaaatctggcttcaaaaagaaactgtcctgatctgacacaatccaagtcaaaatatttgaaaccctatttgaaactgtggtctggcataatccacatgattcagggctaggttctcataaactgactcaaaaaacatgcaatcttctggtagaacttttgcccagggctggtaaacatgcaaattattgcagtcttttcagaaagtaatttggaaaaacagatcaagaaggtttaaaaggctcatatcttttaacccaggcttgagaaaatattcagagacaggactgagttttatacacaggttcttccttgaagcactatttgcaactacaaaaacaaaacaggaatcaaagaaaatatccaataattaacaaattgcttacatcatatttcaatcattccaatatgtgttttcttaaaagaaatgtttagtggcatgtggaaaacattcccaacatgcacaaagagagagaaaacccagggttacaaattacaaataatatgattttaattttttaaatcaatcccatccatccatccatccatccatccatccatccatccatccatttgtccattctttatctctttatctatctaggggatataggcctagaaaaataactgaaaataaataaatatgttaacagtaattatcccagtatattggcctctttagtatttttcatctttgcacttttccatattttccaaatttcctgtggtgaccatgtcctactttataataaggaaaagaatgataaagactatcatttacagaaacaagacagcccttatctcttctttgaactgcaaaaacacctaacaacatattctccttctccttcaatttgtgtgctacacgagctgccatattgatttttctgaaccattctttttattataacatcctttcccttaaagattctctggctcctcactgcttatataaataattgttaaactacttaacctggctttcccggccttcagaaatctggtcctgttataccatctgtggatttttattagtattttttctccttaaatctccattcaacagatatttatgaagcaccagctctgtgctaggctggcttttctcctcacctcccaaattctccacaagtggcctcttccctggcccagcctcatgtgctcccacctgtaagtctctgttccttggcatgctccttattgcacccattgcaaaagatgcaatgtgtgtgcaccatcctctcagagacttctgtttatccacccaacttgggcacatgctctagggacttaggcaagtgccttaatccctcattgccttcatcttcccatttgtataatggaaactacagtggcaatatgtaatctattcatttgttgtgaagatccaaagagctgatatatgtaaaatgcttaggacagtgtctggcacaatgtaaaagctcaagaaacatttcttatttgtcttgtaacttccttcaaggtaggatcctagtctcattccaatttacaactcccatggaacctaaccaccttgctctgtctctagttggatactgaagaaattcttgttgagtaatgtatgaatgaatggcagctgctatagactgaaggtttatgtctctccccactattcatatattaacaccgaatccccaatgtgatggcatttagagtggagactttgggaggtgattgggtcctgagggtataatccctcataataggatcagtgttctgtaggaaacagcccagagagctccctaaccccttctactgtgtgaggatgcagcaaaatggccatctatgaaccaggaagcaggccctcaccagacactgaatctgtcagagtcttgatcatggacttcccagcctccagaactatgagaagtaaatttctgttgtttataagccaccctgtctatggtattgttatagaagcctggatggactaagacaaaatttatatgagcttttactgaccatgtatatcccttctccttttggacactctgtccctgactataaaccgtacccatatcattcatcacttgtgtggtcaatgttggtgctattcattgtgattatggtcaaaccctctgctgtagctgtacaacttggcatcagatttcttctgttcctgaagcattgtggtggtagatgcttaataatcttgctcacagatttctatactgttcccatttttccatagcaagttgcagaatagctaccttatgttttccaaccttaattttcttggccacaagcctgaaggaaattacattaagtctttcactttaagcccatgcattgcattatcccagatgaatgcactaattcatttgaaaattagagaaaaatagacaaatgatggtataaaaaaaaaagtaactgatttatttagggaccactatttgccaggttctgcaataatccctttcatacagttatcctgttaaaaatgtgaaacacatttagaagctgtgtgaccacagtcaaatcaagttgttccctctaagctttggcttgagctttcccaggctgtactattgcctgcccaaatgccgcttctgttttctgccccatctgtcaacagtcttctagaaaattctatttacaaataaaaagtagagttaattatttcctatttcaaacctattcttccttctatgtccctgccatccattcagctgcccaagtcagaaacttaggagtcacccacccacctttcctacccccacatgactgccctgactacaattcaggccactttcatgtctcatctgctttagggcaacaacctcctaattggtccccctttcataaccccttcttggctgatctaatctacttttctcattgtagccatgatctttgcaaaataaaaaagtggccctgtcactctctggcttttaagccctcaacagctcttcatgaactccataagatatcatctagcccctgcttctctctcaagttttatcttttcaacccatcagtttttcggttatatactttgaattttatgtgctacatgagaggttctcaaagtgtggttgtaggaccaatggggtttccgtgccctgtcaaggagtcttaggtcgaaactattttcataataatactaacatatcatttgctttattcactttcattttctcatgagtttatggtggaattttccaaaagctacatgatgtgtgctattgtaacagatggaatgcaaaagtagatatgagaacccagctaactgtctttgattaagccagacattacagagatttgcaaagatgtaaatctataccagcttctcactatttttttttgaaaaatatacttgttttttataaaagatatttttgttagcacataatgcataatgggtttattattattttaaattaataaatatacagatttaaaaatgtttacagtttcaacatttaatatggtaaataccaagaaatatatcccacatgaacaaaatattttgagggtgcttaataatttttaatattacaaaggggtcccaagactagaaagtttcagaaccactactctagcagtggaaccattcagagcaccccagaatatgttctgtcactttctctcccagcccactcagtgcttctccatcaccataatggtttctctctgcttcttctctgtctgctgaattctcctgcacaagagtcaccacttagtgaaagcattcctttgagctttacaagagtagctacaaggctgacttttgctgaaggcctcttgtatgctaagcaaataattgctttacctgcattttctcctccttttttttttttttttttttttttttttttttttttttgagacagggtctcactctgcctcctggactggagtgcagtggcacaatcttggctcaccacaacctctgcctcccaggctcaagcaattctcctgcctcagcctcctgagtagctgggattacagacacgtgccaccatgaccggctaatttttgtatttttagtagagacggggtttcaccatgttggccaggctggtcttgtactcctgacctcaaatgatccacccaccttggcttcccaaagtgttgagattacaggtgtaaaacatcatgcctggcccactttttttgttttgttttgttttgtttttttgagatggagtcttcctctgtcccctaggctggagtgcagtggtgcgatctcggctcactgcaacctctatctcccggtttcaagcaattctcctgccttagcctcccaagtagctgggattacaggcacgtgccaccacacctggctaacttttttgtatttttagtggagatgagtttttgccatgttggccaggctggtcttgaactcctgacctcaggtgttccgcccacctcagcctcccaaagtgctgggattacaggcatgagccaccgcacctggccttctcctttaagttaggctgaggcaaggccagggagggtcagggaggaggaaagataacatcagttctagtctagacctaagaaaacttaggctcagagaggtttagaagctgctcaggtcacagagctagtgagtggcacagttgatttgaattcatcctcttcccactcagtggttcttatagttctatgtgctatggtgtgctggtgaataataaacaactggctctccaataggacaaagccctcattagtagtgtttggcaatttccatggtgtaaatgctcctgcagtggccagtttcaggccgccaacatgacatcattgaacagagagatcaaaaggggtgtgcagtcgtccacatcatagagcattttcaccacacacataaaaatgatgaaaaactcaagagcacaggtaatagttaagtgtggtaaagtaattgggaattacagtgatgaattctgagtattttgaatttgagcatatttgttttaaatataatttctgtaattataagttgatctaatctacttgtttataattgttaataattgcgtgtttagcaaccaacttgcataattcccaaatatgtaacaattgactcttggacctcagaattaactttcaacctttggacatcacagatgtttgagccctcttccaaacctactgaagccacctctccatgctggtgtccaggcagctgtgtttttaccaagccctccaatctcatctcatcatgcacacagagagtcatttgttcattcttccctcattcaccaagtcagcacacattgactaaaggcctacattatgtcagatactgtttcaaggtgcctacctcatggtccacattcctaccagacggtatcctcatttagagcagggatggagcctatctcccagagcttggtgcagagtctaatgcatcatacaaacttaataaatgtttttgctggaacaaaataataacaagaagccaggttttgcctggctcagctccaatcagcccaaatctctgggattggagagcataagcatcaaatgtgggttggcatgagataggtttgggtttgagtctgattcttggacaagtaagttagtctactacttttccatttcctctgctgtaaaaatactaatacccactttagagggcggttgtaggaattacacacaatcatgtttttatcgcatccttagcaaagtgtcctggtcacattatctgaagagcatccttggccactcttggttccttcatcctgtgttatttttcttcattatgcttatcattgtttgatgttatagtatgtatgtatgcatgtctgatatttaggtattttattattgtgcctcctccccatactacccacccactagaatggtgttctattaagggaaagacccagtttgttacattcatctctgtatcctcagcacctagaaaagtccccaatacccagtaggcttccagtagatatttgacagatagatgaatggatggacagagagcctagtatttgttggttattagtaaaaacattatgttttttaaaaatacctccctctgaggctacagtgagccgagttcatgccactgcacttcagcctgtgcgacagagtgagactccatctcaaaaaataattaattatttaattaattaaataaaaataaataaataaataaataaattaaaaaaattacctccctctggattagggaccctgttgtgtgtctcacttgtactccaggatctagaatctgcttccttcttgtacatgtggcacatgccatggcctcctccagctcctggcctgtcctcatccttgtagttctaagtcttatagtgacatcatcttttctcctattgtgttccggtattgtaagaaggttacttgtgaacttttcttcctgactctgccaggaaattgtttggtcttttactggtacctgatgcccctggaagcttttctgcttcagacctgatgaagtcaaccacaaagtgacaagtttccctgcaacatgagggtcattgcatttctaagcatatgttgagttcttatttttgatatgcacagaaaagtcagttgattattctaacttaaaaataaaattctaccttcatattggcttgccttttctctcctttgggacaggttgggaacttgggaagcataatataggtctatgctcttggcttatggtggttcagagatcagggcttttggaattgggcaaatctaggcttgaatcccaattttgctccttcctagctctgtgccctgggaagatagttaacctttctgagtctcaatttcctctataaaatgtggcttccttccttaacatgtacttattcagcccctagtgagttcatacattgttctagacgttagggatacaccagtgcgcaagcatcacacatgacctcatgcccatgagttgtcttctctatctggttggtaaactattaaacaaacaatgctgcaaaggagaaggacagggtttgatgggaacttacaatggagatataacccagtctggacaatcagagaaggtctaaccgaggcagtgttaacctgagtagcaaagaacagatgtagctgagtgggctgtaaggaaggaggaacgaaggttgagtctttagagagctatggtttagaactagaggtgaaggctctgtattcaaaactggtttggcgagacaaacggaatacaacttggaatataactcctcatataccatcatttaaacccctacttgcctgctatggaccttgagtttaaaattctatcattttaaagatgaaaaaactgcaatccacagaagtttccacaggccaccagctagttaagcatggcagagctgatattaaagttagcaccttaaagtatatccataccatcagggcggggggcattttcactctggtgggcattttcaggcaacaattccaaatacgtgaagaactgccttgtcctcaaatagcccagcttcacagcatggctcatttcacatttaaattgcactgggaacaaatacatttcacaatgttcagcttcaggttgcgaagaataacatgctaatagagagttgcaggtaccagtcattttcctccaaatcagtctcttttggtcccactctggattaatgaccacctttgcaaagaggccacatgagctttcaaagagaaaggagtaaacaggaggacatgcattaacatggcaggctagtcacctcccacacctgaatgtagagcttttagaaatggaattgttaagatgtgcttcttttacaaatatcagataaacataatctctgagggtacagaggtagtgggtgttgggtagaatgatactttagccatggagtgaatatctagggcaagtaaaaagtgaaggagacatctaattcatgtaatgggtggaggatttactaagtgtcaggcactataaacaatgatttcataggtgttttatttcatttgcacaactcactaggtcacacaccaagaaagaggagacatgagattaaacccacgttttctaactctgggctcattttggtgacgtcaggtgatttgggtgagaatcccagttccagcgatctcagcatgactggtacctgcaactctctattataagtaatcttgggttacttatttaactgttctgagcttcatctatttctcatctggtaaatgccacatgcagatgtacaatacatttacagtttgtttgttttaattagaccatgtggttcctcactgggattactttaatattaaataaaattaataaataataatataataataatattcaataaaactaatattaaataatattaaataaaattgaaaagcacatcgtgaatgaagagaccacaaagaaaagactacatgggatatttgggggacagctaattttccaggctggttggggaaagggtatatggagtgacatgctcagagggaactataaaggaagtcttgaggcaggacatgggggactccagtgctgttttgagtttgggaaatcttctctagcccatggccattcactcagaggatagaacagatggcgtttatgaacctacccacatacacccacaacatgtcaaatggttaaatttattgactcaccatttgcaaaattgtgttcatctccacactaggtttctttccaccacttcccagtttcaaatggatggcagctttgggattcagtatcagtaccctgatactgactctatatcagtgcaatggaaatactttcagttttcattcattttcaaccttaccaatgctctggaatcactaaatctgacttttttttttcctaagctctgggcctgtgagcccaggtttatagatgtagcttatagatatgctattcaaattcatttgtatgcaaacatatctcagtggattttgttatacttctgttcatcttgaaattcatgaaattcctcagacatctgacaatgcatagaattttaaatatatgctatcatttttctaagacacttgatttttgatcctgtctaatgtatttaatcaaactcaaattagaaattggttccaacaggcagtcttatagatcagcactgatcagtaggaacataaagtgagtcataaagatgagccatgtatataattttaaatttcctgatggccatattaaaaaaagtgaaaagaaacatgaaagtaattttaaaaacatatttcgtttaacccacagtactcaaaatattatcattcaacatgtaataaatatacaaaatgatgagatattctacatttattcttttcatactaagtccagactgtattttatacatacaacacatttcactttagccacatttcaagtgtacaatagtcacataaggctaagagctgtagattccagttccttagaacagttagttccttcaaagaactggaagagtgatttatatcccccttcctcttgctcccatccaagcagtaatattgcaaaatttctctctcatctatggatttttgggggttagacctaagagattatcttgtcctaaacttttgtattatggtcaatgaagctgagatgcatggagagaaagagtcttggccaattcagccatatctcctcttgtgttggtgcagtctccactccatgaagcatgtccatagtgattaaaaagatgagatagtctgaactgagaattgtaataaggaatggcttcttcggttaatagagtttacagaagtatataatgtagatttgggaggtgtcttgtgacagaaaccgctaactgtatccacatatattctcttcttccatggtaacaaaacccttagcttggcagggcacatatcttctttatcctaagaagataaaggatatatgtgccaacctctctgaagatatgtgcccacttccctgaaacctgaggagaagggcatgaactaaattctgacagtgggacattaagggaagtgatgagtacaactaaaggaaatgtatataaagggaaagaacaatgctcttccattctcccccttcttactgactggaatatgtgagtgatattacagcttcagcaaccttcttgaatcatgaaaagaagagaagcaaagtgggtggagaaagaagataggaagagtctgatccttgacactttggagcaccacacgagtcctagactgactagctacagactttttgcctatgaggaagaaataaacttctatttcacctaagccactgtcattttagatttttccgttactcatagcttaacctatatagccttcaccctcaaagttttccttggttgcaccacatacccctctgtcctactaccataggttgggtttgctgcccttcctctgcattcatagcctgctgtattaccgtcaaaataacttaccacactgtattgtaattatttatgcatgtctctcattttattcattgcatgtgtactgtgtatttattgatcacttgtggcaaattatccacaaaatctctacacacttggaaatgaaacaaaatacttctaaataatctatgagttgaaaaggaagtgtcaaaggatgtttaaaacatacatagaacataataaaattgaaaatataatatatatcaaaatatgtaagatgcacctataacattgctgagagaaaattttatagcaccaaatgcttacattaaaataaaagtctcaaatcaaaaatttatatttttacctcgataaattagaaaaagaataatagaaactgaaagcaagtttaaggaaggaaataataatgagcagaaatcgaagaaattgaaaataagaacataattaaaccaataggtagttcttcaaaaaattcaataaaatatataaacctataataatgacaaagataaaaagaaaaaatacacaaatcatcaatattaaaaataaaaaatggcttatcactacagaccctatagtgattaaaaggatagtaaaggaataatatacacagtttatgcttaaattcaacaacttagaagaaacatacaaatttctcaaaagacacatactgccaaaaatcatctaagatgaaacatatgaatggtcctaaaccattaaatacattgaattcataatttaaaatttccctcaaaataaatctgcaggcctaaatgatttccccagagaatactaccaaatatttaaagaagatttaacacaattttacacagtctactccaaaaaatggaaaaagaggaaacacttcctaagtcattttacataaggccagtattatcctgatgccacgaccagacaaaaagagtaccaaaaaaacctcaaaaaactctgacgcagtatctccagtgtatctcatgaacttagacataaatcttcaacaaaatattaggaaatggaatccagtaatatatgaagagaattatactctgttaacaagtaggatttattccagctatacatggttggttcaacacttaaaaatcaataatgtaattcactgcattaacaggctaaggaaggacaacatgattatatcaattgaagcagaaaaagcactttataaagtctgacattcagcaaattagtaatgaaggagaactacctcaacatgataaagggcatctacaaaaacactgcagctaacatcacacataatggttaaagattgaatgctttccacctaagatcagggctaagacaagaatgtctactgtcaccattcctagtcatcataattctggaatttttacctaccaaaataaagccaaaaaataagtcacaataattaggaaagaaattaaactgctactatttctacataatatgactctctatgtagaaaattccaaaaaacatcctaacactaataactaagtatattagtccatgctcatgctgctataaagaacttcccaagactgggtaacataaaggaaagaggtttaattgactcacagttttgcatggctgggaaggcctcaggaaacttacaatcatagtggaaggggaagcaaacacatcctttttcatatgatggcaggagagggaagtgcctagcaaagggggaaaagccccttataaaataatcagatctcgtgagacctcactcactattacaagaacagcatggggataactgcccccatgattcaattacctctcaccaggtccctcccacaacatgtggagattatgggaactacaattcaagatgagattgggtggggacatagccaaaccacatcactgagtttagcaaccgccgcaggatgtaacatcaacacacaagaatcaattgtatttctatatactaacaacaaaaatctggaagccaaaatttaaaacacagtactatttacaattgctctaaagaaaatgaaataattataaacacaataaaagacatgcaggatttgtatactgagttacaaaatgcttatgaaagaaattatagatgacctaaataagtgacacgacatattatgctcatggatcggaacacttaatgtagtaaagatgtcagttctctcagaaatgagctatagatttaatgtaattcccatcaaaatcccagcaagattttttggaaatatagatgaactgctctaaaatttatatggacaaacacaaaacctagaatagttcaaacaatcttgaaaaaagaagaaattttgtgttagtttcctgtgactgatataataagttaacccaaacttggtgacttaaaacaatgcacatttattatcttacagttctggaggccagaaatccaaattctgtttcactggactaaagtccaggtgtgacagcaatggttacttctggaggccccaggagataatctttttcatgcttcttccagcttctagatgctgctggcctcattggctcatgggtgcattactccaattccactttcatagtcatactgccttctcctcttctgtagtaaaatcttcctttgcctcccttgtatacggacatatataattcatttacgacccacacagataataaagaataattgtcccatctctcaagatccttaatcccctctgcaaagtcccttctcctatatagttgatgcttgaacaatgtgaggactagtgatgctggcaccttgcgcaatagaaaatctgcatataacattttttaaattatttcagtagtttttgggtgtttggttacatagataagttctttagtgatgatttctgagattttggtgcagccatcactcaagcagtgtacattgtacttgtacacctttatccctcaccccccttccacactttcctctgcgttcccaaagtccactgtattattcttatgcctttgcatcctcatagcttagctcccacttatgagtgagaacatacaaggtttgattttccattcctgaattacttcacttagaataatggtcttcaatttcatccagattgctgcaaatgccattatttcattcctttttatggatgagtagtatttcatggtatatatgtaccacattttctttatccacttgttgactgatgggcatttgggctggttccatatttttgcaattgtgaattgtgctgctacaaacatgcgtatgcaagtatcttttttgtgtaatgatttattttcctctgagtggatacccagtagtgggattggtggttcaaatggtagatctacttttagtctttaaggaatcttcacactgtttttcccagtggttgtactagtttacattcccaccagcagcattaaagtgttcccttttcaccacatctacgccaacatctattattttattattttttatattatagtcattcttgcagagtaaggaggtattgcattgtggttttaatttgcatttccctgattatcagtgatgttgagcattttttcataagtttgttggccatttgtatatcttcttttgaagatatgtctattcatatccttagcccactttttgataagattgtttgtttttttcttgctggtttgtttgagtttcttgtagattctgcatattagtcctttgtcaggagcacagtttgtgaagattttcccccactctgtgggttgtctgtttgctctgctgattatttccgttttttgcagaagctttttagtttaattaagtctcatctatttatctttgttttgatgcatttgcttttgggttcttggtcaggaaatatatgcatatagccaatgtctagaaaggtttttccaatgttatcttctataattaatttttatggtttcaggtcttagatttaagtctttgatctgtcttgagttgatttttgtataaggtgagagataaggatcaagtttcattcttctatgtgtggtttaccaaggagctgagcactatttgttgaataagatgtcctttccccattttatgtttttatttgctttgttgaagatcagttggctggaagtatttggcttgatttcttggttctgtatactgttccattggtctatgtgcttgtttttataccagtaccatgctattttggtgactatggccttatagtatagtttgaagtaaggcagtgtgatgcctccagatttgttctttttgcttagtcttgctttgggtatgtggtatcttttttggttccaaatgatttttaggattgttttttctagttctatgaagaatgacggtggtattttgatgggaattgccttgaatctgtagattgcttttggcagtatggtcattttcacaatagttattctacccatccatgagcatgggatgtgattccatttgtttatgtcacctataatttctttcagcagtgttttgtagttttccttgtagaggcctttcagggattcagggatggaacatataaagtcaataaatatgatacaccacacaaacagaactaaaaacaaaaatcacatgattatttcaatagacacagaaaaagcacatttgacaaaatccagcatccctttatgactaaaaccctcagcaaaattggcatagaaggaacataccttaaggtaataaaagtcatctatgacaaacccacagccaacattatactaaatgtggaaaagttgaaagcattctccctgagaactggaacaagacaaggatgaccactctcactacttctattcaacatagtattggaagtcctagccagagcaatcagacaagagaaagaaataaaaggcatccaaatcagtaaagaggaagtcaaactgttgctgtttgctgatgatatgatcatatatctagaaaacactaaagattcatccaaaaacctcctaaaactgataatgaattcagcaaaattttaggatacaaaattaatgtacacaaatcagtagcactgcaatacaccaatagcaaccaagctgagaattaaatcaagaactcaacttcttttatgatagctgcaaaaacaaataaacaaatgaaaatacttaggaatacacctgcatgtaacttttgactcccccaaaacttaactactaatagcctactcttgatggaggccttactgataacatgaatagttgattaacacatattttgtacatttttatatattttattcttacaataaactagaaaaaagaaaatgtcattaagaaaattatttaaaagagaaaatatatttactattaattaagtggaagtggatcaacacaaaggttttcatcctaattatcttcatgctaagcaggctgaggaggaagaagaaaaggagcatttggacttgctgtctcaggggaagaaaaggagaagttgcacttgctgtctcaggggtgtcagaggtggaaaaacaagaggaggtggaaggggaggcaaggggcaggagaggcaggcacagtcagtgtaactttgtagaaatacaacataatttctgcctgacttttttgcttttttatttctctggtaactttgcagaaatacaacataatttcttcctgacttttttgctttttcatttctctagaaatgcttctataataccaatccttctttcaccatttgctttagttttaatgcccattagaaggatctacatcaccaaaaaaagtatcaaaagaggtcttgaataatcagaactgttgtggaagattgtttaatgtcaatttgttttctggcactgcttcttctacatcttcttcctcataatctggcaccagttcagaagcactcatcaagtcatcatctgttaatccctctagtgtagtgtctattagatcttgaatttcaccaagatccgtatcttgaaattcttcgtcctctacctttttaaccgtatccacaatctgtttcagattccgttcactggctctgttgtaaatcctgtgaagtcatgcacaacatctggacacagttttctccaacaggaatttatcactttggatttgatgacattcatggctttttctgtaacaatgatggcatgtttaatggtgtaatctttccagagtttcatgatgttctctctattggggttttcctccatagagttgacagtcctttccatagcgtaccatgtataatcagccttaaaggtcctcatgacccatcttttgaagaatgagttaggggtgttgtgtttgggaggcaaggagaccatttcacaactttcagtgttgaactcatggggttctggtggccaagggcattgtccagtattaaaataactttaaaaggcagtttttaactggtaagggacttgttgatttcaaggacaaagcatcaatggaaccaatacagaaaaagggcctttgttgtccaggccttcttgctgtacaacaataaaaaaactggcaactggtgtttatcttttactttcaaggcttggaggttagcagctttatagagaagaacagtcattatcataaacgcaactgcatttccacaaagcagtagggttagctcatcccttcctgccaaaaatcctggtgttcacttcttttccttactaataaatatcctctgcagcatttttttcctccagaatagaacacttctgtctacactgaaaagttgttcaggcaaatttcctttctcttcttttaatggcatctagaaacttgtctgctgcctcttggtcagcaggagtttcttctcctgtaaccttaacatttttagagccaaatctctttctaaaattatcaaattgttctttgctggcatgaaattctccaactttagatccttcatcttctttttccttaaagttttcatataatgactttactatttctcgaatcacattagagtctataagtatgcctttcttatagcaatcctgcacccacataaaaattggattttcaatatgagaaagatgttttacagaaagtacaggttttcacacttgaagcaatagcttcacaagtgtacttttctttgtttacaacagatttatttatgctggatttatttatcttgaaatggcagattgaggtctcagttgcagccctcaagctatggtacatatctaacaattcaacttttttttttgtaatgtcaagacttttccctgcttcttaggagttcttccagcatcactagtgacacttcatatagttcccatggtgttatttatggtattgcaccaaacatgataaaaaatacatgagaaccacaagagatcactttttactgtgataggcaatttactggaaagacacaaactgctcacatggagatgcttagcatcatcagcactttaagtggatgggtgcaacacttgaactcacaacaatagcaacaggaagtggccacaaaattattaaagtaatatgtactatagttaatttcatgctgttacgattgaatactgttgtattagtccattttcatgccgctgataaagacatactggagactgggggaaaaaaagaagtttaattggacttactgtcccacatggctggggaggcctcagaatcatggtgggaggcaaaaagcacttcttacatggtggcggtaagagaaaatgaggaagatgcaaaagtggaatcccctgataaaaccatcagatcttgtgagacttattcactaccaagagaacagtatgggagaaaccgccaccatgattcaaattctctctcaccaggtacctgccacaacacatgggaattatgggagtacaatttaagatgagatatggatgagaacacagagccaaaccatatcaactctatcttcatgtttgtttacatttctctcaactgtaagttgtctgtttgtatagattttgataaattttaactttttataataaatttgtgtatattttattatagcaaataatcaaatagactagcatttatatgttttatgcatttagtacatgcctgtttcttaattttttttgatatttctaggctgtgtggttcatcttcaatttttttcaagttttcagaaacccccctaattttttcaatatgtttatcttgaaaaatccacctataagtggacccagactgttcaaactaatgttatgtaagggccaactgtataaggaacattcacaggtttcaggtattaggacctggatagttttagggccattattcagcctcccaaaaaagtggcagaaataactctacctaatattaaggcttactatataagctaaataatcaagacaatgtcaaattggtggagagatagacacatagatcaatggtacagaacagagaactcagaaatagacacacacaattatgttcaattaactgtgcaaaagcatgcactaggtgcaaaagcagttcactgtagggaagatagttgatatgtgtattagtctgttttcatactgctataaaaaaaagcagccgaagactgggtaatttacaaaagaaaaaggtttaattgactcacagttcagcatggctggggaggcctcagaaaacttacaatcatggcagaaggtgaacgggaagcaaggcaccttcttcataaagcagtaggaaggagaagtgccgagtgaatggggaggaggcccttataaaaccgtcagatctcatgagaactcactcactgtcatgggaacagcatgggggaaaccacccccatgattcaattacctctacctgggctcccccttgacacatggagattatgaggatttacatttcaagatgagattcaaatcgcatcttgaattgtcattcccagtgcttggggagggacctagtaggaggtgattggatcatgggggcagatttcccccttgctgttctcataacagggagtgagttctcacgagatctgatggtttaaaagtgtgtggcacttccccctttattctctctctgtctcctgtcaccatgtgaagatgtgcctgctttccctttgccttctgccttgattgtaagtttcccaaggccacaccagccatgcatcctgtacagtctgcagaactgtgagttaattaaacctcttttctttataaactacccagtctcaggtagttctttattgctatgtgagaatggactaatacaatagtcttttaaataaatggtttgggaacaattaaacatccacaggcaaaaaaaaacttaaaaaaaaaaaactcaaaaaaaaaaactcaacctaaacctcacaccttatataaaattaacttaacatggatcatccacttaaatataaagcataaactataaatcttaacaagaaataggagaaaatcttcaaaatctaagtgaaaagttcttagacttgacaccaaaagcctaatccttaaagaaaaatttgataagttggacttcatcaaatttaaaacttctgtgaaagaccctgttaaagaatgaaaacagaaacagaacctacaaactagaagacatttgaacatcaggtatctgaaaaaggaataaaatatagagtgtttaatgaattctaaaaactcagaaataaaaaacaagcaatccaattagaaaatgggcaaaacccctaaataagcattttattaaagaggatatatacagatgataaataagcatgtgaaaagatgttcatctttattagccattagggaaacaaaaattgaaacacaataagacataactacacaattatcaaaatagctaaaatttaaaaaaaataattacaacaccaaatgctggtcatcacaatgcaaagaaattagatcacctacacattgcttgtgggaaagtaaaatgatttagctattctggaaaacatttggcagtttgttataaaactaaacatgcaaccaccatatgacccagcaactgttctcttgggcacttattccagagaaatgaatattattttctcacaaaaatctgcatgtggacacttatagcagtattatttgtagtagccaaaactgaaaacaatccagatgtccttcaatggatgaatgattaaacaaacgacagcacatccacatcattcagcaataatgaggaatgaactattgatacacacaacttgagggaatctcaagggaattatgctgagtaaaaaaaaaaccaatcccacaagcttacatacgtcatgattccatttatataaccttcttgatatgacaaaattatagatatactagaactgattaatagttgccagtgtttagggctcaaagtgcagggggagggataagagtgtgattacaaaagagtagcacaagaaatccttctgtatcttaactgtggtggtaattacataaattgcgacatatgataaattgcatagaactaaatacatgcacatacacatacaagcacaaggatatataaaactggtgataatctgaataagattgataggttgtattcatgtcagtttctgggttgtgatattgtactacagttattcaagatgttaccataaaaaatttggaaataactctggagataatgttttaataagaggcataagcacaccttaactataaaatgtttgatcttcagaaaacattctgaaatgtaatagaaatttaacaaatgtggaaaggggagaacatgctgtgaagttattatcaactcctgtgcaaaaatgttagggctctggccaaaatctcaactcagaattgccaactttcataaagtctgcaagtagaaacttgtcacatccataaatgtaaataacacttctttctttcacctaacctgatttaaaattatttacttgcacttttcttatactttacaaagtattttcacatgcaaattctattccattttcctagtcacttgatgtggcagacagagaagaactttttatcctccattataaagatgaggaaattgagtctgagagaaatgatttgttctgacttgaagctaaaaaattgtaaagttaggagtaaaatatgaaatgtgaatcttttgactcctgattgatgatgctacttgaaggcgaggaataagtcttataattcttagagggttagtctgatgtaggggcaaaaacaacactggattattagtcaaaagacattgttttaagcttcagcattgagccaggtccaagctaaagttcaatgtaagttagaggcatgtggtgagagaggtgctaccaagttccattaaggaaagcaaggaaggctttcaacagatttggcatttgttgagtcctgaagaatgccttgaattttaatatatgactttattaagagaaggaaaaatccaggcagagtgtagtaaaaataggggatgggggcagtgagcagcagtatggggaaaagaaagtgtaatgaatccagtgcccctccattacccacctccaccttgacagcagctgtattcccctgtaaattgctcctctctctttcttctctctttctgggactctggtaatatgaatgttggcgcttgtgacactgttaattttctttgttctactttctctctcttgctcagattgggtaaattatattcatctgtcctcaagttcactgatggtattttctctgtcatctccactctactattaagtccatctagcaagatttttattttggttattgtacttttcagtgttatagtttccatttgattctttttataacttctacttctttgttaagattttctctttttttatttgttaaagagaattcataattgctgctttaaaattatcttcagataattccaacaccttggaattcatcttggtgttgcctgttcatttcttttctcatttaagctgtgatttttatttacttatttatttagttagttttggttcttagtttgataagtgatttcctgtggtattctagacatttggaagactctagatcctatgtaatcttttttaccaggcattatctccactgatatgtagtttgagggccgagtgggtgtgtattttcaatggaagtggtgtgctcacactgcctctttgcagaagggtggactgaaagttgaacttccttctcagtcctatagaactcttctcagaaaatgtgggtgcaaactcgtactgccttattggggtattagctcagctccttagtgagccatagtgatgagatgagagagggagggaagtattaactagctccagcttgcatagcctcattcattttcactgacgccactgacacaaacctgtaaagggattcagagcatgaacgacctaatcagctcatttcagatataaggctaaaaaattgtaaagttaggaataaattatgaaatgtgactcttctgactcctgattgatgatgctacttgaaggtgaggactaagtcttacaactcttagagggttagtctggtgtaggggcaaaaacaacactggattattagtcaaaagacattgttttttaaggctcagcactgagccaggtccaagctaccatactaccacttaccaccacactaccctaccagcaaggaagggatagaaggaatctgaaatagaggattagctctgttgtggtgcagaaaatgatttcccaaaatatggcagttgagtatgttgagtgcttttaagaattgcgaggactcaaaaataaaccctagaatcaaggtctctctaacttgtctcatttctccctcccttcaaatgcaagatgggcccctgtctcctccctgctctatgacaaagggtatataagcttctgtgccccattggggggttggagtaaccactctgatatggtttggctgtgtccccacccaaatctcatcttgaattatagctcccataattcccatgtgttgtgggagggacctagtgggagataattgaatcatggggtggttttccccatactgttctcatagtagtgaataagtctcatgatgtctgatggttttataaggggtttcccttttcactttgctctcattctctcttgcctgccaccaagaaagacgtgccttttgccttccaccatgattgtgaggactccccggccacatggaactaggagtctatagagcctcttttttctttataaattacccagtctcaggtatatctttatcatcagcatgaaaacaaactaataaacactctgtgattctctcccatgcacattaataaatatgtatgcatttctggctattagtctgccatttgtcaactgattttcaggaaacttttagaggataaggtgaaagtttttccttggccctgcaaaagttgtcagggccaaaatggtgtcaccaaagttaagagaactctggcaaataagagctagggaaggccatgaagagagggttctcatgcttgtatgcttgataataacaaccgaaaaaaatctctacaaaaaacacaacctggcacaaaggccatcacaatcacacaaaaaaatacttctgcaggacatatgaccagcactgtctgtccaacctcaggctggtgtcatacttgtcattgatctttgtagccaaggataattatttcaagaacaattgtgtaatgctcctcatttcttttttctttagaaacctttgtcttcctttaattcaaatatacaaataatttactattgcatgtatattccctttgcaatactctattcccaaataaacataattttcttttagaaagcctctcactgtcatttaggttgacagcctctatagtttcctattctgtcctgctggtaacagtaccagaagaggaaatcaaatcattagcatctgcgtcttcagggaagagtacagtgtggtggaagacaatcttcctcttggtggaggaagaatagaagaggttttgccattggtgtttaactggagtagcacagatattgccaaaaagactttctcttgttaatttgtcctttcttggctaggggaaacatgcttttgtcagccctgtgtgtgtgtgtgtgtgtgtgtgcgcacacgcatgcacatgctcatgcacgtgtacacctattggtggttctagcctgggggtttctgcagtgtcctattcaggatacacggacacaataaggatacccagagaattcactatcatagcattccttacatgctgaggttcctaaatcgcccacattttcccacctttaagtattttcctttgcttatctgttatgctatttccagggttattttagttgtaagacagtatatgagagaaatgaggcttctctctcttggctgggaccagaaatctctgctgagtatgaacaagactttctaatcctcatattattatttttttgctgtgatggactacatgcttttctttgaaacacatttctctctcagtatttactactgtacattgtgagtttcctcctatcttttggtcacttcaaagtgcccttcactgtttcctctttgtctgtagctcagtgcttctgttctccaagattctgccctaaacactttcatcttacctcctcttctcttcctccacagcctcaccatcaccatatgttgaaaactgacaaatcatggtctcaagtctctaatcccagtccagtttgcactggaaaccttcatctggttgtctcataaacaccttgcaactttgttatctagaatgtaatttattgtccacatgtgcatgtgcaaacagattttctcccaaattgacccttctttgtgcatttctggacttggtcaatgaccccatgacccacccaggaatcccactcagaaatatggcagtcaccttgtttctccctttattctaaactccaacacatcaccaaactttggccattctccctgctaaataattctcaagtccatccccttgtctctgttccctctggcaatggctaaagcatttgttcaaaatctcattcctggatgattctaatagttttctaattggtctacctgtctttctccattcccacagaggctctagaatgatcttttcaaaatgcaagtataatcaagtctgcctaaatcccttcctaattcctcattagctctaaagaatgaattctaactctaatttctccagctcgtcttccacaatttcctccatccatgtctggaatcatgctgtgatctctcagaccctacattttgtctgtgattttgttcactgtcctgtctgcctgaagtatgaaatatcttcctctccttccctcacctgcacccaccctacctaaaccaaccctactagacctacaagattccagtcacgtaatctcttcagggaaaatatttcccactcctcattaaaggtgcttatcttccctgtttctaaaacaccctatgcatgttaaattgttgacttgcttctttgcctcccatctgggattcgggagaaactctgaggaaggttcattttccatcctggcataatatgaatagagaacagaaaggtgagctcctccgccctttgactagtcatcttggagaagaagtgtactacaggcggggagcggtggctcacgcctgtaatcccagcacttcgggaggccgaggtgggcggatcacgaggtcaagagattgagaccatcctggctaatacggtgaaaccccttctctactaaaaatacaaaaaattagcagggcgtggtggcggcacctgtagtcccagctactcgggatgctgaggcaggagaatggtgtgaacccgggaggcggagcttgcagtgagccgagatcgcaccactgcactccagcatgggcgacaaagccagactccatctcaaaaaaaaaaaaaaaaaagaaatgtactacagtggtcaagagccctgacctggagcagaacagttgggttcaaatcctggctctgctacttaccggttttgtgacatttatcagtgtccccccatctgtaacacaggcataacagtaacttttttattggatagttgtgaggattaaagtaagagcatgtcaacgtgtagaaagattatatacgttctacagttcagaaacattggcgtgtagattataaatatttgctatgttaaaatatttttatttgggggcaggactttgagctgctccaccccacccccacctcctgctgcccacgcaagaatcagaaccactgctgggcagagtggctcatgcctggaatcccagcacttgggaggctgaggcagggagattgcgtgagcccaggagttccagaccagcctgggcaacatgcagaaaccccatctctacaaaaaatacaaaaagtatccaggaatggtggctgtaatcccagctacttgggaggctgaggtggaaggattgcttgagcctgggaggtggaggctgcagtgagccaagactgtgccactgcacttcagcctgggcaacaaggtgagaccctgtctctgaatgaatgaatgaatgaatgaatgaatgaatcagaactgtaagaaaacctgctaacctctccacattgtcccgagtccattaatttcccagctgtttgtggcctgaagcctccagccaccacagaaaccaagattttccagacaatggttcctctcagttcaagtatggcagattttcggaagttttttgcaaaagcaaagcacgtggtcgtcatttcaggggctgatgttattgcggtaagtggggttccacccttcagacaagccggaggtcatggggaaaatgtcagtccaggccctggcagctcctctgtcctctgcccacgcttttctgggtgtgggagctccccactgcgggtgagaggtcaggccgagcaggagcccagtccgcacctcgccaccatcgaatgtgatgccctgctgggcggacagggccgccagggcatgatcatgacagaatatccatgggcggcacccaaggctggcgccaagaaccttctggaaatccactgtagcttatttaaactccatgtacctcttgtggagtcgtgtctgagaattatgagagtcggttggtccacctttatcaggagaaggtgccccaggacctggaactcaagatgccagaatcccagttgggaaacttgccgggtgtgagaggcagagagcaggggcttgccgcaacctcacgccctgtggtttggcaaaaacttggatcccgcctttctggaggaggttgacagacagctcacccttgtgactatgtctagtggcacatactccccctgtggtgtaccccgcagctgtgtttgcccaccagatgtctgccaagggagtgccagtgaccgaatttaacatggagaccacctcagccatgagaagattcaggtttcatttccagggaccctgtggtaggatgcttcctgaaccccttgctggtcatgaaaatgaaactgtttcttaagcatcctgggaagaaagaaattatagtatatctaagtatgtctaggtggcgagctgatattggatgatccaaaaatattctgattccctggctgaaatccaacctgttgataagtgtttagggctcagaagtagcaagagcaaaggtatttagaagtcagagaactgtaaagttaatgcatgttatttgatttgaactgaaacataagagacctttgatgtgtttagttggttattgggagggaaaaacgttgtaattagattgtctttaaaaatgtaattattctgattatatttttcctatttgggcaaagatagaagtagaggggtaaaatcctgtcatttagcacaagttttaatggaaaataaaatcattctcaactacctacttatataaaggtgttaccccaggaacaaaaattcttttttaaactattacttgtaacattaaaaacatgttcttccttttctcaaggttagtatttgccacttgaatttaataatccgtttgctcacctattaggagcaacaataaatgcaatacattttgaaggagaattaccctggagaataaccaaggtagagtagtttcttttagaagtagatttactacattaggtacttcagcaaagaattggtttttaggaacagaattcataagaagctatatggtagaaccatttgggtattttccaagtggttgagaataattgctatgaaaatgaatagggaaattttaaaataattatttaaaaacgagccactgaatagatcttctaagcttgaaaatgtctatagtaccatgaaatcatgtttacggccgggcgcagtggctcatgcctgtaatcccagcactttgggaggccgaggcaggcggatcacgaggtcaggagatcgagaccatcctggctaacacggtgaaatcccgtctctactaaaaatagaaaaaattagccgggagtggtggcgggcgcctgtagtcccagctactcggaggctgaggcaggagaatggcgtgaacccgggaggcggagcttgtagtgagccgagacagcgccactgcagtccagcctgggcgaaagagactccgtctcaaaaaaaaaaaaaaaaaatcatgtttacgattccttctcaacaatgtgcttctcgtctagaaacacatacattgttcaatagatatttgttcaataatattttgtggggaaaaaaatcactagattaagagcctcccctgaacctctcccaatttaaaaaaaaaaaaaaaaactctcaaaagcaaggatatgtatactttattccctcgctcaaaaaattatgttcaaatataatctctttaaaaactcccttatgggggagtctctcaaatatcattcctccccttgtctttcattctgctccctattgcctatatccagtatttcagaatataggaagaggcagaaggcagaggcttgcttttcacccgcttcctctgagacagcaacactgtgaccatcttcctcaaagatgcctggagttcttcgggatgtcagttcaggaaagacacaaaacagctctgtattgcagagacctccctaaaacacccccctcccatattggataatttcaacatggcaaggacatccatgtgtgaagttcttattggaaacttttaacagatatggtttaaattttaatacaatgggcaatgttttgttttctggtgagacaaattcttacagctgattgcatgcaggaaaagctttattaagtcaataagctgttacacttttacaaactgctatgcagaatactcaaacatttttaaatgacatgagaaactactaacatctttagtgagagtcactttcacaattttctctgctcccacacccctaatgatcaacatattcatttttttatttagtatatgtcacgcagcaatttatcaaaagcttttgttgtgaaaacacttttcttaaatacacaattaaaagatatgattaagcacttacaggatgtgaaatatttaaaggtaatacacaataatcgggttaccaaaaggacgccttccaatttttctttctattcattttgatgttttgttcttttcaaaacattttctctcattacattcattactaaaggccttactttaaatacatcatgctacattttgttctcctcttcaaatgccaatgttttaacaatttgaattctctggcctgggaaaaagaaaagttatccacttacaaggtatacgtattgacaacatggatgttacagtccaaacaacagcacaaaatcaaccatgtacatgtaacatagtgaaatgagtccacgttttctacacgctacaggataggaagagctggctcttaaggcccagggctcacatgattatgcacttgtcaagcagcttctcagtggtgttgggcatctgggatttcttctcgggctcctggaggccggtggtgggctttttcttgtaattcagcagcatgtggaacagctcctgcacattcacatcggtcttggctgaaatctccatgaaggcgcaattccactccatcgcacaggtggcaccatcattcagggccacctcccggtgggtgtcatcacttttattgcccaccagcacgatggggaacttatgcaggttgttacctttgatcttgcagatcagctcatagaaggccttcagctcttccagggtttccttcttggtgactgagtagaccaggacgaaggcgtggccccgggctataacgtggcgctgcagagcgcggttgccgtcgccactcttgctgtcggtgatgtgcagggaaagcacaccgtggctgcagcccagcaactggcagtaggtattttcaatggtcggcaggtactcatgacggaagttgccgctcgcccacttgtgcagcagcgtacttttccccacaccagcggtgccgactaccacgacgcggtaatctctgatcttcctgtggggcttgaaggcgcggaggataagcagggcgggcagaagccgcaaccgcttcagcagcttctgttccttggagccaaagctggcgttacccatcgttgggattcggaggggagatacgtgcacaagttctcccacacttagctggcagcaggagacccctaggaagaaagtgagacggtgagagatggtagtggtaacctacaatgttgtcagatcatgtcagcctggccagctgctccactaggactctgaagagagtccaccctgtgacgtaaaggggtgcacacagcgagaagaaaattcccaggcacacagttcagcctgctagaccgagggaccagcaggtgatatatattaaacagacatggtggtttgctttttaccatctagaaagtgcagcaatactaccttttgttttctttccttaaactgttttattaaattctcactacacccctacaagaaacactctcatttcctcgcttgtaaaattaagattttaattgaagaggactgaacagtcaaagagaaacaggtgagggaattttccccactctatggggctgaatgccaaggtgacatttagagtgacaccgccgccctggttaaagctacagagtcatcagtacaggagaaaggagggggtttttggtatcagtggtgtgggatgtagagaggggaggtacctgcagtcagtgcagccccagaagaggcatggggagcacctttgctctgagcatgctgtcaccatgtgccaccaagagctgagggaggggtcttagttcatgaatccttagtcacaatgacagtggagtaaaaaaaaaaaaaaaaaaaaaaaaaaaaaaatatatatatatatatatatatatatatatatatgaacctttctcttcaggatctaatctctgattagaaaagattgtaaatattgaatgagtttttctacagaacagtggtttttcttttgccatggctactacctttaacaaagtacttttaattcagccttatggaaatagagaaaatttcaggatttgaacagtcaatgaactttttgagttcaggaataaacatagtagattaggtttgtaagaaacttttctcacaggtatatcctaaataccagacagctgcccagggggactgcttcagaagcatcctaggtcagatggaaaaagttctaggcaccatgcagacagaccacatagctggcctctggacagaggtaggaatagtacaaggcaatgtcattcctgtggcactaggtatagaaatttatacatgtttctaggtgatgatggtccttaaaatgcacttctcttcaggtacagctatgattgtgtcatgtacaataccagaaagagaagagaggctttttgtgaatagcacactccctatataaactagcctgtcttgctggctgcgtagttgaacacatactctcccagtactggggaaaaggaccctttttagaatgtgcaagtcccatgagagagtaatatgtccatattagagttttggtggtggtttttttttttttgttttttttttttgagtcagggtcttgctctgtccctcaggttggagtgcagtcatgcgatcatgactcactgcagcctcaacctcctgggatcaatcaatcctctcacctcagcctcccgagtagctgggactacaggcatgtgacaccatgcccagctaattttcttattttttgtagggacagggttttgctatgttgtccaggctggtcttgaactcctgtgttcaagtgatcctcctgcatcagcctcccaaagtgttgggattacaggtgtgacacaacatacccaccccatattagagttttcatttgaaaaaaaaaaatgttgttgctggttgttatatcttcagacttaacttgcttctaattctagtctggcttctttaagatagtgtgattctaagagtgttctaaacttaagtggcaaaatttaagtagatgattttatattcttgattaaagggggccagggaggttaatacagtaaatatttgaaattgatataaaataaatacatacatatatctaaaccattcatttttgcagctttcaggtaaaatctagcactttattccagtctatgagatgtggttagttgatatcatctaatattaagtaatgacatcagctatccaaatcctgggcacaattcctttagcaatgatgacctttaatagaatttagcttaaaaaactaggagatttctgctacagtgatgcaatctttcacatcttatttattaacaaaaatcaacaatccagctttccttaggtcttcacgcactaagagttctctagtcacagaaatcctagccttgtctgcactctccacaactattataaactccatgttagtatcaagagttccagtaaagaccaaatatctcttggccaccaacatcccacattaggaaatgtgcattactaattattctgttttacattacttcctgctctaggggatgtatgtacaaattcattcatagaaaattggtaaagcagccgggcgcattggctcatgcctgtaattccagcactttgggaagtcaaggtgggaggatcgcttaagcacaggagttcaagactagcctgggtaacatagggagaccgccgtctctatcaaaaagaaaataaaagaaaaaaaattggtaaaggacacacgtgataactgaagtttccagatgtgaagagaattctcattctcaggcagtggacccccccccccactcccctccacactccttccaccttcccaggccacctggcctcaggctgagggggaggtgaaagtttccaggaaccagagggcgtccaaacccagcggccgtgcggagctcaaggtcccgccgctgctgttgcggcaccagcctggctcatggacatcaccacgcacctgcaaggtcaggtttctctctggtggctgtggcggctgctaccctcctcgcccatttcaatcttactttcacactacatgactccactattacttcctgaacactagctacctacgcagctgtaatagtggacactgtgtcaacctttaagctcgcacacttatcaaacctcgttcttctatattaaaaagtgctagcttcccaacgggactatccaaagtgcagttgcaggacctgccaggagcccgcagggctgcgggtggttcttgcgtaatcgcgccaagaaagacctggttccagtttcagggacaactcgcccataaacttctactgcgcaacagcatctgctgctttgtctgacacttgttgttttcaagtacccctaaaaaagcgaaagaaagacttacctttctcggaggcacgaaccaagcagcctagaagacaaatgcgctgctcggagagactgccgcggcaaccaactggacaccccaagagctcactcctccgcggttttatattccgacttgcgcacaggagcggggtgcgggggcgcagggagtgtgggtaacaggcatagattccgcttgcgcaatacgtggtaagaaaccagctgtgaggggctggcccaacgcagagcggcgcgaggtccgcttggcatctacaacaatcgaggggctagtccagaagttcaaggcggggttacaggttggggaggaactgttaaactgtggactttttctcacctgttggaataagcttcaggcaaaactttgccaacaaaaaccggtccaactgattttagacgaaagtccaaaagcagtttaatgcaggacagataatcttttccacaaatgatactgaaaagacaggacatctatagattcccccccgccaaaaataacccttacataaaaattaagtggctagatataactgtgacgagtaaaattacaaaacggttttaaaaaacaacaaactattgtctaaggctaggcaaaaggttcttaaattgacattagtggcaagaccggtaaaaagaaatgttgatgaattagactccataaatttaaaacttttgctttgtgaaagaccctgtaacgatactgaaaaggtttacctaggagaaaatatttacaagccatatatctggcatacaaccagtatctagaatatgtaaataactcaaaaatcaattatttttaaaaatccaattagaaaatagtcagaagacataaacagacacttcactgaagatatgcagatggcaaataaccatatgaaaacctttaatgtcattagccattagagaaatgggaatacgaggctttcgttgttcttcgcctcccactagggcgggttgagggtctggctccagtagccccgggtgcctctcactccttgggcgcaatgctactatcctggcagaaccctcgccgaaccctcgcaggacgccccatcgggtccgccagcggctaggaagcccgattgtgtcgttcctttttccctctgcgcctcccaccgccagtcccttttccaaatgcgcctgcgtctgccctccacatctccgagctccgtctggcttctttctcccttgcctgtgagcgcctggcggcggatgcattgaaagctgcgcaccaccgcctaccgagcgttttggggagtgtgtggaagttgttggcagcaggttttgacagcagtaccctatgggcctagtcgttgacggtagcacctggttttgtgtgccccagccagctgaggccagggtgtgtggtgtgggccactggtactgctcttctgccactataatccctccccctaccaggtacctggtgcgtagaagtctaaagacctgtgaggtctagcctggcgcctgtaatcctagagaataaggaggttgaggccaggagttagagaccagcctgggcaacatggggagaacttgtctctactttaaaaaaatttagcccagtgtggtggtggccgcctgtagtcccagctatttgggaggctgatgtgggaggatcacttgagcctcccacatcaaggagatcgaggctgcagtgagccgtgatcacagccactgtactccaatctgagcaacaaagtgagaacctgtctcaaaacaaattccaacctgattctggtatagcatcacatgacaggtagcagccctaagggcgatcaaagtattttaccccaaaatatatttctgacatattttggaatggtcctgtgcaaagctatcttttgcgagggaaatttgtgttctgtggacaatctccttccctttccaggtctttctctgatccgggagagatttaactaagagtctgacaccgtttaaggtcatttaccttttgaggtacatatgccatctattctttctgaagcatattacaggcttcacatatgtaacaagaaccctggcttccacaacctccctcctgccaccactggccaaacccctcctcctccaaaatgtaccggctttccaggtcaaaccaatgtataccttacatatattgactgatgtttttgcctgtatcttctgtcttcctaaaatgtataaaagaaaactatagtccaaacaccttggacacatgttctcaggacctcctgatgctgtgtcacaggccgtggtcactcatatttggctcagaataaacctctaaatattttacagagtttggcttttttcactgggtttccccactcattttattggcattagctcatactctttctgtccaatcatatttctacattgctgtctatattttattaatcctaagttaaaaatagacaatttcctctatatgcttgggtcatcattctgcaggctcccatgtatacatattaaatacatttgtatgctttttctccaattaatctgccttttgcaggttgatttttcagtgagccttcactgaagtttccctttggtccctgcactggtaattaactcaaactgttttaccaaaatttgattcatagcctttatctcattttaccagaaaaataatttggatccaactgttctctataaaccagcaagtttatatgttttactatctcacaactaaaattctaaaataaaagctagaagacctttatgtgtatatttgtttaaatatatttacacatatgtacatgtattatgttgtatgttatgtctacataataaaattcagtgtggtaggccaaaaatcccttaagaaatgttaatctgattggtttaaatagatgggcactcacacaaaaacatagtaattaacctaatttttttagttcatgtaacttaatctttaaaaaagtaattggttttaaaattgttgataaaataaaattaaaaacgtctttctaattgtcaatatatatttttgcctgtgtttactggtgtgggggctatggctctcagccccccaaagatttgctggaaaatcactgacatgggccacattgattagtaagagaaaagacatacaaatgtatttaatgtgtatacacaggagctttcagaataaagacccaacttctcaatgagttatagaagtttatacactagtcttgaaattacagaaagaatggggggcttggattctggtaaaacagattatgggaggagaagaggaatttattgaggggcaatgaatgattggtgagagaatgattggattgagcaacagatattaacttgtaaatagttttctttggaatttaaataatccttggaggcagtcattgtacttctataaaggtctgcttgggtgtggttacattttggtcttcttttctttaacagatgagataacaggaggaggagaaccaacaattgctctccttggtgggtctggttgttaggcagataaaggaacttcagcttctttgggaaggatggtggggttggaggaaaagtcagagagaccttgaggcttctttagtttagcgtgtcaaataccatgttttggcatatcagtttctgagcaccagcactggtcagttttatatttgcctgtgctattaaggtcatgaagctataaaccaggcctaaagcaaagtgatatatatttatgcaattctttgataaataagattaatttaatattatttaacaaaaacagctgtggctgggtagtgactcccacctgcaatgctaaaacttggagaggccaaggtgggaggatcacttgagcccaggagtttgagatcagcctgggtaacataacaagacccaatctccataaaaaaatttaaaaattagccaggcatgtgcctgtgatcccagctactcttaaggctgaggaggggggatcccttgagcccagagttcaaggctagagtgagctatgatcacaccactgcactctagcctgggcaacagagtgagcctttgcctgtaaggaaaaaaacaaaagttgtattttctgagttatctacagatacccatgtatttaactttatggctcttatgtgggtaaacacctcatgttaacaggctatataattatttaatttaaaaaaacttgaaataatgaccagctccatctaatatctcaatttttgtaagaaatataggtataattgttaaaaaataaattaactgtaaatgaaataaatgtttataaatgaactcatgtaatttaaagtcttaaaattttatgttaaatcatatatacaaaataaatgtctgtatcatagtcagataagataaaatgattggttatcccacatttttaaaaaaagaaaaattataggactaagaggtaggggttaggaaaataaaaggtctaaagttgaagaggactaataaaggatgagctaataaaagaagttttatgtgttattgacttggctggaattaaaaacaaattgtttgtgtgtttttctaaaaattaaacgttctcaggtaggggaccaggggacaggcactgatacagaaccagagtctggttccttatatttaaaacaacaagatttcttgaagtattatctgattttaataaaattttaaggggttttgatttttaaatttatactctgtttttaaacaggtatcttctccttgacatctatttaattttcctagttttgggttaaaaatgttgtcttcttgatttaaagtggtaatttcattccttgaggtacagttgtttttttttttttatttctcaaattcatattgcagaagttcatcttttacagtttcttgctgtacatgatttgcaggtcaatatgtcatttccttcatttttttctcccctggagaaggcctgagatgatcattctcctctttggctttttttggttctaacattgctgttttggcctgacattagaatatttatcttgaaggcgtagaaaagcagcgtttttctccagtataacttaattttgtgctcttggcttttcttgatatgtctgaatttttccatataaccagaaaagttactgtggtaagtaacagcatgctgttactaagaaccatgtagttccctgctcaaggtactagttttcttgtttatattcctctataatatagtgtatacttataaccttggacatattcttcctgtgtttcatgacattcaagttcccttttcatcaggttcaacttccacgttatctgaatgagcttcccataatgaaaaacaatcacaccgaagagggctttctttacgtttttggtagcgagtctaagaaacaaagattttatgttttagcaaactaactttctatgttacctttattaggcttttgattacttaaaaaaaaatgagttttaaaagggttaaggtttctaaatccatgtgactttcttattgcttttgaagtcttttgattatgacactggttaaatgaataactgttatttcacagcaacctgtgattctgttttgaaccttttaacatctttgacaaatgtctcccaggtcaaatcctattttaagactttttgacctaaaattaactttgagattttttcagttaggctcctggaaaaccttaaaagacatatttctcattttgtagagatgactaggcttatttggtgaattgtataaaaacatcgtcaaataagtgatactagattttcttttagttacatttatgtacatgttgacatgaatgtttcaaaaattatataaattcatagaaatcgagtatgttttcagtcataattctaacataatcttttgttcaaattatactcatcgtccctgttgtagagctggacattctctgctgtaattcaacccagtcataaaattttacccaatggctacaacaggactcaagactcaaccagtttcctacatggtcttttgatttctttagttggttaccttcaacagtaggttcatggtttagcaccagtatttagaccagactgattatattagtgggtttttttgtgtgtgtgtgtgttatgatttttaaacttttttcttattacttgactagtctttgtaaagccagctctcccaacaagataatgttagcccagcaagatgattgactagacatagccaggtagaatagcttctaccaagggacagagacagctggtatactcctaacagattttcagagggaaggctgcccctaccacttccctccaaaaatgatgtagggaagacacagaagctgggctgaagtggggagaaacctgggaacactctatggggctaccgtgcacccggactctttccttgaccccagtggctctgagggcatgggtgagttgaacttgcaaggagcaacacattcttgccataggcctctggaaccccaccaggaggagacccctcaaccaccatggacacttgaattggcaggaagggctacttagagaactggtaggggcagcaagccagctgatgtggagcacagagggtttggagcaggaacatctgtagtggagcatggccagggacacccatcccccttggatcaacttacttccataggagactttagccccaggggaactgttagtcctgaactctgtagggcaatcttgcccatcagttggggctggtccaacctgagcaccccttgctctgctggcctcccccaaggccctagcctagccacacctgcttgcagggcaatctcaggcacgtgggggcccacatcatagtttctgtgctggcggactgtgcctgactggaaagctctagctgggtggccctcacagcccacatactccctccccacattgcagcttccctgagacccacagcaattcccaacattgcttcgctggtgcatatctttgcagacaggttttgctttccttgccctgccatctcaccagtatgtgtgcaccttaccctgccactgcagcgcgagagtgcagtctgaccctctctcactgctgaccatcattgcagatggagccttgatgagcacagagcgaattctgccccgacggtgccctgcccttgcactaacactgctgtgggagtgaaactaggtgcagaaaacaacagatctctccctggcctgagcaattactcatgcttgtgaggcacagagaaagctcacagacctgcacctgccagcatccagctcccaagccaacaccacaaccagtgcagccatgcacaccctcaccagcaggggcccctgctccccctagctgcattgcctccaccactatggtgaataccctcagggaggcaggcaccctagtaccctgccgcagttgccactaccactgctgctggtacctgtgaatgagaatggatcccactataactgcactacaaatgctttggctgacactgtgggcagcaagccacccaggtgccaaggcaagagaccaagggcacgagctgttccagtataataaaatatataaaataagaatagttatactagatatagatcttagatacgattttatatgaatatcattaatcattagtttgtagtaattactctttattccaatattataataatcctcactctacaatcataacctaggaaaaaccaggccatacagagataggagctgaggagacatagtgagaagtgaccagaagacaagagtgtgagccttctgttatgcccagacagggccaccagagggctccttggtctagcggtaacgccagcgtctgggatgacgcccgttaccaagtggaccgtggtctagtggtagcattagtgtcaaggaaaaacacctgctacttagcagacaaggaaaggaagtctccctttccctgggggagtttagagaagactctactcctccacctcttgtggagggcctgacattagtcaggcccacctgcagttttctggaggcctaaccatctccctgtgatgctgtgcttcagtggtcatgctcctagtctgccttcatgttccatcctgtacacctggctctgccttttagatagcagtagcaaattagtgaaagtactaaaagtctctaataagcagaaataatggtgtaagctgtctctctctttctcctctctctctctgccttggctgccaggcagggaagggcccccgtccagtggacacgtgacccatgtggccttacctatcactggagatggttcacactccttatcctgcccctttgtcttgtatccaataattatcagcgcagcctggcattctgggcactaccggtctctgcatcttggtggtagtggtcccccgggcctagttgtcttttcttttatctctttgtcttttgtctttatttgtacgctctctcatctctgcacatggggagaaacccaccgactctgtggggctggactctatagacaccacgcactggaatgtagtgaccagtggtctcggagtctgggagcaccttgaccaccaccaccccctcaatcccactgcagtgggtttctaactttgaggagccagaaaacgaagttggagcccaacacaagtcccccagagttagaacacatagtacaggaattggaatctgagcctcggctctgtaaaatcttccagaaatgaaaccagtcagctgaatataccttatactatgagcaaaccctcaaggacatcaaatagaataaaagaaaaaaaaacattcaaaggtcagcaacctcaaggattgaaagaacataagcccacaaggatgagaaagaaccagcataagaaccctgacaattcaaaaagccagagtgctttctttcctccaaattacctcatcacctctcaagcaagggttcagaaccagaagagatggttgatatgacacaaatagaattcagaacatggataggaatgaagatcactgagctacaggaatatgttgaaactcagtccaaggaagctaaaaatgatgataaaacaatgcagaagctgacagacaaaatagccagtataaaaaagaacataaccaacctgatagtgctgaaaaacataccacaagtcataatgcaatgacaactattaatagcagaacagaccaaacagtgggaaaaaaatctcagaactcaaagactggttttctgaaacaagagagtcagacatgagcagaaaaaaagaatgaagaggaaggaacaaaacctccaagaaatatgggattatgtagagatcaaatctacaacacattggtgtccctgaaagagagggggagaatgaaaccaacttggaaaacatatatcaggatatcatccagagaacttccccaacctagctagagaggccaacattcaaattcagagaacccccagtaagatacttcacaaaaggatcatccccaagacaaatattcatgagattctccaaggacaaaataaaagaaaatgttaaaggcagttagacagaaagttcaggtcaactacaaagggaagcctaccagattaacagtggacctctcagctgaaaccctataagccagaagagattgggggccagtattaaacattcttgaaggaaagaaattccaacccagaatttcatatccagaaactaagcttcataagtgaaggaaaaataagatcctttcagacaagcaaatgctgagggaatttgttaccaccaggcctgccttacaagaactcctaaaggaagtactaaatatggaaaggaaaggctgttaccagccacaacaaaacacactgaagtacacagaccagtgacactgtaaaggaaccacaaacaaatctgcaaaataaccagctaatatcatgatgacaggagcaaatccacatgtatcaatagtaaccttgaatgtaaatgtgttagatgccccagttaaaaggcacagtgtggcaagctagataaagaaccaagacttatttgcatgctgtcttcaagagacccatctcacatgcaattgcagacataggctcaaaatagagagatgaagaaaaatctaccaagcaaatggaaaacagaaaaaaagcagggattacaattatactttcagacaaacagactttaaaccaacaaaaattttaaaaagacaaagaagggcattaatggtaaagggttcaattcaacaagaagacctgactatcctacatataggaggaggacccagattcataaaacaagttctcaactttaaagatatttacactcccatacaataatagttttggagaatttaacacctcattgacaatattagatcattgagacagaaaattaactaagatattcaggacctgaactcagcactggatcaaatgaacctgctgacattgacagaactctccacacaacaacaatagaatatacatttttctcatcgccacatggcaaatactctaaaatcaatcacataatccaaagtaaaacactcctcagcaaatgcaaaataactgaaatcataacaaacaatctgttggaccacagtgtaatcaaattagaaattaagactaagaaattcactcaaaaccatagaatcatggaaatttaataacctgctcctgaatgacttttgggtaaataatggaattaaggcagaaaccaataaattctttgaaactaatgagaacaaagacataacataccagaatctctggaacacagctaaggcagtgttgagagggaaatgtatagcactaaatgcccacatcaaaaagttagaaagctctcaagttaacaacctaacatcacaattaaagaacttgagaaccaagtgaaaactaacctcaaagctagcagaagacaaggaataaccaaaaattagagccaaactgaaggagattgagacacaaaaaaccattcaaaagatcaccaaatccaggagctgatttttttttttgaaaaaaatactaaaatagaccactagctagaataataaataagaaaagagagaagatccagataaacacaatcagaaatgacaaggaggatattaccactaactgtacagaaatacaaataatcatcggagaatattatgagcaaccttatgcaaataaactagaaaatctagaagaaatggatgaattcctggatgcatacaccctcccaagactgaaccagtaagaaattgaatccctgaacagaccaataacaagctctgaagttgagtcagtaataaatagcccaccaaccaagaaaaagcccaggaccagatggaatcacagctaaattctgccagatgcacaaagaagagctggtatcattcctgctgaaactattccaaaaaattgaggaagagaaactgctctctaactcattgtatgaggccagcattatcctgataccaaaacctggcagagacataaccaaaaagaaaaataataataaaaataaatttaaaaaaacacttcatgcctatatccttgatgaatatagatgaaaaaatcttctactaagtaatggcaaacagaatacagtagcacatcaaaaagcttattcaccatgatcaagtaggctttatccctggaaaatcaataaatatgattcaccacataaacagaaccgaaaccaaaaactacatgaccatctcaatagattcagaaaagagtttcagtaagattcaactccctttcatgttaaaaccctcaacaaactaggcattgaaggaacatacctcaaaataataaggaccatctccaaaatcccacagccaacatcttactgaaggggcaaaagctgtaagcattccccttgaaatgaggaacaagacaaggatgccctttcttaccattcttattcaacatagtactggaaataccagtgggaacaatcacgcaagagaaagaaataaaaggcatccaaataggaagagaggaagtcaaactatccctgtttgtagacaatgtaatcctatatccagacaatcttatagtgttggcccaaaagcttcttaatctgataaacaacctcagcaaagtctcaggatacaaaaatcaatgtgcaaaaattactagcattcctatgcagcaacaacagtcaagctgagagccaaatcaggaatgtgatcccattcacaattgccataaaataaaatgaaataaaataaaataaaataaaataaaaacctagaaatgcaactaaccagatatgtgaaagatctctgcaatgaaaactacaaaacactgctgaaaggaatcagaaataacacaaacaaatggaaaaacattccatacttatggatagactcaatattgttaaaatggtcatactgcccaaagcaatttatagattcaatgctacttctattaaactaccaatgacatttttcacagaactagaaaaaaattattttaaaattcacatagaacccaaaaagatctcaaatagccaacacaatcctaaggaaaagaacaaagctggaggcattacactacccaacttcaaactatactatagttgggcaaaagtatactatagggctacagtaaacaaaacagcatggtactggtacaaacacatacacatagaacaatgaaacagaatagagagcccagaaataaggctgcatatctacaactatctgatgttcaacaagctgacaaaaacaagcaatggggaaagaactccctatttaataaatggtgcttggatcactggctagccatatgcagaagattaaaactagaatctttccttataccatatgcaaaaatcaactcaagatggattaaagacaattttaaaatctaaaactataaaaatcctggaagacaacataggcaataccattctggacatagggatgggcaaagatttcatgatgaagatgccaaaagcaactccaacaaaaccaaaattgaccaatgggaccaaattaaacaaaagagcttctgcacagcaaaagaaactatcaacagagtgaacagacaacctacaaaatgggaaaacattttttgcaaactatgcatctgacaaaggtctaatatccagcttctagaaagaacttaaatatataagagaaaaacaaacaaccccactaaaaagtgggcaaaggacatgaatagacacttttcaaagaagatatacttgtggccaataagcatatgaaaaaaagctcatcactgatcattagagaaatgcaaatcaaaaccacaatgagataccatcttacaccagttagaatggctattattaaaaagtcaaaacataacagatgctggcaaggttgtggagaaaaaggaacgtttatacactgttggtgggagtgtaaattagttcaaccattgtggaaaacaagatagtatggtgcttcctcaaagacctaaaggcagaactaccatttggctcagcaatctcattactgggtatatgcccaaaggaatataattgttctctcataaagacatatatgtacatgtatgttcactgcagcactattcacaatagcacagacatggaatctatctaaatgccaatcaacggtatactggataaaatgtagcacacatataccatataatactatgcagccataaaacagaatgagattatgtcctttgcaggaacatggatggagatggaggccattatccttcacaaactaatgcaggaacagaaaaccaaatacaacatgatctcacttataagtggaagctaaatgatgagaacacatggacatttagagaacaacacacaccagggcctattggagggtagaggatggaggagggagaggatcaggaaaagtaactaatggatattaggcttaatacctcagtgatgaaataatctgtacaacaaattcccatgacacaagtttacctatatacaaacctgcacatgtacccctgaacttaaaataaaagttaaatttaaaaatatttttagaagataatgttagcccaacacttcaaggtgattgctgttgtccatggtattgataagaggaaacttgatacttcccagagaaaattaccctgagaaaatttttccttctggactttttgttattcaaatgtggcccaagcccctgacatagaccctcatgccttctttccgacatgggacagagacaaccaggacaggcttaccccagcactgaggaacaattaagccaaattcaagatgattgatcagtgatgctttcagagaaagatcttgatcaaaagaagaaaatgggaagttgatcataccagttgggtcaattttgtcatcctcaactaaatcatattcaagggatcgaaggggaaaatcactcagaacatataacattgctccaagaatataattttctgaaatcttggcttatgaaactgccagttgtagcctgaagccagttttatctaatagctactgaaacatcttgctgagatgctagactaggtttatccacaaccatcactcaccaatcagtacttgccagctccctaaaaaatgttactagtgccaatgaactttctttcaaaacaatataaaacatttctccttcttgtggaaactccaacctttttttgcctccacacaaaaaagactgaagatcaaccagtctgtatgcatgtcccaaattgtaattcttacttccctaataaaacattttgaatttagaaatttgtctctatattttatttgacttcaacatattcatattatgggatgctactcaggaataaaaaagaattattgatatatgaaactacttagatgaatcacaaaaaattatgctgagtgaaaaaagccaatcctgaaatataccgtatgattctatctttgtagcaatcttgaaatgacaaaattatagaaatcgtgtattattagtagttgccaagggttaaggatgagggaggaggcatgggatgaaggtggatatgtttgtaaaatagcaatatgagaaattattgtgttgagagaactgttctgtatcttgaatgtggttgtagagatacaaacctacacgcatggtaaaattccatagaattaagtacatacacaaatgaatacaagtaaaactatctgaataagatcagtgggctgtatcgatgttaatattctggttgtaacattgactgtaattttgcaagatattaccatcagggaaactgagtcaaagttaccagagagctctctgtattatttcctacaattgcatgtgaatcttcaattatctaaaaattttttaaaaaggtaaattttagaaagcacttgcaaaaaaaataaaagcagcccaactctgatggctgtccattgcctacagaattaaagttcaaactctttagcttcatactccttgttccctgcaaaccaactttaaattccctttcgaatcttaccttccaaaagccttgtgcacaaactggctattcttgggaggtccttgtggcagcttgaccactcagcttatgcattcctgctgccctgctcccttccccacccccatcttcatctcctcatccacttaccccaatcctactctccttcaagccttgcctctaaatggcacctccagctggaaggaatttctcccttcttggagttcccacagcactattccaccttgtattgcagttatgtgtgtattgtttcatgttctccacaaagctatgagcttttcttggacaagactgaaattcatttatctctgatcccctcatgctagtaagtgccagcatgtgtcactcagaggcagccaagatagtggggaacatacattccacccagaggggtggagatctctgaaggaaagccagctttggatctagcctgacttcctcttcaggcctggttccaccacttctttacagtttggcctttgactctatcctaagtttccgcaattgataatagcagtgtgtgaaaaaaacaccttcctcaatacctagcacatagtagacactcagaaagtgcagctggagtttggggacttggtttccagttcctgtttggtcacgtactaattatataggcttaagcaaacaacttgttttccttttatattcagtttctctgcctgtagaatgggcacaaaatatttatgtctgaagtaagattgagttatgtgtgtaaaactactttagaaatgttagagaacaatattcaaggagagtactgattgtggagtatgaatgagctaacagtcacttgagtgttgaccacaagccaggcactgctctaacaattttacatgtgttcactatttaaatcttactatgattgtgtgaggtggagaccactgctatccctattttataaatgatgagactgggtatagaaaggttaactaagtggcagaggccaggagggctagctagctccaggtgtagagcattttacaccatgctgcctttctattaggtgttgttgaaagggcgttgttggaccttcataattataattttggaaatctgtttcttttcatttcctacaaggttctccttacaaacacctttgcttaagctctgtagaaaactaacagcagttgtatttcacacccttcacaacgagttaagtatcttctttacaatttttgacttcctggatcagggttacctaagaatcccttccctaatcccattcaagtgttttctactccctccaagtctgttcccaacctgtctgcttttgcctagcacccagctgcttcaaatagctcctcattggtagagatattatctcccacttcttagagaaaggaagccaccaggcaaaactcaccagctcctggaccatgcacattcttgggcattttctctttccttaatccatggctactagcttcatctgagccgtggattgtttttcaatatgtagtcctagtatcacctgtattggaatcaccggggatgcttgctaaaccacccagctccagtctacagaatcagaatctggaggtggggcctgaagctgggtgggaggggtgtctagattttaataaggcccctcaggtgactctgatacagaggcaagtttgaggcagctccttcagaactttgcttaatcaatcgtgtcttttctaacctaccagtctctctcactgtcaattagattctttctcctggcctgtaaatatactcaggtctcgactattctaataagaaaaaatgttacatcatggggttgtggtgatgaatagtgttaatatacataaagccaacagcacctagtacatacaatacatatgttggctatctttttttcttaaattttttttgtagttaactaaagcccatagtttatttggatttcctcagtttttacctaatgttttttctgttttgcaatctcatcctatgacatgtaattgtcatgtctccttaggcttctcttggctatgacagtttctcagactttccttgtttttgtttatcttgacagctttgaggagttgtagttaggtactttctaagatacccctctattgaactttgtctgattttttaaaaaatcataattagaccaggattatgggtctttgggaggaagatctcagaggtaaagtatagttttcattacatcacatccagggtacatgtacatactattgacatgatttataactgttgatgttgatgttgatcacctggctgacgtgttcgtcacatttctccattgtaaagttatgcttttcctgctttgcatactctttggaaggaagtcagtacgtgcaggccacttgaggggagatttatgcttacctctttgagggcaaagtagctacataatttttaaaaattatttggaattcttctgtgtggaagatttctctctaacccatttattaatcatttatttatatcagtatagatttaaggatacatattttgtgcttggggttataacccaatgctactttattagattgtaatgatttgttcaaattgtttcagctttggccattgggagttctttcagctggttcttatgctcctttgaccttctcattaatagactgcaggttttttgtgtgtttcagcaattcttggcattataagatgctccagactcatcttgtatattttctaccccattgctagaattaaccgtttctcaagtggaatggtatttttttttttaaaaaaatctattatgctggtttgtactgggaagtcattgttctcagactccctcaactgagagggcaaagaaatatatgtgtgtacacttgtccttgtctatacgaatatctataaatatttctatctatatctatttgcatctatattaagttaaatatgagttcttactgatgtctttgactatacccattactatatgcatcattctagccatcctcttgcagatctagaaatttccattccaacagtgagacatctggctcccatcttctgccatgtttacttagtcatccaatcccagtatatatgtatagtgggctcagaattgttaacttttcttaacttcatttccctgggaaatgtctttatcaactagtacaatgtttatgtatagttccttgactgttgtcttacatactccatttatttccagaatgacttcggttggtgttttccaaccccttcggtggagttataacagagtctctggttacagtctgcattctttcctagaggaatgtagtgattgtcacaatcttaagtaacacatccattgccacccatgatgtacattagatcttcagaatatagtgagtcttgaaatctagtcagtcctccaacattgttcttcagtacagtaagttattctggtttctttgcccttccacatgacttttaaaatcagtttgttactatccactaaatagcttactcagattttgatagggatcatgctgtacctgtaaatcaagtagggaaaaattgacaacaatattaagtcttctaatccatgaacatggaatatctctccacttgtttagatcttctttgacttctgtcatcagagttttgtagttctctgcatacagaacctgtacatattttgttagatttatgcctaagaatttcaagtacatctaagtattttgatgctaatataaatggcacggtgttatatatttcaaattccaatggttcattcttggtataaagaaaagcaatagggttttgcatattaaccttgtattctgcagtcttactattgtcacttattagttttagaaaggtttttgtgggtttttaaaatttattctatgggactctctacacagacattcatatcatgtatgtcacatataaacaaaagcagtttaatttcttccttcccagtgtgtacactccttgtttctttttctttgcactaactgggacttctagtacaatattaatcaggagcagtgagcagggacattgtgctttgtactcaattttagggggaaaacattcagatttttttttttttttttggtgagacagagtctcgctctgtcaccaggctggagtgtagtggtgcaatctctctgctcactgcaacctctgcctcccaggttcaactgattctcctccctcagcctcctgagtagctgggactacaggcacctaccaccacgactggctaatttttgtatttttagtagagatgtggtttcactatgttggccaggatggtcttgatttcttgacctcgtgattcacccaccttggcctcctaaagtgctgggattacaggcgtgagccaccgcagctggtcaacattcagattcttatccataagtacatcaggtgtgagtttttgtagatgttctttatcaagttgaagttgttttttctttctagtttgctgacagtttttatcattagttaccatgaattatggattttgtcaaatgcttttgctgaatcagtggtgatatggttaggctttgtgttcccacctagatctcatcttgaattataatccccataatccccacatgtcaagggagagaccaggtggaggcaattttatcatggggggtggcttctcccatcctgttctcataatagtgagtgagttctcacgagatccgatggttttataaagggctcttcccccttctctcaacacttctccttcttgctgccttgtaaagacggtgccttgcttcgcctttcccttccaccatgattgtaagtttcctgaggcctccccagccatgcagaactgttagtcaattaagcctccttcctttacaaattacttagtcttgagcagttctttacagcagtgtgaaaatggactaatacaagtgtttagaagaatatttttcttctttaacctgttgatgtgatatattgacttaaaaaaaattaacccagccttacataactgtgataaatgctatttgtgacatataattctttttacacgttgttgcattcaaattgctattattttgttgaagatttataatcacaggtggtctgaagttttcctttcttgtaatgtctttatctggttttgttattaaagtaatgctttcctgataaaatgaattaggatattttctctgtgcttctattttctggaagaaataatagaaaattggtattatttctttcagtatttagtagaattcatcagtgaaaccatctggagttgttggtttctttaatagaagattgttcattattgatttaatttctttaatagagacacattcatattattcttgtatgagtttttgtagttcttgtctttcaaggaatttatctatgaaacataaaatttgtgggcatgcagctgtttactgtaaggctttgttaaccttttaatgttcattggagcagtagttataacccctatttcatttctgatactgtcaacttgtgttttctctctttttttcttggttagccaggctagacgcttatcaattatattgatcttttcaaagagcaagtgcctggttttgttaattttccttattgttttacatttttaaattttattgatttttattgtaatttttattatttaattctgtttgcttaaggcttaaatttctctttttttcccaagtttcttaaggtagaactttaaatgattgatttttagagtttttcttttttccaagatggcaattcaatgctataaatttccctgtaatcactgctttcattgcacccaacatagtttgataacttttatttttattttgttttatatatttttaatttttcttaagacttattctttcatccatgtgttatttagaaaagcattgttacatctccaaatatttgggaatattctatcattttgttattgatttccagctcaattacattgacacttgaaaatataatttgtatgatttcttatcttttaaatttgtccaggtatgttttgtgacccagaatgtgatcctggtaaacattccatttgagaagaatgtgtattctgctgttgttgggtgagatactttttatatgttaattaaattgctaattggttaatgatgttgttcacttcagctgtattcttactgattttctacctcctggagatatcaattactgggagagttttttttatttaagtcttcaaccataataacagatttgtctacttctcttttcggttctattagtatttgcctcatgtcttttggtgctttgctatcaggtgcatgcacgttaatgattattatgtatcttggaaaattagcccttttatcattatgaaatgcccctgataatttatccctgatgattttccttgttctgaaatctgatttatttgaaattaacaaatctactccaactttctcttgcttagtattattatggtagacatttctctatcactttacttttaacctatttgtgcttttatattttaaatgggttttttttgtaaacaatatatagttaggtctcctttatctattctgacagtctctgtcttttaatttacatattcaaaccattcacattttaatatgattatggatatagttggtttaataactaccatgtttgtaactgttttctattaattgtactttttattttttattttttccctctttttctgccttctctagttgtagaacattttatgtcattttatatttcttctctcttagtacaacagttaccacaatttaaaaaaattttaatagctgctctagaatttgcaatgtataactttatgttcacctttaaataagactatgccactttacattcaattcaagtaccttataacatagtatttccagttcattcctgccatcctttatagtattggtgttattcatttcattcattcatatgctataactgcttgatatattgttaatataattacattgaacagttatctattagatcaatcaagaataagaaaagattttattttaccttcattccatctctagcattcttcctttcttcatttcttttttcctttttttcatttcttttatttgtttatttttttaatttttattttacgtttggggtgcatgtgaaggtttgttacacaggtaaacttgtgtcttgggggtttgttgtacagattatttcatcacccagctattaagcccagtacccaacagttatcttttctgttcctctccctcctcccaccatccaccatcaagtagagcccagtgtatgttgtttccttctttctcaagttcttataatttagctcccacttataattgagaacatacaatagttggttttctgttcctgcattagtttgctaaggataatggcctccagctccattcatgttcccacaaaagacatgatctcattcttttttatggctgcatagtattacacggtgtagaggtaccacatttgctttatacaacctgtcatcgatgggcatttaggttgattccatgtctttgttattgtgaatagcgctacaatgaacattcacgtgcatgtgtctttatggtaaaatgatttctattcctctgggtatataccaataatgggattattgggttaaatggtaattctgctttttgctctttgaagaattgccatactgcttttcataatggtttaactaacttacatttccaccaacagtgtataagtcttcccttttctctgccacctcagcagcatcagtttttaaaattttttttttaatagccattctgactggtgtgagatggtatttcatggtggttttgatttgcgtttctaatgatcagttacattgagctttttttcatgtgcttgttgggtgcgtatatgtcttcttttgagaagtatctattcatgttctttgcccactttttaaagaggttgtttttctcctctaaaattaagttccttgtagatgctggatattagacctttgtcagatgcatagtttacaaatgttttctcctattctgtaggttgtctctagtctggttggtagtttcttttgctgtgcagaagctcttaaatttaattagatcccactggtcaatttttgcttttgttgcaattgcttttggtatctttgttataaaatatttgcccttttttatgtccaggatggtagtgcctaggttgtcttctagggtttttatagctttgtgtttttttcatttatttttaatattttaaaagtttattactgttcaggggtacatgtgtaggtttgttatacaagtaaatcacatgtttcaagggtttggtgtatgttttgttttgttttttcacccaggtaataagcataatacctgatagtctttcaatcctcaccctccttccaccctccaccctccagtaggccccagcgtctgtagttcccttctttgtatccatatgtactaaatgttaagctcccatttataagcgagaacatgtggtattttgttttctgttcctgtgttagttcacttaggataatgacccccagctccatccatgttgccacaaaggacatgtcattctttttgtgactgcatagtattccatagtgtatacataccacattttctttatccagtctacattaatgagcatttaggttgattctatgtctttgctactatgaatagtgtgctacaatgaacatatgcatgcatgcatctttatggtagaatgatttatattcctttgggtatatacacaataatgggattgctgagtcaaatggtaattctgctttgaattatttgagaaattgcaaaactgctttccatagtggctgaactaatttgcattttcactagcagtttgtaagcactcccctttctctgcaaccttaccagcatctgttgttttgactttttaataatagccattctgactggtatgagatgatatctcattgtggttttgatttgcatgtctctaacaattagtgatgttgaacattttttcatatgatttttggccatgtgtacatctcttttgagaagtgtctgttcatgccctttgtccattttttaatgaggttactttttgtttgtaaatctttttaagttccttatagactgtggatattagacctttgttgaatgcatagtttgcaaatattttctcccattcagtaagttgtctgttgactctgttgacagtttcttttgctgtacagaagttctttagtctaattaggtcacatttgtcaatttttttttattgcaattgctttgggcatcttcatcatgaaatctttgccagggcatacgtccaaattggtatttcctaaggattttattagtttttacagttttaggttttaattttttacagttttaggttttacactgaagtatttaatccatcttgagttgatttttgtatgtggtataaggaaggggtatagtttcaatcttctccatgtagctagctagttatcccagggccaatggggactcccttctccattgcttgtttttatgacgtttgtcaaagttcagatggttgtaggtgtttggctttatttctgggctctctattctgttctagtggtctacatgtctgtttttgtatcagtaccatgctgttttggttactgtagccctgtagtatagtttgaagtcaggtaatgtaatgcctccagatttgttctttttgcttagtctttctttggctatgtgggctcttttttggtttcatatgaattttaggattgttttttctagtcctgtgatgaatgatggtggtattttgatgggaattgcattgaatttgtagaatggcagtatgatcattttcacaatattgattctacccatccatgagcatgagatgtgtttccaattgtttgtgttgcctgtgatttctttcagcagtgttgtgttttccttgtagaggtctttcaactccttaagtatattcctaagtattttattaattttttaattttttgcagctattgtaaaaatggttgagttcttgattttattctcagcttggtcacagttggtgcatagccgggctactgatttgtgtacattaattttgtaacctgaaacttttgctgaattaatttaccagttctaagagctttttggatgagtctttagggttttctagatatacactcgtgtcattagcaaaagcaatagtttgacttcctctttaccaatttggatgccctttgtttctttctcttgtctgatcgttctggctaggacttccagtactatgttgaatagaagtggtaagagtggacatccttgtcttgttctgtttctcagagggaatgcttccaactttttcccattcagtataatgttggccgtgggtttgtcatagatggcttttattaccttaaggtatgtcccttctatgctgactttgctgagagttttaatcataaagggatgctggattttgtcaaatgttttttctgcatctgttaagataatcaagtgatttttttgtttttaattctatttatgtggtgtatcacagttattgacttgcatatgttaaactctcactggtgtgaaacccactcgatcatggtggattatcttttttatatgctgttgtatttggttagctagtgttttgttgatgattttttgcatctatgttcatcagggatattggtctgtagttttctctctctctttttttttttaagttatgtccttttctgggtttgttattagggtgattctggcttcatagaatgatttatggaggatttcctctttctctatctttcggaatagcgtcaatgggattggtaccaatttttctttgaacgtctgacagaattcagctgtaaatctgtctggccctggactatttttccttggttactttttaattaccatttcaatcttgctgcttgttgttggtcttttcagagtttctaattcttcctggtttaatctagaaaggttgtacatttccaagaatttattcatcttctctaggttttctagtttattcaaatagaggtgttcatagcagccttgaatgatcttttgagtttctgtgttattggttgtaatagctcctgttttatttctaattgagcttatttgtgtcttctctcttcttttcctggttaatctcaaaaatggtttatcgattttatttatccttttaaaaaaccagctttttctttcatttatctttttgtatttttttgtttgaatttcatttagttatgttctgaacttgtttatttcttttctactgggcttgtggtttggtttgtgaccttagattttctatttgtgctctttcagactttgatgtaagcatttaatgctatgaactttcctcttagcaccacctttgctgtatctcagaggttttgataggttatgccactattattgttcaattaaaagaatttttaaattttccatcttgattgttgactattattgacccaatgatcattcaggagcaagtttttaatttccatatatttgcatggttttgaggattccttttggatttgatttccaattttattccactgtggtctgagagagtacttgatataatttcagttttcttaaatttattgagacttgttttgtggcctatcatatgggagtgtgtttctcaggccaatggagttatgtttccaggggggattatggctgccttttctgtgtgatgcaggtcgccagggaagtgggggaaagctggcagttaaaggcctcacccagctcccatggagcccaaaaggccgatctcactcccactgtgcccgcccgatggcaccaagtttatttccaagtagtgggtgagcagggctgagaacttgccccatgttcccagactcccagttgagaaagcaaacagggtttttaggttttgtgcctccctgcctccagcagcttctgtgctgtgtctgcactcctgattcaccccctcccctgagttctgtctgggaaactttgcgtccagttgaaattgttacaacattcaactggaagtttccttctccctgtggtcttttcccagttcctctggcagccctccctaaagatccctctgagacaaagtcagaaatggcttccctagggaccaagagagcccacaggctcttcctgctgctgctgcttctactcctgtattttgctcagctctctaagtttgtctcagctccaggtaaggtcaaatccttctcctatgatctggaccttcaggttccccagtgaaggtgtgtgtttgggggaggatggttcctctttcacacttgggacactcgcagttttttggctgtctcccagggccagcaggagcaatccacttccttcaaagggtctgtgaattctcttagctttcctggtatgttctgtagtagttcttggaacaaaagttcatgatatgagtctctacatgctgctacatccacacgagtgggagctacaatttagtcctgccttctatctgccatttttctcctcctgcctggcttctagtgcagagcatgagtggaattacctgcactgccatcagggcatttcccaggacagtaggagactgcactctctgacttagtccacacaaaagtgggaccactctgccaaaagctctagcagatgttgccttcctgggtaccagtggcagaagtgggtgcggtcacacaccctgacatccaggtactacccagatcaacaggagactgcaccatccagctgagttcagacagaagtgggaccgctgagtcagaagcattgcccacctggctgcccacttcagactgaagtgggaccactgggccagaagtcgtcagcctgttctggcaaggtgtggatggagcaatcttactgttcccaggcaccatatttgtagcctttactggggctatggtatcagtgcttgtctgctctggggcccaaggcttgtagaggccccctggactcaagcattgacccacaaaacatctaggtggctctctgcctcagtctagaagcatggttgggggatgcagtgggggaagggggattctcccattcccagccttgcccgggtccctgtggagagtgtgaatcccctagagggctcccattcactcaccctttcccatgttaaagagggtctcctggctccctgctgagtccagacaggctggcacccagcttcactcctctctgctctctgtatccctggttgccttgctggatctcaacgtggtttctcagatgattggcctgcaggatcggtgttcacaagcccatccgtttttcttcatgagagcagcatacacgagctgcctttagtccaccatattggccccctccaccaagtatcctttctttatttaaatctgagttctgagctatatcatttttcttctccttgaaaaatttcttttaacattcctgcagggcaggtgtgataatgatacatttccattgtgtgtctgagaaactatttttctccttcacttttaaagaataattttgctgtatataaaattctaaggatggtgagtgtctttctttcaatgctttaaaaattgcactgaattatttttttttttggtcttgtttctggcaagatgtctgatgtaattcttattttgttcttctgtaggtaagattttttccccttccatcttcgtttaagattttctctttgtctttgggtttctgtagtttgaatatgatatacctgggttttaattttttggtattaatatttatcctctttggctttccgtgagcttcctggatctgtggtttggtatctgtgattaatttttgaaaactctcatccattgttatttcaagtatttcttttcctatatttgctctcttctatttctagaattcaaattaaatatatcctcttctatttctagaattcaaattaaatacatcctcttctatttctagaattccaattaaatatatcctcttctatttctagaattccaattaaatatatactttttttttgtaattgtctcacaattcttgaacattctgttctttttattatcattattcttttattttgtctttgcatttcagtttgtgacattgctactgatgtatcttcaagctcactaattcttgtctcagctgtgtccagtctcctggtgagcctataaaaagcattctttagttctattacagtaagtcctcacttaacatcattgataggttcttgaacactgcaactttaagtgacatactgtgtaaggaaaccaattttcccgtaggctaattgatataaacaagagtaagttcctacagcatagagtaccttgttttgcttaaagctgcaatgtctgagaacctatggatagcataaagtaagaacttaactatatggtgtttttcatttccagcatttcttgattcttagagtttctgcctctctacttacattacctatctgttcttgcatgctatttttttgaatagggcccttcatattaaaccattgattttaaattccctgtctgataattccaaaatctgcatcatatctgaatctgattcagatttttgctttgtttctttatattatgaggtggtttttctttttacctttttgtgtgatttatctatttttgtttatagatatattgagtaattatatataattatattgagtattatatataatgtatgtaattatattcagtattatgaagccagatatattgagtaattataactcagataatcaggcctctagtatggagattcactgttcatctggttacaggttgggctgtgtttaatgtttcctatagctataggtgcccaaggctttagtttcctctagaatccttgttttatttttctactccattttctttgggtttccctaagaaatccttctaaaatagtgtggtagttctttcagttataatctacttttattaatttgtacctctgttgatgtaccgataaggtatagtagaggaaacggttctacaatctcatgtttaaatctgttttttttttagtgtgcctgagtctctaagcttcagaagtgtttctttgcctttatttttattttttgttcatctaggtgaaacaggaatgctacagaggtctagagttggctcagtgctttcaccccaggtagatacaactttggtaaagttgtttctctatcctgggccacaaacatattctcctacttttttcagtttaactttagtttcacctttcacaataaagtctttaacttaactttgtatgtaaaattaatatttacgtacaattccaagccccctacatgatccaatcacctcctaccagggccccatctccaccattgggaattacatttcaacatgagatttgggtggggacatagcaccaaaccctatcagacattaaccttggtcatgcagctgaggtaatgtttgtcaggtttcttcactatataatcattctcatcatgtattgagctaggtttatatttcttatgtagtgaagcaggtttctcagtgctatctaccaattagttagatgtgtatttgtaatggaaaaaaagtattgagagatttctcccaatgttgggggatggagtttggggtagggctggaggaatgagaaaaagcttcacagagaccatgctgtgccatctgaagtgaactttgaagggaggagaggacaatggggaaaggcatttcaggcagaatgatgccaacagagctaagagccaataaagcatctatgagtgaaatagtagttgaattggaatccaccctggaaatcatctgtggcctaattacctcatttcctaggtgagtactataatttgcccaaggttacacagctagaaatttgtagagctgggattcaaactcaggagagtgacttcagcacttattttcccaacacagaaggaggttaagacctactcagggtggcccagccaatcagatgcatagccaggacaaagccatcagttcctgtctcccagttcctctactttcacaagtatacaccttgaaacataatgctcagaaatcctatgggaattttagtgatggagttaacatagtcctctggggttaagggaaataaggttctgtaggaatcagaaatcaaatattctcaggaggcagagaggatttatagagtagcactaattacagttttgaatatgctgccagcatagtcttcttaattaaatgagccagaatacttctttggaaactttcctagatgatcaggtctgtgtaagtgaatacttatgccttatactcaaaggaatgcaccaaccacctaaagccagctctccccttgaagaagagagtggtgggaggagagtaggactagcagagaagggcctttccaggagtgatatcattatagcaattagaagtagattagatgttcacacaacagtacaaatggatgtgaaaaacatagtgtttactgaaaaacagtaagaaaaagagatgaggtatatggcacttcatcatttatgtaaattaaagaggtatgcccacaaaacaatattatacattttgcaggaacacattcatacaacatacatactaagcacattagagcagttgtccacaggaggcagggaaagaacatgactaagcaggatatgcatatatctttatatacatcgattgtgtttgtgtgtctgtgttacgatcctgagcaatgacaaggacagcagcattaaatgactttttagaagccctcatacttcttggcactattcagatttcctcattttctttttttctagcgtcctttttctgtctcaggatcctaatcatgttaccacattacacttggtgatcatgtctccttagctgcttcttggttctgacagtttctcagattttccctgtttctaatgatcttaacagttttgaggactactagtcaggtattttgtagaaattggtattggaatttgtctggtgtttttctcatgattaaactgacataatacatttttggaggaagaccacagatgtacataatcattctcatcatatcatatcaagagtacatatgatcaatgagacttatcactttcatgttgtattactctgttcttacactgctataacgaaatacctaaaactgggtaacttacatagaaaagaggttttaataggctcacagttctgtggactgtacaagcttctgcttctggggagaccttgggaaagttgcaatcatggtggaaggcaaaggggaagcaagtacatattcacatggctggcaggagagggagaatgaaaaaggaggtgctacacacttttcaaacaaccaggtctcctgagaactctattataagacagcattagggggatggtgttaaaccattagaaaccacccaaatgttccaattacctcccaccaggcctcacctccaacattgggaattacagtacaacatgagatttgcgtggggacacagagccaaactatatcagatattaaccttgatcacctggctgaggtaatgtttatcaggtttcttcactataaagttactcttctttttctctttccatatcatacttacagattacttactttaaaactttaaggctaattaataggattacaatagccaatgtttacaatgaagtgttttaaattattaataacaaaaaggtttttagacaagatggacaagatgcttcctttttcctgcactaacagtgggagagatgttttcttctgactcataaagcttgtacagagaatctgatttcttaaagtcttgagttgacatttacaaggatgttgatcttgttttccttcataatttggagatgtaaatatttcaaactttcctattggttctgctatttgtaaatatacagctgtccttggacacataaggtgagaataattatagcatatcacagtaacaatgtaagaatcaaggggactgataagcaagggactgagaatgttggaggaaaggaccttgttaacgtggcaactcaaggacagcttcatgaaagtcttaacatacaagtgttatttgaacaagtagaggaggccaacagtacaccacatgcactaaggcaggaaaggaaagaacatgacgtataggcaaagtctgccatgtgagagcatagggtgtgtagaacttatgcaacaggctaaagagtttgcacttcattctgtaatcctgagtgtggaggacaatggcatttttgggcaaggagagtaatatgatcagatctgagctttagaaaaataactggcaactatctaaatgaaatttgaaggataagagcctggagagaaacatagaagttattattaaaaactatgaaagaatatatacaaaagaggggatattgaaaataggagtaaaaatatgtagagagattatggaggcagaatagacaggccttggggccaatttcatagctaacagtggcagagactggcaagatccttaccaaacctgtatcttcctcttcctgggcacacagctggactacatttcccagcctctctggcattaggcacagctatgactgactctccagccaaaatgaacattatgggtgaaagtcatgtatgccactttcagacctatccttctaccataagactggaatggagagaactttcaagaccactctgagagtcatgcatagaatataatagaactatggggtagaaggagctgtagctcccaaattacttcctggagaattactcagcctgcaatagactttgagacaactgagaaataaactatttccctactgagcctttatatgcttggacttttctgtaatcacagcatactgtggactaccctaaccaaattaaacattgatactttgaagtgggtgctcctacaacagaaaactaaagcatgtgacctgggctggtgaggagacaaattattagagactggaatggctgaggagccctgttttgctatgccaaactatttgacaaaatggttgcctgcctaaagttctagaaaagtgattgtaagtcagaaagatagtgtgtgttggccactatggctgctttgagtaagatattacaagacaaaggtgtgcttgggcaaaaattgtgtgtggcaagcacaggtgaaaggaaacagagaatatctaatgttgggctttgaatagaagaggaaaaaactgcttctagatcctgaataaaaagaaaaaagatacaggaagccagaaaagtccattagactcacttggtagtacagatgagatgaagggtgttgatgtctcatgagcctgctagcttcaagttagtaagagaggcatggcgggtagttagacagagaaagaaaacatatttgaagggtgcatcagaaaagaagtgctgttaatgacacaggaaacagattagcaacaaatgaaacaaaaacctactactgtttgaggcaattttactaccaaagaaaccataagccgggtctagaaaagtctgtattatggagagttgctttttaaagaaaatctcaggaagaaagtgagtgtacttgggtctactctaacacccatgttggagatgaacaaatatgaaaatgaacagggaagagcttcccaaagaacaagactaggggcctcccagaacagtgagtgagaaagatcatcccatagagcagatcacagcctaactaaggacttcctcgtttagggtagagagcctttacaatgtctgcctagtgggatttctgaattgccaaggtccagtgaccacagtgtgcctcacattcttcctctgttttctaatgggcgttcattatgattatcttattcttcctctgtaatcatgtgcatggtgagtggccctgggggtaatggggaataactttcctttttcattaataggtcaccaaactcgagaagcaaaatcagcacctgatggcaattgctgcccatcactcagagatcctggacttgaggctgaatgctgtgatgggataggatttgagggaagggcacaagtgtgttctttgtgtgagaagcagagtgaaattgctttttgacaaccagtagggcagtctgtgtgaaaaagtgactaagggctcaccaagcctgattcctcttctttctaggcacacatgaagactgcatttcccagccttccttagagttatctgaggccatgtgactgagttatggccaatggaatgtgagttatggccaatggaatgtgaatgggtctgtttgttaccacagcagaatctagcctacctagactaacacactagcatttatagatacaagtatttgctacgtgctccatgtatattagctcatttaaccaacaaaaccaacccaatgagataggtgcaagtataatataatctccattttacactgaggacactgaaactgagagaagccccaaatcatacaaataataagatatagaccattgtacttgggagggtcctctctaacacccactttggagatggacaaatacgaaaatgaacagtgaagaacttcccaaagatcaagactaggggcctcctagaacagtgagttatagagatcatcccatagagcagaatcacggactaactaaggaagttatcttatttatctaagagcacaagagatagaaactcttcaccacaatgctctatcacttcttgaggccaaagataatttctatgttacttggaaactagaacaacagcagagataataatataatcctagaatattgggaaggtccctggcaatcttggtgaggaaagcacatgcagtattggagacatgagctagtgtgcaagggactggggtgttcacaggtggacatccacaagctgcatgcattggtggctccagaatttctgtgtcagtggctaaagggccgtcattgagttggcatgaggcttgaaatgcatatgcatagtactttccattagttacagaaaatgccaatattctttacttgaaaatgggacaaggaaagcaacagagtttgagggcctaaatcccacttatgccagccctgagtacttcctatatgcttgtggtcaagcccagcctcatctctcccagcttctcttcacacactggaagcctcacccaatccaaaccctgccaccctaccctttctcacttctgtgagcagctaggtggccgagtggtgagcgtgtcctaaatattcatccagagccgagtttgaattctggctctgcaatttattgtcactagtataacctcgggcatgtctataataatacctacctatgaggattgtcatgaggtttcaatgaaatcatgtatatgatgtgtttaacatagtgcctggcccataatacgcacttaaagtaaaaaaaaaaaaacttttgatgtgtgaaattccagtattttcagcttcaaacaacatctcctagatagctgctcacacccataagtgggagacagattctctgcagaccatgtattctgatttagggtgttgaaaagagagtcaatacatagcaattggagtccacaggaaagaggactcatcggggcctgggatggtcagcaaagccgtctggaggaaactgcacttggatgcagtttgaaggtggagttgattcatccaggaagaagtgagtgggcgaggcatggacaaatgcttaaaagcaggaagcacacggtatttcatggtggtgatttttattttgctaatataggctctacccagggtatcaatgagagctatgttaaaaaggtagcttagggaaagattataagggtcttgaaatttctccctcccttcttttgtttcttttcttttctttttttaattacacttttaagttctagggtatatgtgcacaacgtgcaggtttgttacatatgtatacatgtgccatgttggtttgctgcacccattaactcatcatttacgttaggtatttctcctaatgctatccctcccccatccccccaccccatgacaggccccggcgggtgatgttccccaccctgtgtacaagtgttctcattgttcagttcccacctatgagtgagaacatgcagtgtttggttttctgtccttgtgatagtttgctgagaatgatttccaccttcatccatatacctacaaaggacattaactcatccttatttatgactgcatagtattccatggtgtatatgtgccacactttcttaatccagtctatcattgttggacatttgggttggttccaagtctttgctattgtgaatagtgctgcaataaacatgcgtgtgcatgtgtctttatagtagcatgatttataatcctttgggtgtatacccagtaatgggatcactgggtcaaatggtatttctagttctagatccttaaggaattgctacactgtcttccacaatggttgaactagtttacacttcaacaaacagtgtaaaagtgttcctatttctccacatcctctgcagcatctgttgtttcctgactttttaatgatggccattctaactggtgtgagatggtatctcattgtggttttgatttgcatttctctgatgaccagtgatgatgagcattttttcatgtgtcttttggctgcataaatgtctttttttgaaaagtgtctgttcatatcctttgcccactttttgatggggttgtttgatttttttcttttaaatttgtttaagttctttgtagattctagatattagccctttgtcagatgggtagattgcaaaaattttctcccattctgtaggttgcctgttcactctgatggtagtttcttttgctgtacagaaactctttagtttaattagatcccatttatctattttagcttttgttgccattgcttttagtgtttagtcatggagtccttgcccatgcctatgtcctgaatggtaatgcctaggttttcttctagggtttttatggttttaggtctaacatttaagtctttaatccatcttgaattaagtttcgtataaggtgtaagaaagggatccagtttcagctttctacatatgcctagccagttttcccagcaccattgattaaatagggaatcctttccccatgtcttgtttttgtcaggtttgtcaaagattagttggttatagatgggtggtgttatttctgagacctctgttctgttccgttggtgtatatctctgttttggtacctgtaccatgctgttttggttactgtagacttgtatagtttgaagtcaggtagcatgaagcctccagctttgttctttttgcttaggattgtcttggcaatgcaggctcttttttggttccatatgaactttaaagtagttttttccaattttgtgaagaaagtcattggtagcttgatggggatggcattgaatctataaattaccttgggcattatggccattttcatgatattgattcttcctattcatgagcatggaatgttcttccatttgtttgtgtcctcttatttcgttgagcagtggtttgtagctctccttgaagagatccttaatatcccttgtaagttggattcctaagtattgtattctctttgtagcaagtgtgaatgggagttcactcatgatttggctgtttgtctgttattggtgtgtaggaatgcttgtgatttttgcacattgattttgtatcctgagactttgctgaagttgcttatcagcttaaggagattttgggctgagacaatggggttttctaaatatacaatcatgtcatctgcaaacagggacaatttgacttcctcttttcctaattgaataccttttatttctttctcttgcctgattgccctggccagaacttccaacactatgttgaagttccctgtcttgtgccagttttcaaaaggaatgcttccagtttttgcccattcagtatgatattggctgtgggtttgtcataaatacctattattttgagatacgttccatcaatacctagtttattgagagtttttaacatgaagcgctgttgaattttgtcaaaggccttttctgcatctattgagataatcatgtggtttttgtctttggtcctatttatgtgatggattatgtttattgatttacgtatgttgaaccagccttgcatcccagggatgaagccaacttcatcttggtggataagatttttgatgtgctgctggattcggtttgccagtattttattgaggattttcgcatcgatgttcatcaaggatattggtctaaaattctcttctttttgttgtgtctctgccaggctttggtatcaggatgatgctggcctcataaaatgagttagggaggattccctctttttctattgattggaaaaatttcagaaggaatggtaccagcttctctttctacctctgttagaactcagctgtgaatctgtctggtcctggagtttttttggttggtagcctattagttattgcctcaatttcagagtctgttatttgtctattcagggattcaacttcttcctggtttagtctagggaggatgtatgtgtccaggaatttatgcaattcttctagattttctagtttatttgcatagaggtggttatagtattctctgatggtagtttgtatttctgtgggatcagtggtgatattcccttcatcatttgtttattgcatctatttgattcttctcttttcttctttattactcttgctagcagtctatcaattttgttgatcttttcaaaaaaccaactcctggattcattgattttttttttttttttgaagggttttttgtgtctctatttccttcagttctgctctgatcttagttatttcttgccttctgcttgcttttgaatttgttttctcttgcttctctagttcttttaattgtgatgttaaggtgtcaatttttgatctttcctgctttctcttgtgggcatttagtgctataaatttccctctacacactgctttaaatgtgtcccagagattctggtacgttgtgtgtttattctcattagtttcaaagaacatctttacttctgccttcatctcgttatttacccagtagtcattcaggagcaggttgttccatttccatgtagttgtgcagttttgagtgagtttcttaatcctgagttctaatttgattgcactataatctgagagacagtttgttataatttctattattttacatttgctgaggagtgctttacttccaaatatgtggtcaattttggaataagtgcgatgtagtgctgagaagaatgtatattctgttgatttgtggtggagagttctgtagatgtctattaggtctgcttggtgcagagctgagttcaagtcctggatatccttgttaacgttctgtctcattgatctgtctaatattgacagtggggtgttaagtctcccattattattgtgtgggagtctaagtctctttgtaggtctctgaggacttgctttatgaatctgggtgctcctgtattgggtgcatatatatttagggtagttagctcttcttgttgaattgatccctttaccattatgtaatggccttgtctcttttgatctttgtttgtttgaagtttgttttatcagagactaggattacaacccctgctttttctttttcttcttctttttttttttttttttttggctttccgttcgcttggtagatcttccttcatccctttgagtctatgtgtgtctctgtacgtgagatgggtctcctgaatacagcacactgatgggttttgactctatccaagttgccagtctgtgtcttttaactggggcatttagcccatttacatttaaggttaatattgttatgtgtgaatttgatcctgtcattatgatgttagctggttattttgcccgttagttgatgcagtttcttcctagcatcaatggtctttacaatttgcatgtttttgcagtggctggtaccagttgttcctttccatgtttagtgcttccttcaggagctcttgtaaggcagtcctggtggtgacaaaatctctcagcatttgcttgtctgtaaaggattttatttctccttcacttatgaagcttagtttggctggatatgaaattctggtttgaaaaatcttttctttaagaatgttgaatattggcccccactctcttttggcttatagagtttctgctgagagatctgctgttagtctgactgggcttccctttgtgggtaacccaacctttctctctggctgcccttaacattttttccttcattttaaccttggtgaatctgacaattatgtgtcctggagtttctcttctcgaggagtatctttgtggtgttctctgcatttcctaaacttgaatgttggcctgccttgttaggttggggaagttctcctggataatatcctgaagagtgttttccaacttgtttccattctccccgtcactttcaggtacaccaatcaaacgtagatttggtcttttcacatagtcccatatgcctgggaggctttgttcgtttctttttactgtttttttctcttaacttctcctcttgcttcatttcattaatttgatcttcaatcactgataccctttcttccacttgatcaaatcggctactgaagcttgtgcatgcatcatgtagttctggtgccatggtcttctgctccatcaggtcatttaaggtcttcactactctgttaattctagttagccattcatctgatcttttttcaaggtttttagcttccttgcgatgggtttgacatcctcctttagctcggagaagtttgttattaccgaccttctgaagcctacttctgtcaactcgtcaaagtcattctccatcctgctttgttccattgctggtggggagctgcgatcctttggaggagaacaggcactctggtttttagaattttcagcttttctgctctggtttctctccctctttgtggttttatctacctttggtgtttgatgttggtgatctacagatggggttttggtgtggatgttctttttgttgatgttgatgctattcctttctgtttgttagttttccttctaacaggtccctcagctgcaggtccgatggagtttgctggaggtccacttcagaccctgtttgcctgggtatcaccagcggaggctgcagaatagcaaatattgctgcctgatacttcctctggaagcttcatctcagaggggcaccttgctatatgaggtgtcagtcgtcccctactgggaggtgtctcccagttaggctacacaggggtcagggacccacttgaggaggcagtctgtctgttctcagagatcaaacactgtgctgggagaacctctgctctcttcagagctgtcagacagggacgtttaagtctgcagaggtttctgctgcctttggtcagctatgctctgcccccagagatagagtctacagaggcaggcaggccttgatgagctgtggtgggctccacccagtttgagtttccaggctgcttcgtttacctactctagcctcagcaatggctgacgcctctcccccagccaggctgctgccttgcagtttgatctcaggctgctgcgctagcagtgaggaaggctcagtgggcatgggacccactgagtcaggcgcaggatataatctccttgtgttctgtttgctaagaccatggaaaagtgcagtatttgggtggcagtgagctgatttttcctggtacactctgtcacagcttcccttggctaggaaagggaaatccgccaaccccttgcacttcccgggtaaggcgatgccctgccctgcttcggctcaccttccgtgagctgcacccactgtccaaccagtctcagtgagatgaaccagatacttcagttggaaatgcagaaatcacccatcttctgtgtcgatcgttgtgggagctgcacaccctctttcctttcttttataacaacagcagcaatggcaatgacaacactcccctccccccaccagaaaaatggcccagttattaaactgtgctctcagattaaaaattaaaacccaaatctgagtacccacatgtaggtgagggggcctttggccacacagaagagttttaacaactgtgttccttttatgataaggtgtccaaggactgcattcacctaggatgaatcacagcaatttgcagctctgtattgttggagacacttcaattctgctattagccagccagagctcaaatggttctgccttcatctggtccaggattaagaaaaaagtgtctctgggactggaagggggtgtaggtggctttgtgaactgtaggtgagaacagagtgtgattgaatgccagtgaagcctaaagtcttaagtccagttaggggtcctctaaggagttttgtcttcattgagctaccttcttcaaacttttcagggtatattctgcatgtagattttcttcaatgagtaaaaccttattcatttactactagttataaaccatagatgatttcttcctattgtttcatcaatgttgcttataaattgtcacatcaactgttacattagtttaatagtgtaaaaaaattctgtgagcctagtctgattaaggtattgctgaattttttaaaatattgaaatatagtacacataatgtatacatcattaacacatagctccatataatacatcaccatcatgcataggacattatcatcatcccaaaagccaagctcaggttccttccccaaaactactcccaatttatttactatacagtcttctaaaactatggtttagtttcgcttgcctttttttttttttttttttttttgagatggagtctccctctgttgcccaggctggaatgcagtggtgtgatatcagctcactgcaaactctgcctcccgggttcaagcagttctcctgcctcagcctcccaagtagctgtgactacaggcgtgtgccaccatgcctggctaatttttgtatttttagtagagaagagattttaccatgttggccaggctggtcttgaactcctgatgtcaagtgatctgcccacctgtttcccaaagtgttgggattacaggcgtgagccactgtgcctggccagttttgcttgtttttgaccttacgtaagtgggatcatttatatatcatcacacagtatatattctttcttgctgaatttctgtgctcaaaataatgtttgtaaatttgttcacattgtatagttttattcatcgtaattgctggtggtatttcattaaatgaggacaccacaatttatactatgaatggacatttgagctgcttccattcaggggccattacaaataaggctgttatcaatactcttataaatatctttttgtccacatgtgcttgcacttctgttggtataggcctaggaatggaattgctgggtcacagggtaggtgtttatttcaatttgtattttcttgattactaatgaggttgagcacctttcatagatatattagctatttggtatcctcttttttatacaggaagcatcttgaattgtctgtatttttatgtttgtataagtttttcatgtgttttggacataagttgctcacatttacatgtgttgcaaatatcttctactctttggcttactttccctctcttttaataatgtcatttgatgaacaaaagctcttaatttaatgtaatgtatccaatttattcatattttcctgtattgttagtgatctttgtgtcatttaataaatttttttctctagcctcacatcatgaagatattttcttattttatctaatagaagctctattattttaccctttacatttagagctaccatgcactgagaattgatttttatgtgtggtatgacataatgatcaagtttctctttttctccccagacagttactcaatagactgagcactatttactgaatgaccctttctctgctgctctacagtgctagcttgcaagatcgaatgtccaagtatgggtggatctgtttgaaaactctttcctgtagtctatttgtctatccttacatcaatatcacactgtcttaattactgtagtttaattacctataagtcttgatatctgatggagtaagtccttaggctttatgctatttacagtcctttgtatttctgtatatattttagaagctgctcagaattttttattaaaaaacactgctgtgattttaatggggattgcatataatggagtttgtttcataaagctttcttcattctaccaagatgggatatttctctgtgtatgtaggtcttcagtaatttatctcaatatatgttattttctgtgcagagatcttgtacatatttgttagatttattcaaaagtatttggtagttttgttgccactatgaaatgatatctgctttaaatttttattttctaatttttaatgctggtattaatttcatatcttgaccttgcatctggcaaccttgcaaagctcacttatttatgatactttaattgtaattattatggattttctttgcatatgtaaataacatttgcaaacgatcatagtttttctattccttatacccttggtttaatttctgttattgttgtaattactaggatttccattagaatactgtgaagaagtggtgattctgggcatacttggcttattcctagtctcagagagaaagcattcaacatttcaccatttattatgatgctggctttttatatggccctgatgaaattaaagaaattatcttcctttcctagttcttagtcttttttcatgaataggtgttgaatttaattaaatattttttaacctattgagatgtcagcgatttttatctttcatggtgttaattcagtgaattaccctgcctggcttttccaatgttaaactagaaattgcatttctagaaattatccaacttggttttgatcaattgcactttttatgtattgctgtattgagtttgctaatattccttttagaatatttgcatctatgtttgtaagtaatattggactgtaattttgttggtatcaagttgatggtgtcaaaattatagaactttataaaacaaataggaaaatttctcctttttccctattctctggaatagtctgtgtaattgtcctatttctcgtatgtttggtaaaatttaccagtgaagcccaacttttctttgtgggaacaaaattgaatataaaatttaaaaaatattcatagagattattcatatactctatttcttcttgtatcaattttagtaagtttttttaagaaatttgtccataacatgtaaaaattcaagtttattggcataaaattgttcatgttatcctcttattaactttgtagcatctgtgtggaaactttgtcgtctgtgatgatatccccctttttatttatttatttatttatttatttatttatttatttatttattgagacagggtctcactctgttgcccaggctggagtgtagtggtgcaaccagagctcacagcaacctcaacctctcaggctcaagcaatcctcccacctcagcctcctgagtagttgggactacaagtgtgcgccaccatgcctggatatttattttattttattttttgtagaaatgagatctcattatgttgtctcaaactcctgagttcaagtgatcctgctgttttggcctcccaaagtgttgggattactggtgtgaaccactgtgccccgacactttttatttttgataatgggtaatttgctcttgctgtcttgctgacttgctcctgctcttgcttttgatctcttttctttttcttgatcagtcttgccagtttatcaatcttattgtactttttaatgaacaaacttttggcctactggttctctttattgtcatctgtattatatttcattaatttttttctgttttaattttttacctccttctcctgtcttttttatttaatttgcctttcctcttctaaaatcttgggtggtatacttaaaccattgatttcaactgtcttttattacatgcatttcagtcttacatgcatttcttttattacatgcatattctaagtatagtttagctatatcccagaagttttgatattatcaatgtttacattcaattagtttcaactattttaaaatattaattgtgaggggtttttgaaatttgcaaatagttttaaaacttccaagcatatgggtattttacagttacctttgtaaaaattaattttagcttatttccactatggtccaaatttattggagattttctttctgatctcggtcctgcaattcagcactgccttagtacttctcaaatgactgtatgaagctgggaatcatacagctgaagaaggccattacatgtgctgggaacatgcacctttgaaggcttagctagtggttctcaacctatcagatgcaacactaccattttaaatacatatatttgcaatattactttttctatcctgaaaaaaacttacaggtaatctaaatttttagaaaaacaatacagtatcctgttacatggaggataaataaataaaaagtaatttgtaacaaaataatgtttttcaacctggaaatgttcaggcatgactacactagagacaatgataaagttggcagatgttttcttctacatacattgagttaatatggatgtaagagaagtaagacaatactcaaagaatatttattgttgacgcttttttccttatatttaacattttgagataaaggctaaatgagtgtatttgtgtgcgtatacaagtacaatcaatgtgactgtgacaactgcaaatgcaaagctgataaacatgtgttgccttgttgactcaaataccagaagctgcgttgtcattgatgaaggaatatttcgaagcgctgaacaattcttgataaagttccgaaacaaacaaagcacaatcttccctcgatttacatgggagttgcattcctggaaaattcagtatattttaaaaccatgcaaaatatccttttaaaaaaatatgtaacatggagtttaggaccaaggctcaggtaactataaaaatttttacctacataaatttctagtggagtgtttgaaatttgtttaggactgtgtccttcattgtgggacatttgcagatttctcccttgcccactaaatctcaatagcacctcctccctcaattattgtgacaatcagttcctccacattcaacaaattttccaacacctcccgagcagcactgccatccttgttgagaacgtgtatctagttcatcttaagatagaactgcccccctcatccccactttctctcccaaatcctgtgaaagcccagcacaggcactgggggatacagcaagccacttaggaggattcccagcttgtgtcattgaatcatctttaaatttatttttatttttttttatatgtcttatcatcttccaaaaaggatgttttggtgaactgcaaagagatatactcagagacaggaaaaagatctggtagggtgaagaatgaaagaaaaacaggcaggcagaataaagctgaaagctgagcctagtatctaaaacgcacactcccagggcttgtatactcaataaagttgagaagtaactgggttgtcaatttaaagaggaatacttgatcagacacacaattctatgttgataagattaaaaacaagctctagtcatccttccgtacctgtaggagattggctgtaggacctttgtggatgccaaactctgcagatactcaagtcccttatgtaaaatggcataagggaccatttgcatgcaacctatgcccctcctcccatatactttaaataatctttagattacctataatacctaatacaatataaaggctatggaaatagttgttatactatattttttcatttgtgtcatttttattgttatttttaattttttagaatatttccaatccatggttgggtgcggaacctgcggatacagaggactgactataatatcaaggtaaggacatggattctggacccagactgcatacattcaacttggcttcacttttacaaactgtaggaccttgagcaaatcaccacatgcttctgtcttgttacctataacaggataatatcactacctacaataccacacaagtctattgtgaggattagataaattggtgcacataaagttcttaggagagtatacagtagttacttgtaagcactatataaacatttgccaaataagcagaaaaagttctcagagaaaacagtttttaccagcagtttttctcactaatagatgtggaattgaattacctagattgaaaactcagaggaaacttgacattcatcaattctaatctgtttgtgttacagtgcaggaaactgcagccagacactgaaagtctaggggccaagctcacatattagttgaggatccacaagttagttgaggatcctggtcccctggttcttttctgctgctcttgccaatatctcggcctggagctggcctgtggaggggtgcagagaagcagcctattgtctctccttcccagagtgtccacaggttccaaaattctaccttctcccaactgttctataacaccccaaactctcatttcttcctaaaggacagagagcaaagaataaatcaggtgtgaatgacccctaaactcaaaccctcaaggaatatgcaaacacatagtagagttcctttaaatatagtaaatcttcaactttgaggaagagggcgaatgggtaggtgggaggcaaaggttttaaatttagaaattaaaattgaattgtctaaactggcaaaagtctcaccactttccagttgtgagactgcacacaaagttacttgagagtctccaagcctcatttttctcttctgtaatgtcaaaacagagatcataaggctgtcggaatggactctttgtggcaataagataccatattataaacaggacccaaggtcatgccaggtaagaatgaagtcacacacccttcctcttaaggaataaactatattgtaactgcctcaaggttttttctttcactctagcagttaaacaagcactgataagtctccagcccaccatgaacatgggacacatgcaacatgcatgtttgctttactatgtatgcgagcatcccccacttcctaaatatttattgccccctgtaacctgctgaatatgtaaacataaacgtggccaaaccgttcagcataaattcctgctttacccctctctcccttgaagtgcctgcttttggtgtctgctggaggctatgcttcccagcctatcaggatggccacctgcaggctgtaaccttttgttagaagtaaagctctcctctccaagtttctgaaccttgtgattcttcagttaacagtaacatggggatgataataatcaacacctcatgggttgttgtgaagaagaaatgaaataatacaaagcacctagcaccatgcctggcagagaggggccaataaatgttcatcatatttgctattattattattattattataggcatcagcaacctatcagaagagaaatagttttcctttgctctttgaagaaaggaggccgccccagaaaggctttattcgtgtcctcttactccatgaacttagttaccttgtagaggggaacgggaatgtctggaaagaaagaacctgaagctcagtcccgataggatcacatgaagcgtcacaaagacagaagggttgcagggctgaatccaattcaaccactcactctagtgtgttcctgagagtgctgtcttctctctctgacccttaaacaaatatgtctacgttcactgtccagaatataatataagacagggcttggtattattaagatgctgcttactaaatgaggaactctgagatattgcacaagaaatctagaaacttcatgaattgggggtgagtctcccaatggtgaaagttcaggaagactggctgcaaggggctttgcaaaatacacgcttataaacacactttctcttcctttaacaaggaaaatgataaaacttcatagttacagcgagaaatactgggaaacaaaaaatacgctcttaaaatttcaataacttcatatattcattctacttagctgttacgggagagaaatcaaatatcttactgttgattttcattttccaagggactttgaactatgtgtgtaggtggcagtaaataccttcgttatagctgctgggagctgcagactctgcacacacaggtgaaggtggttagacttgtgtttcctgggaagcaagggcaagtaaggagtgtctaccatgggccagctatatgcctttggtattccattcaacaccctcctccctgtgttagaggaaacatttctcctcctgcattcttcccagcctgtaacaggactttctgtcctctgggggattgggaagttatttcctgccccttcctctttttacttcttcccaagggaaagaatgacttctcttcttagggaggttggagaagggtcctaaacagcgggctctcttgtttaggctgactgtgagacaattttttcattgcttctgctttcctatggggagaaccgttgaatcgtagcctgggatctggaggttgatgtctctcttcttgctctccagaattcattgatttgaggcatgcatctgacctccatgtttctgcaccacagactcaattctcctcatgtgcaggtccagacccagctggggttgtatcattttgaaggtcatctgattgcaggtccactttaagggctcctactcaacaaccaataaaggtcctatattcatctgtatttgctgaaatatgactatttctcaattggttcagaatcagagaagctctactacccagaagagttggaacgggccttgaaatgtaacccaagcatcttattatacaggtaaaaagccaaaaatcatatgcccctcttgccagctgaccttcccagaccccacccaggtctggccacataataatgtgcattgcccaaggtggcttgattgcctggtctggcagctggaggagtgggccctgcacctgacctcactgtgtcttggctttgtccaagtagaccccttgccttcgattgttttgtgcctaatgttttcactcatttagaaacacctgcatctttcttcccctggcagtgctctgaacccttttttttgccgggggcactgtcaccagtgtcttgagatatgttcctgttctgtatctgaccccagtggaccggaacctgcacgtaggtctgctgcctccctgcctagcgctctttctgctcccaccagggtgcatacctctgtgaattacatggctggacttctcttaacatcagactctattaactagaacaatagttttatctcatcctgtgattcaaagacggttgctagggaaaccagtggggatatgtttaatctgtaaatcctgtaattgccctaaagtagcaacaattcatgtgcttgcttcaaaaggatttggactgaactgactgggaagcaggtgagtgaagaagaacaatcacaggttggctccccttgtgatctgttcacattcctcataaggtgttttttcctgctgctttgccaaaaagctaaagggattaaagagggagcactgcggtgcccttctaatggaccaggaaagctagaaagacaaaattatgcagttcttctcttcttatggattcaagtggtcagagctgagtgattggaggctgtactggtggtgatggagagagataagaggataaatactccattttattttaaaatggattcagaatcctataattgtagtttgtagggggatactaactccaaatgaggagaagcaaggtatttgggaagtcttatcagaagaggccagggtggtctaagcataggagcacagagtcgggtttggaggcgtgcccagcatcatccccgccaagcctttccttaatccacagcagtattcagtgggtcacccacatgctgcttgggcactgccaaaaatggagaacttgctccttcccagagcagctcattttgtgtttaaacagccctgattgttagaagatctgccttaaattgaactgaaacatggggtgctgggggcaggggacaattttcctccttgacttggctgtctggcggagctcacagaggtttcttcataagacatgccctacctctgtcacagggcccacacccagcaagccacactggctcaagggcccagaactatccagaccgttgaagagtcccaccttgaggcacaggacagaagcagtagggagaaaactaaacattccttgatgtagtgtttgattaagaataaaatgcacagcttctgtctctcggggccctgcaatgtttgtgatttaaaaaaaaaagcaaaatctaagtgcagaccctgtttcccaggagaaaagtcacacgaaactcttctttatacaaaatggttctgagaatcatcactaccattatcggtggagatgactcagtattctagacttagctagttatgcaaagtccagggaggtcattgtgctctcttttggaaacataatagttccattaatgcagctgaatatcacatttgctctgagcagctgcatcccactgctgactcatgttgagctctacaatcagtgaaaacttggagggtatttctcctttgtaggtgcaatatcatatgatccctcctaagcccagctctattgggactatgggtgtccagggtccctcctagctccttgcctgcttttgctgtcaagtttgtgagttcaccttctgtattttaaaattcaggattgcagcctggtgcgatggcttgcacctataatcccagcactttgggatgctgaggcagaaggatctcttgagcccaggagtttgatcaagaccagccagggaaacatagggagacctcatctctactaaaaataatttttaaaaaagtagccaggtgtggtggtgcatgcctgtagccccagctactcaggaagctgaggtgggaggatggcttgaacctgggaggccaaggatgcaggtagccatgatcgtgcctctgcactacaacctgggcaaaaaagcaagacacctgtctcagtaaaataaaatttaggattgcagggattgcaccctcctgtctctggttctttgttacctatcctgatctgtgaagtcttaggcagtcactgcctgtgcatagttgatgtatctatgtggtcccattctcttcagctctaatttatccagaccagcatgtttaataaggttagatgtctgatctaccctttattaatgtctattctcttttccaattcattgacagaaaagttggaggaaagccaggagccagggagttttgctttctttgatctgttgaagcagcataagtagtttacctaagagtatactgcccttgtgagaggtaacaatgcaagattttggaaaaagacatctaacctgagtgcttatactttgcataacccttttgcattgtttagtactactggtttttatgctacttaattgttttaaaacagggatttataaaaatagacacaatttgctaaattctcattcagttcagtcactcttaatggaaagtctagttttatatgccacaaagccataaccaaggtgccacctcattgtagaaaaagaatccagaaagaaagaaatggttttgagtagcaactttgaaaattccaaactatgaaacaaaggcagaaatcactgttacaaggtccttggctttccaggaagtccaaaacccaaatgaaaaaggcatcttgattttctctctgaactctgctcaaggtttactaagaaactacctaccacgtataaatgggaaacacacaaaagatgtatttcttggaaggtgaggggtgttagtgattttggcctcacattaagggagccagaacctgcctgaactgctagaaataaggggtggaaagacaggactgggttctggggctgcatccagggaaaacatgtcagtaccgtacacctaacaccagatgagtggacagagacatgtcaggagaaaagaggaaaaaggaatgccccgggctccaaaaagaaaaggatatgggattggtgtaagggtctgagggatgagagaaaagaaaagatggtgatacataatcacttctcttttttccttcagaatgatgacctaaaactaaacattggtcactgcaatcaaagtgttaatatgaaaaatcaagtacctcgctctgaaatttcagaatttcttggtggggagttaggactaggaagaatcacagccaaaaacaactaacagtaactcccatagcaatgctctatatttaagatgtagatacatccataatatatatactctggagtggtttattaaaaggcacttcgagccattcataaagaaataaatgatagtgcaaggcagccggactcaatggccaggaggggagttagcagtgagtgctcttgaggagatgccgaggctgggtgggcagagggtacttcgaggggggcctaagggagccctcagtgggcctgggtgatgatgtcctcagaatttcccagtgtgtgtgacctctgcagcttgagtgttcctaagggaagtttggaggataaagacagcatctctgggacaccagaccagtgtccttcaggtctgggagccccacagagcaacagctgggaaagtatacggttattggaggcaaaacaatcaaaattccattccagaaacgtgtcccttgcaaacctaggtacctgctgctcactgttcaatggtggcagacatttcagtgtaggcagctcagtgcttctcatgcatagacagactgcttcccacttccccacccaaggggcacctggaaacgcgtgtgcatgtgtttgtcactgtgtgtgtgtgtgtgtgtgtgtgtgtgtgtgtgtatgtgtgggtaggtgggtgggtgagtatagaggctactggtatgcagtgtccaggacaagagatgcttaatgtcctgcaacacgagatcagttcctcagagcaaatatggaccccattataaaacaatgtgctttggacactgtcaagaggaaattcccttaaaagaactaaatgtataccttactgaaaccaactaagtcggtatgcatttgaacgtgtatattccaatgttttctgcttttaaatttaaaagctcttaaagttagaaaatacagattagcataaagaaaatgatcaaaataatcctcattcctactatttaagtaattaatatgttggtatcgattaatgtgtctttccatttatttatgaaaataagacaaaattatgcatactatatttttagtcagctctttttaattactatattgtgaatcttcattgacttaaatagatccttttgtatataatttttagttgctgcctcatactgtattttatgtctgtaccattgttgaactatcctccattgttgaatagctagattttttttttttgctattaacacaatgtggcaatttatctttgaacggttttttattgtcagagagcaaaaggatgtttaacagctggaaggtaggaggatagatagagtgacaagagtttaggttctgcaatgagaagacattgcttcaagtcccaactctgccacttactagccatgtgaccttaagccattcagctcaacctctttgcctcagtatcctcatctgcaatatgagaataacaatacttacctggcaggatagcacaggagattaactgaagaaatacatgtgaaagtacctttcaactgtacctcactctgagagagaagggggaaaaaaacatgatcttccatttactgtgaatctctcatatgccaggcactttcctgcgttttacgtgctttattgcatttgatcctcatggcaaacctgtaaggcaggggctatttttttattacccacatgttacacagaagggaaatgagacatgtggataatctaccccatcatgggcacaacggtagaagcggcagcacagagattcagacccgggtctgcgggacacaccccaggctctgaggtggatacaatgcagaagagaagcacactccccagtgtggcaggaggccagttctagagccttccagacccagctccccgggagatgaatcaccagctagggacaatcccgaggccaaaaagctcatgatagcctgctcacagtcttgaatcaataggtcttttattagtctttaaaatggggaccacaatctttatatgtatacaatattcgtgcattccagagctctttcccatccattctctcactgttctgacaatagctctgtgctgtgggtggggcaggaatcggcttgtgaagcatcatcctatatgttaggacagggaagactggaactctggatgcctggtcccaaatcatttgaaatttgaataatcccagcttattggaaaaggaatcctgtcttttctacttggtatctgtgtagctttgggtaactcatttcatttctcagattttcagtttcttcatctcttaaaagagaccaaaagcaggaataatgtttatgtcaaggattgtcctaaaatccaaatgaagtcatggaggatattaaaaatgcctaccactgtgtccctcccacctctaaggcagtgtacccactccagccacccagcccatagtgtgctatggtctacaccagatgcccccttcccactccactgtgggtgattggactgaggtgggcaatgagctcaaagagtagttcactggccttaaaggaattcatcaaatactgaactgaatcaccttgattcttttgagattttttttcactgataattgaatttttaattctacttagttttaattaattttaatttaatagccacatggagctaatggtgaccataatgtacagctcaaggctataagtttattatctggggaaagtaaaacagaagtcaaagaacattaaaaaattgagagcttttcttatggggaaaattggcacactaaagataccacggacccagagaaaggccaaaaaatatatatatgagggaaagaaatggtaatgcctggaggggcccgtgttagtagaattcaatatgaaagtattaaagagcacttctggtactataaggaatgaaatattatgaaatgcttagtgctataaaataaagacaacctgacaaagtatacttttaattttattcctgggcttgcaagaagttatgtaccacttatgcactaccaccttcacccccaacaaagacctgaacacacagcaataagtgctaagcataggtgaaaggcagggttgccctgctggcaaatgctgatgttaaaactgcaatcaaaagccagctaacaagatagagagattaagcctagggtcccagcagtgggctaaagtttctataggtgggtaaccctctggctctcaacaaaaacaaatctctctggagaaaagcttcctcaatttgggtccttagatttccgtggattaagcaacaatatatgagcactcaataaaatatgatcaatgaaatataatcaaacacacaagaaagcaaaccactataagcaagaggtagaagagatgaggtatgccagacttctacttctaagaactttaaatgttggaatgagaatatttgaaatgtataataattacaaaattcattcaaaaaatatgaagtcacagaaataggcatgcaatgctagactataaaaagtgaaatggtagatttgaaaaagacttaaacataacttttagaaatgaaaaatgttattaaaacagcagaggaaagaattagtgaagtggaaaatagagttgaagaaattaaacagaatatagcacaggaaaaaaagattataaataagaaagaaggatcaataatcattataggttccaagtaaagataatatattgaacacatacagctcattttactaccttctccaaacttattaaaactacagcaaagggattttaaacaatcatataaacccacaagaatgggcaaaatatgagatgagataccagcaacaaacttctggaaaatggaatataaatgaagaattgataacaatgttaccagagctaagaaaaccaaatcctaaactgatggtggggaaatcattgaatcaactgaatttgcactggaacacaacacaaaaagtaaaaaaaaaaaaaaaaaaaaaaaaaaaatacagtaagaggcataaattagtaggaattaaagataaaatagaagaactaccaaatcaaaaattctttaaaaagactattagattaatctttagtaagattgagaaaagtgaaggtataaatatgtatgaacaaaggaatatatctacagataggcaaaattaaattttaaaaagatttttaaaaaatttaatttaaaattaagttgaaaaaatattttaagtgccaaaagagatagcaagaataatctacactactttatgtctatacattggaaacaatttaaaatgcccagaaaaatataacttgtgaaaccaattgaagaaatggaaaacctaaatagccttataatcattaaataaattaaaatggtagtctaaaatttttctgcaaagaaaataaaagtctcaataatttcagtgacatattattattgcattaaataaaaaaccaaatgtccaagaagagccaagacattctgaggacaaacaggatgaaggaatgtgcttttctagattgcaagccttattaaaaagctaaagtaattaaaacagtatggttttgaggtaaggataatcaaattagccagtggaacagactaagaagcccccaaaaatctctgtctctctctctctctctctctctctctctctctccatatatatatgtgtgtgtatgtgtatgtatatatatgtttgtatatatatgtgtgtatatatatatatatttgctcgataaaggatattgtgttgtagatcatgagtggcttattcaataaatggtgctgagagcattagttatccatataggaaaaaaattaaagaggctccttattctcttacatacaaaaattaatttttgatggaacagaatcttaaatatggaaggcaaagtcttaaaactttttgaagaaatttagaatatttttataatcttgaaatttatttaaagaatttttttgaaagacacaagtacccattaaaaaagaaaacattggtaaatcaactacacaaatcatcaaagataccataaatgaaaacataaggaattcatatctagattaatcttgaccgtggtcttaagacttccagcctcctgaatagtaggaagtaaatgtctgttgtttaagccactccatctatagtatttttgttatagtagcctgagctaagacagctttatataagcctttggggaccatagatgaactacatcacttggttctagcatgttctgtggtttcaatgcagaaacctagagaataactaaggctgggagaaagaaggaccacactggtgggagaagctggtgacaagtggtaaggagtgggcaacctgggtactaattcttgttttttcttccccagccttgtggtcttggccaaatcaccgggcctgctgtcttttctgtagagagaagggctgctcggttctcatttggattcaacctttccaatgcagcatttaaacacggaggagggatttttttggttgtcacaaggactgggggaccctgctggctaaatatcctccaatgtgtgagacagttgcaccctaaatgccagtgtgcccctattgagaaacatcctctctataacagtcctttgaacgagccctttacatctctctacacatacatgatgtttgctggtgggtcgggaaacatttggatactttatgaagcatgcaggtctccacccaaacccacaggtcagatggctgctgtccaaactttaggatctttagggctgcagatgagatgctctgttctggtgtatgtcctgcttggggggctgcccctccttgccagaagaagatttagttgaattcaattgaagtgtactattaccaaccatttgctcccttgttctgacagccagcaggagcagaaaactggcttgctctggtactaactgcattctcagaaccgtgcatgcagtgctttatcgttctgttcaaagctaagcagtgccctccttgggacactctgggaatgtacagtattcattgctctaagaaaatgccttggccacaaggagaaaacattcgctggctgtggcttgagccaactgggtcagcgccagcctgtgcagatgtctttgtggacagagaagaagtccctctgggagaaggcagcccatgctagggtgcatagattgatgagaggagtgacaactgtatttctgtccttacttgctctcctggccaggtgctcttatgcagtgcactagctgtacaacagtacctactggctggaccctctcattctctaccaattcagcagtctcctcttggcttcattcaggaggctgtctccccatggttgcctgaacccaaaagcaaaatgtgtgggtcccacctacttctcacgctctagttctaaagaatgggcccaggtgtccagcctccacggcctgacattcaatgctgtgtacactccggttccaagttgcttttctactcactgcaccccagactctctgctaaacaggctactttagtcattgccacccaaataatgcttgtgaagttgcatctccacactctcatactcttcccttaccctcaccttttatccaactctttcaaggctcggctcattttcagtcttctgggaagccctctcaattgcccccaatcaggagttactgaaaagtgtccttgtacctcccattggtcaccgactgcacggttcatgtattgggaaccttgattgttaagaagattttaagttccttgaaggtggaaacctaatgagaagacttgcccttcaggctcctctacttaagaatcattccaagcaattaccatggaaacaaatatcttctcttcctggcctcttggaccaaaacaaacagacaaactgttaaagagcaaggaatttggctccctgcctaggttggcagtgagagcgtcagaacaaggttgaggccaaatccatgaacctcatttagttagctgcccacgaacttggcttggaacgccttggccccatcttaaagaaagcccttcattctggggacgctggtcagcctgaggcccatgctccttagtcccaccacaggaagccttctctctccatctgtcactctgagaccatattggctgaagctctgggcttactcatatcctgagtcatccaacctcgcatgtccgtaaaaatatccgtatccttataggtggaggccttatagataggttgttgagtcagatttatgagtttgagaaagagatgctttggatgcaaaggacctttggtgagtttgcagaagccctggactcaaatctaccaccactcagaacagtgaatgccagaaaattcctggaaaagggcatctctttgctgaatgaccctagtaatctactcattccccaggtaattactgagccactctgtgttccaggcacagttctagtttctggaaatatacctgagaacaaaacagacagaaattctgcccttatgagcctccacttcagctcctggccaagtctgtttttcatatgatccaagcactttggcaggtgttagggctgtaaaagggatggcatgggacccccttgggtaggggacgtggcagacacatctcttagaaatattgccgcaagcctcactgttcaagtctggtgtgtggagcagctgcatcagcacctccagggagcatgttagaaatgcatcgtctcaggcccttcccaagcccttctgagtaagaaactgcactttacaatatgctcccaggtgaactgtccgcagggaaaggcttgaaaagccttgctacaggacagcaaatcccacaagctgtcctacagtgaaagggagcagaacgataatgtgcatttgagaaagagtacatcccatgcctcagatttagaaaggtggcgtgttcaagactgagatctcctcagaaagaaacatgcttaaaaatccaatgctactcaactgtatttgatggctcaacaacaaatcaccgactgtaatcactcaacagaaccagcatcctgtgaaacacaccttgagaaaccagtagtggaccttctggcattcccggattcaactttcttggcttcaatgactgcagatggagtgagcccatggggtgataactggcagttttgctgaggaacaaatctgaatcatgcctactgccaggctgaggctctgggccaaggtctcagcttgggatagggtgaggatcagaaggctggaaagatagagggactcggagactgccagctactggttaacttgtggcataaggaggatatatacagaaaacactggattctatagctgaaatatgtcatttggagaaatttaggagccaatataagcattccttatttgtcatttcatgggctatatatattccacaggtgtcaagaatctataatgatgatgatgatggcaaagacaatgatagatacctttttaaaacttactatatgccaagcactgtcctaattcatatgttcccaacagcaatgctaagtggtataatcctcatttctgcagatgaagaaattgaggcacagagctggctcctcgttttaatccgtttcatgctaaatgtgacttctgagacctaggtgacaggcatctgactggtgcagactaaactggccagatgatggagtgaccactggtcccctttatccctcgagccagcccctgaaggctgagagacttgctcagagccccgtcccagaagtgggcaagattcatatttgtgccttagcaaaactgccagttatcatactatgggcttattccttctggaatagggtaaagcaagaacagagaaccccctctgggggtgccacttaggtgtgaagcagccctaattgggcaggtataggctggagtgacctcagtggtaggcctgggaggggacacctggtttgctctggggcagtcgtagaaggctcagcacagtgctggactgcaggtaggactaagcttggattataaggcctgggatcttctcataatgctggtctgcagccactgtgtggcctgtgacaggcctttccctgggtctcagtctttgaaaataatgatacaccccccaccacacccggtcatgggttgcaccttgggtttcaactcaatgactgcttttcaggaggtccctctggggctccttagggttatggctgctccaggctggcaaatccagatcatgcaagaggtggcttaaccctctccctctcagggacacgaagaagatctgttgcttccagattgcaccaacacacatgcctagaaccccagtaatgaagctggaacctctgctgtgtggtcagacaaacccaaggataaattgcccctgcttcttgggatgacactaggaattcgccattcttcacgaggcagtccctggggcctagagccaattcattcagtttaacattccctccctttgagacaaagtatagggtggtgataatgaagtcagtcgggcacagccttgagtgctggctgtgtgacacagggcaagtcactcaacctctctgagctccagcatgctcattggtaattggtataaatgaaagtacctatatcatgggactactgtgaggtgccagcacattatcagtgctttgtaaagagccgctattactcttgttgttgcttggacatttgttatgaggggggaatactttttaaaatttgctttttaaaaacatcaacaaatttctgaaggcattttcaaatgagactttaaaatatgtttttctcttcttataaagttaaaatttttgtatgaggttaggcataatttttttttgttttaaattaacaaatagcaatcaagggcttctaagcaattccaaggacccccttgctgctctattccactagtcttccaccctctccctcctggcagcagtcgttggcatttttgtatgtctcaccctggaggctggcaagctctgcacctcctggtcgggagcttccagctctcccctgcagctgtcctgaattcctcttgctgtaggttgtccctttgtcccagagcactcaccctaacagggaagtccctcatttcttcattaacttccaggttgctccctccccattaatgctgagctggagaagcagggttcacaggaccttacaatagggaccaggagcagcagctcggagattcaggccgcctttggcttccttgaccctcctgtacccagggccagcatcagggagggaggaagaggacagggacaacaatcagcagggcccgtgtaagcatacacttcttatggatgactcctctgacaaccacacggggtaaggccaggctcacggtcacacagtggctgagccagaagatcagtgtttttgcttttccatctaataatggctccgtctatacaaaattttgggcaggaagggcaatgcatctatcagaactcattggtgacaggcgcagcaggagctaaattggctgagttgaaccaggctgttacttcctagctgtgtgaccttagggaaatcacccaagctctctgtgccaacaattgtgcctacctcataggattcatttaaggattaaagaagttgataaatatcaagtgattaaaatcctacctggcacatccatagcagggattctacatgctagatattttaattgttgttaagcctcatgaaggcaggagtctttgtctatgttggttattggtctgtgttagaacagtgcctggtacttaataggggctctataaacagttgttgggtgaatgaatctatttctttcaagataaaaactcttttgcaatgcagccattgtttatcttggccagcagagggcagcaaatagctgtggactgattaattgtggacaagggtggttttaattttgaaggctaacagaactgtccctcctgagccagttagggaaataaaaggttgccatgaacctgtacgactggccccgacccctcccactcacctttgtgcaggttagaatgattgtcaggcattcaactcacaaaaaatcttggttccatttcttctcaacttactttcaatttccttcctccctccctccctctatccctgcttttcctcctttctccgttttctctaatcatatttccccctgcccccacactcactcctctgcatcaagctagtatactgtacacactcccaaactttatctgtacaattgcagcttgtactgcaaaccatgacatctagagtggatccttatacagtattcttcccaaccaatgaatgctgctaaacctagtataattttttaaacaacatgtaatttgataactagacccagagaggtactatagcttggccaagaacacacagcaattaggggtaacgttagagccctagccaaggccttctgctgtccattatacagcctcatcacacatgttctcttttgccaacaggaggctcgtgtggtccctgtttgtcatccagtcaatacggccatcagcttctggccccagacacctttcctctgcactgtggcacagaggagcagactgctttggagggcagcttcctgggagctccagggaccctggccaggcggccactgccactgacttcctcggctcactgagcccgtgcctgcagctctcgtgtttcctctgtgctgcagtggacgcttatcttcccccgatggcacatttctttgtcacagacaggaccctcactggcagtcggaggtgagttcccggggagcttctgggtcttgttggtgccttctggcaccacttgtggatgggatggctctgacacccaagcctcaccactgctccgggggtaacccaatgacatgatctccccagcttgctagatcctgtccttcccaattatgatccaaaaaatcatgctaggataactgtctggaaaaaatatttaattggtcttccagctgggaaacaaattctatatgaattgatgagaaaaaaaaaacagaatttttaaaactagaaaaaatgtgggtgacctattatcttaggggatatttctttaagcatgaaagcaaaactagaaactataaaagaaaaaatgtacaggttgactacatagaaaaaagctctatatcctggtaaacatccaaatcaaaataaaagctagtgacaaatggagaaaagttgagctacccgtgtaacagacaaaagataaatatactaaatcagactctcaagaaaatggataaagaatctgaactgacaacctaaaaatatcaagtcataggaacatgaaacatgctcagtgttactggtaatgaagtaaatgcaaaattcaatttctgcatcttgaagttgcaaatttcaaaactacgtagtgtcagtgaggatgcgggccacagcctctctcattctgctgttggcacagttctggagggctctgtatgcttacaggtgtccatgataaatgcttttctgtgtagccttcatcgctatcaccttactatctattgcctcctccctcccgccttcctttaccacaccaatatacttcacaatgatagggatattgtttactgatctgccccaaatgcttacaatagcacctggcccggctggttgtggtggctcacgcctgtaatcccaacactttgggaagccaagacgggcaaatcacaaggtcaggagttcgagaccagcctggccaacatggtgaaaccccatctctactaaaaatacaaaaaattagctgggcgtggtggcagatgcctgtaatcccaggctactcaggaggctaaggcaggagaatcactttgaacccaggaggtggagattgtagtgagccgagatcacgccactgcattccagcctgggtgacgagcaagactctgtctcaaaaaaaaaaaaaaaaaaaaaaaaaaagcacctggcccaatattagatgttcaacatatgcttattgaatgaataattgatctttaacccagtagttcttaggaattgatactaaggcaacaatcagtgatgtacaaaaaagatttatatccaaggatgctcatttcaacatatattgtaatagtcaaactttgcaaaccactgaaatgtccagtaaaaattatgaaccatcctttttagagactataatagtaaagtcatgaaaatcatgttatagaagacaacacaataacatagaaagatttcctagatatattttgaaaagggcaggttatataactgtccagaaatttattttctatgtataatacaatcttaatgtatataaatctacacatatatgcatggaaaaacttgtgtaagaacatactgacattttaacagtatttatctttggatagagtaattgtaaaatgtttacatgtttttctttactctttcatgtatttttgcagagtttctgtgataggaccattttgtttttgagactggattaaaaacaatgtagcagaggccatgggtgcctcacccatattcctcaagctggccctagttccaagtagctaagagcctggcggtggccctctacctacaaaggatgggagtggagtggctctctctcacagcttcctcagccccaggggacaactctgcagcatgttcctcacagcttgacagaggccctggccgtgcaccttggtggctgttctttgcattcccttcttctcagccttgcttctccatgccacctcagtgcttcctggaatcacctttcaagccagctacttgcacacaaatccttgtcccagagtctgcttttaggaggagcccaggctaaaaggcacaaacgctgttttaaaaatcctgcccactccgtgtaaagaacatcagccaagcatggtgctatagaaataactcctatcttggctgttcctgtgtgtagttcactttcaatctctcagcatccctgagttgaagagagatcttgcttaactgggagggaaggccaaggggtttctggatacaggagccaccttggggatcttagagcctcagaagaggcaaggatgtacgttataagaaggggctgtccagatgataaatgaaattaataaaccacccctgtgatgccagcacatggctcacagcagatctgcatcaggcgcctaccattgccctaggatgccattaacacctactcttccttatgaggcttagaatcagggctgctgaggacttcagaaatcatctcattcaggtggggtgaagggggtgggtagcttccctgagggtcccacagcaagagttagagacacagccaggaccagaacttactgaaaagcaataatccaaggtctgacttgggttctgaggatttgctcagttatagatgtcattctcgatttggcctgaagagggcagacacttgccattcatggaggtgaagagcttgtttttaaggctggactaacatctcccaataaggtcatttggttctagtgagagttgcagctcacaacattcttgactcttctgctgcaaatatgctactggaaagacactgaagttcacagactgaagttcctttagttccaactctggcactgtaataggtgaccttgcacaggtcacttcacctctctgagtctcacttcttgtgaagtaagatctctactccgtgactgagaaggtggtattggggagtgatatgtaacttacaaagttgcatattacaacacacatcactgctgttaagttctgtgtgtgtgtgtgtgtgtgtgtgcgcgcgcgcacatgtgcacactcgtgatggagagagcttgataaaggagagaggcctaggccaaaggagctttttctggcctcaggtgaatatatatttgtaaattctctagcaattggaaccaattcactttgtacttggaaaagacttaactgcttttactttatatttcgaactgtacttttttaaaagctaaagatgtcccttaacctaactggtgtatgggaaaaaatatacataacagggatatatgtaaagttctaccattaagtcaaaaatattgctgaatacagagaaggtattggtaatacaaatttttaaaactaagtatttagtggttgcttggtcatgagaagcaaaaaagtaagaagtgagtatttttaaaaatcctgtaccattttcctaggacatcaagccctagtacaggaagggacattttcacactaatctgtgccagctggagcagtcctgccatctgaacatcatattttggaaccctgagaagctaggatgcagttaacaggtaagtagtaatgggagaactttctagaaaccatgtctggaggaggggttcaggagctgagatgctgagcctggggtagggaagacttgagtggggcaggccctacaaaaaggggttccatcaatccaaataaggaaaagtcacaaaggaaaggtctggtctcaatagtgaagggcattgttccctgagagatcagtgtgttgtcacaggagacaggaagctctgaacacttcaagacatgcttagaaggccccccgatgtcagcagaaaaggggctgctaatgtcatctcagaaaccaagttatccccatgcaacaaaatcaatcacgtatcaaaacatgatggagagacagcctgcagaagtcagatggttcccggagcactacaggataaaaaggaccttgaaatacagaagacaaagtacaggctcatgaatgtctggacacaccagcaaattgagcctgaccaactgcactgacatcctgatgagtcagcttgaatcaagaagatgggtcccaaataactcagggtcacgcagcagagagagatggggattagtcaagtgtgttcactctctcaccgactcttcctgattgaattcccacactatgctaggcactttttagggagctgtgtatattttctttggaggcacagggttaggccattatctcttccaaggacagcagtttctctgtgaatttattccttgtccaccaaaaaccttctatttcctcttttagcctccatggttacctgaaaataggaaggaaggaagtctacgatgatggagccataagatatatgcattctttactgtaaaagatcacacagaaattctagtttatagattccccaatgttaccattcagcctttggaagcctgattcaatttgaaagagtagataaaatatagtttctagaactgacaaggtgaggatgagacccaagaccagggtgtggccactaccatgtgaacactgggaggtcctccaacctcccctgacatttctcttgaacttctcaaagttacctgcttggaccccaggggtatgagttccaagggcccgatcagctatgagattataggctgaactcaggcatcagaattgttagagctttatctcagttctgagaaatggttaaaaccacccttgggcagtcacacgtggaatcacttatttcattactatggacattttcttgtaggaacaatacatagtgaaaatccactgggataaccaacataaaactgattttgttttcagtttgatatagcaattgcattttatttgtttgttgtaagtattggtaaactttcttattttttaaaaacagacatctgtaaaattatatacttttttcctataatatcctttaaagctgcttgaaaaatgtttattatgacaatgtataaaactggtatacatggccaataataaattttttctctaggttgatggtccttactaaaagcattttctcacctcttgagtttccacttctctttccactgattgaaatgggttgcatccaacctgcattcttgaaatggagacttctttagtgaaactccaacacccactacacatcggtggagaaggcagaacagccaggggacatactgcaacccctctcctctggacctcaagtttctcctccactgtctatttgttatttctctcctgtctcaggatgaaagtgtcttttcactccttcgatgctaactcatcaacttgtactcttggtcccaaaactctgatttggcttgtggcttacattagctcctcaacatctttccttcatggctggatctcacccttcaggtttacaaacttagttcacttccctgcggactaaaaaacacaagtctccattttactctggctcttctcggagcaaccattttacctccttccttcccaccacaattgcccactgactctgctacacttctctgtctaccttctgcccttgccacttaagaaggttacacacatccaaaccaccaaatccaagagacttggatccttaaatgctgctgaacctctgaggacatctaacgttgtttctttcgtcttttttccttatgaatctggttctttctttgaaaccccacatttctctgatttatccaccttatcttcttcccctttcctatagaatatggccatgtctggctcaccactcttggtggtcatctgcttgatgttttactgctctgcccagttgtccttcttcctctcaatggtggtggctgcccaatctgctggacccctcagttctaattgttagctcatttcctcaaagagatggcttttaaaacctagcccaggcaaacccaaactcatcatcttgcccactgtgctagatcttttctgattgtttgcccaattcaaaatggattctccattctttggagatggacaccgatctataaggtaggccccaagcagccatttgacctgacttcctggtcacaggtgactggcacagggacagccacctgcctaagactcctgtttttaagtgagagaaacaagaactggataaagactcagtagtgaatggtactgctctgagagaaaggtgcatggattcctggtgctaggggcccttagagctgccccacttcccatcttcctggttaattcaactcttccatggatctctcatatatgctaggaaagttctagtacagtctgtctcttagctaagcttgctagagttggctcctacttagaaaactttaagtagtgaatccactgacatttgtcatccaagaatctctctctctgtccgaaaccccacccattcccttccccagcgagggcttgaaatttgactctgatcgatctttctgtgcaacccacatccagaacattcaaaccttgtgcattttatctccaaaataatcctctcctccaagtcctctgctactgtcctggttccagtctctgtgatctcttttctgggcttgtccagcctctccaggctccagtgatcattctgatcgtatcacttttctgcctaatatctgaggctaagtcttgtaactcttaccacagcattaaaaacccttctccatctggctcacaggtgcacagggctcatcatctgctatttccattcctatgtgccagccaggcctgatcgccgaccttatccaaacattgtccatgctttgcatctttcttctatgatttttgtactgctgatccctttgcccgttggctctggtaaaatctttctcctttaaggtctatctaaagtccttttcctaacccaggggatagagaaacgttccctctatcttctgggacaggagttccctgctggactgggaggcacggctccctttgattcctggcactgcagtggttgattggtaagtggatattgagtgcacaggatcgtacaccatcccaatgtccaccaggttaggaaaaggcctagagagaatagccaaagtcaaagcattttctactgtcactgcttaccacgctttaagccaaagtcaggaaaaggcaggctaggggtgctgagtggtgaattacatggactgtgccccagacctccagacctcagtgtctgaaaaacaagttactcatgaaactggttttagactccaggaaaaacacatttatgtggcttgctgttcataaaacacttccatatatatgaactgattgaaattttcactgtgaccccagtaagcagttaaagtttatcgatataagtgaggaaatagccaggtcagatgtaaatcacagaccttcaacaggaaacagtgttccttctctcggctatctccagtgcaagtgttaaaatacaacgaaaaaggctattggggaaagtctgaatagggcagaggacggctctgcttctaaagcacgtgatgttctccccacctttgttgtcacgcatatgagcatcccttgccagcctagggaggctaaccacacaggacagaaaatgtcactctttctccaggaataggtattatccccaaacactttgatttgatgataaagtatatcagtttttcagaaacctatttcccccatcaactccccacctctaggttcaacctggaaaataatctgcacgcatgtgtatgagttttagcaggaggggatatgcatgtacacatatgcatatacatacaggtttatttaaatgattggatctacacttttggaggctatttgaagtatcttatcaaaataaaacgcattttaagcaagaagttaaaaaagcttttcagacccgaaggccatttaatacagtaaatcttacttgggtagtttagcaaacattttttaaaacccacatccaacagattggttagtattagatacacagatttggtttcaaagctgaaatacccctggtggaataaatcttctcatgaaattcagttatattatgccacaaaacagggacacttatctattgacaacttaaatattaactcagtgggctacctggtgatataaataggaaaaaaacagtggtcatggattaggagtgagaagactatgacaccagcctaccttggactgggaccgcaaaggatgttaaaatctatcctagaatttaaaacaggaaaaatgtcaaatattccactccccattcggcccaaaccatcccccaaggaatacacccccaccccacccccacatgaggtttactaaccagctgctacagatgttactatgtcactaattaacaatgatcacagaaaatgtgtcataccagagtttttgttatcatacacaatgcattagtggctgcaggaatcttcctccaaaagctaccgtcagaaggcaaactgacaaatgtccatgccgctggtccaagaaaccacagctaagagccatgaggcattcatttgtacattgagctctctctggcatgctccccactctagttagaggggctggggtatggagagaccgtcccagccgggcgctgcagcctcctactcctgggcctccttgcgggtcaacttgtagatctcagtgggtccgtccacatgggtgatagtggtggtgagctggagttcttccccactatggacacccagatcgcctgaaacagggttttcggtgttagatgcattcaaggaggaaggagaagcaagctggggttcatctcatggacaactgccctgatgctagccctctttgacattctgagcacacagagacacctagggcacacaacattcagaacaaggactaactccaaacctgttcacttggactttgcagaactttttaaaataccatttttggctcctagatgacagtcattaagatacgtgagtcagctcactgctgatattattcatagtaatcattaacatttaatgagcatttactttgtgcctgacgctattctaatcactttgtaagtgatcttctttaatcctcgcagaagccctctgaagtaggcagtatgaacgtgccagccttacagatgaggaagctgggaggtaggcaaggtaattgtcctgggtggaggagcaggcccacaagagagctggcaaaggaacatctgatgccaagaccaatgtgatgggctaaaccagcataacacccctcccaacggatgggtcagtcaggcaccaacacatttgctatgaataatttacaaaataggagccaggtgcagtggctcaggcctgcaatctcagctactcgagaagcaggggtaggaggactgcttgtggccaggagtttaagatcagccttggcaacagagcgagaccctgactctaaaaaaaaaatttgttttaattacctgcgtgcagtaactcacacttgtaacctcagctactcaggaggctgaggcaggaggatcactggagcacaggaattctaggctgcagtgagctatgattgcaccactcactccagcctgggtgacagagtaagactttgactctaaaaaaataaaaaaataaactacaaagcatctatgtcacgtgaaagcaaataagacctgcttatatctatccatagattggggaaggagccatgtctaacacatctaggaacaatgaggggctttattctccaggaaaaaagaagtgccagaaacgtgctgtgcatttccttctgccctcaggattgtcctaagtgttctgaactcattatcagtggacagtgttctgctaaaatggaataatttgaacttttctaaattagtaggagaaaaaaattttctctaagttaaacctcgaaaactctgctacctgccataagacaagtgaatgtataaacaacaaagggaaaatggaaaacgcaaccacgctcagtctgactgtgtgtgggggtgcacgtgtgcacacatgtttgtggagaggggtgctggggaatagaaagttaaacttgtgtcagtgatttttatattgtgcacatatcatatgataagttttctggaactgaagtttttctaatttaaagcatagaattaagtaactaaatgctgttttccattgaaatgccataccataacttagaagcagccttggccctacccttaggactagtaatcttatcactaatttaagaactgctaggcatcaatgaatctggtggccttagaaccccagatgtcactcccacccactggcccagcaggctgcttggctggttcccttcacgtgtgccacgcagtattagtttctcatcgtagacccatttctctgtggctgcacagcaaaatcagtcctattattaaatgccaccctgtaagctctctacccaggagattccctggcctcagaagcagactcattggctgctgcagaggactgctgaagacatttggggctgttttggcaagggtctaatccacaggactatgggtagagaaggcattaaaggggcatcagtccagcctccagcacatccacattcatctgccctcaagccagagcatagatgccaagtaaggctggtgagaggctttagctgggctactttgggccaagctgaaccaccacttgtacagtgagcaactactcccaggccaataacttgtattctcactgctgcaacatctagtccacacctcagtcaagcacaagcagtctaagcttcacatttctcagtcaaagctatttctggatttgcatatctgggctagccatcagaacttcaaagccagtttcatgatctgcatgtctgtgtgagtcatcaaaatttcaaagagtcctgaccaccccagtggacccattagcactcataaccgtttacctaaggaatccctttccctgaggacttcttagaaatagatgctagagagtaattctactcaggctttgaaccaaagatgttaattctttaaacttaaaatatgactccaattagcagatcttagaatatgcatatgatcctacagatcacttgaaaaaacagccaaaattgccttggcttctttatttaaatggatacctatgtcataatgcttaacacgtgcctgacacagttctaaatactgtacaaatattaatgcacttaattctcatagcagtcctcagaggcactattatcatcactcccattctgccgatgaagaaactgaggcacagagaggctaagtaacttgcccaaggcccaagctgctaaatagtgtgtgggattcaaataaataggtgccaggatgcaggctctcaacttttgggttctgctgcctcttcttaaatattcaagtttccagcagccagtgagactgccagtgaggtatgaagtccacacacacagcattacagctaaaaatatccgcatacagccgggtgcggtggctcacatctgtaatcccggcactttgggaggctgacggcggcggatcacttgaggtcaggagtttgaaccagcctggtcaacatggcaaaaccctgtctctactaaaattaaaaaaattaaccgggtgtggtggcgcatgcctgtaagtcccagctactcagtaggctcaggcagaagaatggtttgaacccggaaggcggaggttgcattaagtcaagatcgtgcccttgcactccagcctgggtgagagagtgtctcaaaaactaaacaaaacaaaaaactacacataaaataatttgaataaattgtttagcatatttactttgcttttgtatctgataaatttatagcatataaatcagtgcactgacaggagagctgttataaatttatgagtattggccatatgcactgttaggggtttagcatgccctgtatttccttgtacgatgtgaagctactgtggcataattaatttctctactgtgctggatgaggacccagataatgggactccatgcaccaaaatctatgtttcacatgtgattttattgtaccttgaaggccaactgttcccccttggggaatgggtgtgtgaacgtggcagtaacatagcacgagtggagatccctccacttgcctcctaattccatcacctcctacttctgccaaggtcttgctccatctgttagtttccccctctcttggctcctgctgttcagtgcacaaacatgctcaaaagtctcttcccatctcagacaagaaaaaacccttctgaaaatgtgatatgtgtcttggggtgaaaaagagtgagaaagaaaaaagaaaagaatgctttagtttgcagtaaatttctctccctggttatgatgtcaaattcatcacagctcattaacaattagatgacggtctatttcttcctaaccttgtgaaatgagaccaatctctggcacagatttcatcccaaaggactacggcaatgcatccatatgtgtggagtcacatccacaggtgtgtaagcggctgcttggttgtaactgcctggaatgcctaatgaggatgaagaaagccatatgcactggagacagcttcttaggaccggcagcattttaatgacaattgtttgtgtatctgtgcccacttcaataaaaatgacaacagctactctcattctgaggatgtattacagattccgggagagatcggaggtaccactagaggtcttctaatattaataaggcctacgtacttccatcctcaccactaccaatgcaaattaacaccccactgcccaagtgtgaaagccagggagctcccataccatgagttcatatttgttctcaaggtcatacacaatgtgtgccggagccaagattccaaaccatctgtgtctacctccaaagcttatgttctttccagaacattcatgacctatccttttttgtagaattttccctaggcccacaccaacctctctcctattcaccttcaaagctaagttcaaatgataactttttgtaacgaagtctctggttcacagcagaatgagaaaaacagaaaagtgtagtattttaaagccaaattattttcatgcaaagaactgcttaagaatatgtctgccttacatttttggtgttaatatgattgttatgttaaagaacaaaatagtgtcgctggtgcagtggcttacatctgtaatcccagcactttgggagacagaggcaggaggaccacttgagcccaggagctggagaccagcctgggcaacatagaaagatcttaaccaaaagaaaaaataataataaaatggtgaatggtaggtttcttcttctttttttttttttttttttttttagatggagtcttgctctgtcacccaggctggagtggagtggagcgatctcagcactgcaacctccgcctccagggttcaaagagattctcctgcctcagtttcctgagcagctgggactacaggcgcatgccaccatgcccagctaattttgtgtgtgtgtgtgtgtgtgtgtgtttttaagtagagacagggtttcaccgcattagccaggatggtctcgatctcctgaccttgtgatccacctgccttggactcccaaagtgctgggattacaggcgtgagccaccgcacctggccttttttttttttccaaagaaagtaaatacccaggacagtatgtggtatatagtaagtgctcaaaacacccatgaaagatttgcctggtgcaggcaagggcagttcctctgtactctgcatggctgggtctagcctagcatatcggcactggtgttcttccccactggcatttaggaaaacaccctcagttagaaaacaagtgtgccttgggatagctcagctttgaggatcccttctgggagatggggcagagtggctttggtggacagggttaagagccctgggtccagttgtctctcggtgcctgtcaaccccagaggtcatttattccaggcttggagcgagccattgcccatggacctccaaagcacctcctgacacttactgccaggcagtaactgcaagtgggagaagaacacaatagaacttattagtttgggggtaaaatcttggtgttacaggctgaattgtatctcccccaaactctcaaattcatatattgaagttctaacccctagaacctcagaatgtgactgtgtttagagatagggccttcttaaagaagtaattaagttaacaatgaggtcaattggggatgggccctactccaacagactggtgtcctttgaaagaaaaggagattagaatatagatatacacaaagggaagaccacgtgaagacacagggagaaagtatccatctacaagccagacagagaggtctcggaagaaacccacgttggtgataccttaatatcagactgtgagaaaacaagcttctgttgtttaggacaccctgtctgtagtattcgtatagcaactctagcaaacatttaggaagccgaaggttcttcccaagaaggtaactgagatgtccctatcatggtggggtgacaagaattctaagactcagaaaaaatgattttaattgactgggccaggaaaggtcaggtcactggcacagcaatagccctgggagaggcagggggcagaagacacctgattacaaacagctgagcaaggggtgccaggctggtgacggtccatcagttggttcccaccttcactggggaatgggaaaacgcttttaagacctgctttagggtctgggtccagcccgtgtgacaagaccaatcccatcagtgctcacagacatcaagaagctcagctggccatgggcagatcatctaatgtacaatcagggagatggcgtcaataaaagggggcaaccaatgtcagggcctcaggacttaatccaacgctttaccgaggcaacaaagccaaagccatctttcctatgaaacaaggggcaggagacctcagaaacctccaggagtaaaactgacatcacactgtagctagctgccaagacgcggaaccagtgttgccgcttttgctccccgcagagtgggtgcattagacagaaaatgcttagcgtgaacagaaataggagggaatggtggcagtgagggcatcttgtgttccctctgccacagtcatctagttgggaattctgtgtctcacttctttttttaaaacattctgacaagaattttataatcaaaagaacacaaaaatcaaagctattatcaagaattgtctgacttcataagcagctccaacttcttattcccacctgaattgtggttgagtgggtttgcacagtttttcatgtgtgcagggctttgctgctggagccccgggaggtggtatttttgctctgagaagaggattcactttagcctgctgcaattcatatctgcctgggaagacatccagaatgattcacaaattggttatggcaacaggtaaaaagaacaactgtcatgaaaaggcagcagcagcaacagcaacagcagcagcagcagcagcagggcagaaaatataagtgttccttgaaggaaaggtaactaaaatatctttgctaaatttaaaaatctatatgtgcacgtgtgtgtgtgtacactcagacacatatgcataaaatgattacacatataattctatgtacataaaaataaaatgattaatgtgaatgagtttgcacattcactgccgctatggtccaccagccaataggaaggaacccaggggaagtccacgaaagcctgtggctataaagaatgtggcgccacactcccgcagcacctatctgctggtgagaacactccagtgtggagttgtcctgccacctttcaagaggtagatgaggaaatcttgtcccccagaccaggctaaagaccccttgagagcaaggactatgtctctgtcactccttcgagcttcacttcactccatctcattcaagatggcacaaggctaagtactaaggaactaaggtatgaggtatgagctaagtactgaggtgctccgtggttcatttgtaaagggtcactttctgatccatactatgaaagagaaacagaaatatatgagaaaatgctctttggaaagtgaccttgtcttgaacctgtggcccactttgttcttctctgtccattctatgaccaaaagagagaagaaaaagtctatcgtgaaatgctcaatgattccatttccttcctacccacttctacttcctcctgacacttggcatgtccctccaactcacataccaaacaacctccatcaaagattctttcccttttcttattgcctttggcatcagaaactgcttgtctgtgctccgtccaggatccatctaacaaaggctgaagccccacacacctgggattcactctctgtagcaagatatctgaattcctagctctgaagcttcaaagcaaaggagagaaagaaatagggagggaaaggccaaagccaacttaaagacttcccatgagaatggaaaaggagcatgggaatgctggaggtggagagagaatgccatccagagactcagagaatgtaaagacacatgtatccttccttgcaagagttcttctttgaggtttccacataatattccaaactaggtctttccaaggaacttcgaaatcttggcaaatgctccgtaattcctaggatacatcgtgtgatctggtggcagatgaagagatgaaaagtgaaacaaaatagagaagaaaaataagcagaatgcccaacatggaagagaccccttccaaatgcacaaggtcacagcaccatgcaggaaagggaagggcccacaagctgccaggggttcccgggggtgctgggaaatcacagatcatgttaccaaaggagaactgctaaatcttatgacttttgtgtttaggatcagcatatggtccccaaatagtttgcccactaaattgcctgaagaatgttttttcacagagggtctacttggcatttcacaggcaggacatttctttatgacatgagccttgttttgcctattgaacaacatttagtagcacccctagaatctggacactaaatgccaaaggcatgtcccagttatagtcacaaaccaaaacaactgtgaacatttaaaaacacccacttagcagaggattcaggggatatgacctcttgttgagaattatttgcaagttttccatgaaattacagatcaagctgtctttgatgaaaaactctgttgaggaagagtgaagtgcttttctcaattgcaacatttcaagcctaggagactggctactgtgtagggtgggaagtcctgatgggagctgcctaatatatggctcaaatctcaagaatctgtccaacatggtggtctgtagtcatcctgcctctgcagggttggccacagctctgggctcccacttgctgaacagtgttaaagttggacacgttctcaccagtgtttggaaatcccttacctatgacagatatcactctctgggctgccacttagtggcaagaagtgttcttctgccccttccctgctaataggaagaaagacaaccatggactttcttttcttttcttttcttttcttttgagacagggcctcctctatctatcacccaggttagagtacagtggtacaatcatggcttactgcagcctcaaactccttgggctcaagggatccttctgcctcagcctcctgaatatctgggactacaggtgcacaccaccatgcctggctttttttttttttttttttttttttgtagagatggggtttcactatgttgcctaggctggtctcaaacttctgggctcaagcaatcctccagccttggcctcccaaagtgctaggactataggtgtgagccattgcacccaggctaaccacagaaattcgtagttcaaaaggacttttaggagatcacttacatttgggagcagtggtgcacagagggttaagtgttttgccaacagtcacacagtaaaaacaaccaaaagaatttatgtacataaagtgctgtagcacacagtcagtacttgataattatttcccaccggtattatcattccatcatccaggaagtccagccattgctttaagtggtatttctctggaaggtagaaactctacctactcacatcaaggacaaggccacatggtttccttcagtgtcccccacaggatgaccatggaatgaaatcaagattcttgtccacaagcccagcagtgcttgctgctcgtgttgtggaagcccactgcttgacaggctgaatgctcccattttccacatgtacagtaaaaacaccgagtggtgtttttactagaaatggaaaggaagaaggctgcctagctcacaagccttctagcaaaacagtcagtcaaaccaaagttgggcagggggtaggtaagtaaatattctgtattctcacctcagaccagagatgggcttgaaactgattgtaacatgtctactccaaagaggtcaaggggtgagggaaactcatgtccagcatgctctcgcatggacatggcaaatacaggatgaagacagacagtggctgagaccactccacgtcccttgacccccagcacagatgccttcctctcctgctccacttcatctcatctctcaagtaactacccccctcccttctccccacaagatcactgaaggctaatctagaactcttacttctaagcattaattcactcaatattttaaaagtatcctaaagaactggtccttgccctgaaggagtcgatgatccagcaggagcataaaggcacagatgactcatcttccacctctacacaataaatgtcatgtggaaagtagactcatgatcccctaggcatattccttaggacaacagtttcaagagatacactgcctaaagaaagggtgccagggccaaatgatctaataattctggaaaatgctgttaccaccccccgctttgtaaagactgacagtacaaattaatgtactaaaggcattaacatgtattgcagtgaaaagccttattagtgctgatcaactcaatcattctcaagcatgtttgactacctaaatttatcaacatttcatggagacaatattccattgaatgtcatttgctggattctaattggggtgattgggaataggtgttaaagaagatgctgcattttgactgggcccaaaagatgagtagagtttcattagtcccagatggaggcagaatgtgcaatccactcatgcaacacacactcactgagtacttcctaaaggtgaggccaacccttggctctggggggctgctaccctggtttccactgcaaggcagagtgaaaggcactagagcactgatttgagaaagggcttcctatgtttggggaatagcaaatgcatggctagagtaaagcaggtgtaaaaagagacagaatgaggaataaggctgaaccaaacagaaaaagcatctattagatcagttgtttatcaggccacctgttacctgttaacagcactggcctagacagtgttaatcatttctgtctgctgtggctagtgaagaaaccctgagcaagatcttcccttctctaggcctcagtttctttatctataaaatgactggattctctaaggctacttgcagcatccatgtctcagtgttctgtgattataagatataaaaaggcagcagcacataccagcactaaaggacaggaagaactggggacaggagaatagctattggtttagacatacatcgaaaaatcaccttgaagaaaaatgagcagaagaaaaatgaagcctattccatcttcagctctcagggcccagactccctccacctgatatcttaggattctgcttctcaaatgggaagaataaacatggcatagtttccaacagtcaattgtgctcaaaaatgtaaagaagaaaatttgactcttgttctaaaatcaagacatattttagacttagcatgcaatattctcaatgtattttagagatttaaaaatgaggacttaaagaaagatctggcttgtgtgggctttttgtcttatgggtgagtcccctgggtgctcattcaccgtctcccagtgtgaggagtatacttggagggaaagtttcactgggcatctcagagctttagccatttaaatcttgtaaagacagaagcctatttatcctgacttaagctgttctaaagagacagaaactcaccattggactggtcttctccatagtttttatgggatggtgcatacaagaacatcagagcaaagacatacagattccacatcccatagatgcctgtgaaaaaggcactgttcacttggactgtgacgccgccccatttccaatggccttccgttacctgcggagaaaggatggtgatattcaattgaaacagagaagaaacagaagaaacataacaccaataaaggaaccaaccaacatgaaaaccaagtctcttctacatgtgggaaacatgaagggccatgtaagactccatcttttaatctgaatcatttcggtgtaaattaaggtcaactgaaggttctctagctttctgtcaggcacagtcagtggtccttaccttgcccacagattagtatcacctggggagtgtctcttcctaaaaacagcaattcattgctatccctaagttaaacaaactgtgtttgagcccatcacttattcacaattataattcctcctctgctgtctgtcttcccagctagatgtcaattccctgcaggcagagaccagttctctgctgccatgtctttaaggcctgatgcaccatagattaattcaaatccagtgtctaccactcactcggcttaatgtaagacaagatgaagactccagacttcagaacttcagtgtccgtaagtgtaacataaaagcttgcaggttatcgaagagaattaagtaaaaatatttctagaacctgcctggcaggtactcagtaaatattagttatttctataacatcccttgaagtaagccactcatgaaaataattatgaagctttcatatgcttcaaaattctgcaagagatgttttgaagctgcttttgtctgtgttaatgatttggtaattgtcttaagggctgcctaaagatatatggattacactaagaactgtcaacagagctgctgagctaagtgactaatttgtgccagctctgagacaaatgaaatgattttgaccacttctgcttactacgggacacttaaaatggaaatagaagaaagtattgggtaaatattcctttgacagctgaatgaggctgcgttgtataaactttctctaggaatcacttttaaattgtaagatggcaggctagattgaaatgttaagaactttaacaagcaggtggatttcattgcctgtttatgatacagtgggtctgtgttcattatcttctgtataatccataacccacttggggccctaggccaaattaaggtctaagtataggtatttttttctgaaagaccaggagtgtcagttaaccacattagccaattatagacttagcagttttagtttggccttggtgatacataattcttcactttttgtgactcataaacaaaccactattatgaactcttatttattttggaaaataatgcattttatataaaatgcccagaagtgttttctggcaaagatggatttcataaccattactaattttaggacaatgtaccagcattcaagctacttaggacttcttagaaatgtctccaaatgtcgctcttctttaagtgcagaatatactaactttataaaaactatattacttagagcatcttatgatgatttttattgcatataatggaaaggaaaagaaagcattaagatagtttccagaaatacaggtacctgctgtcataacacagagaactcttctgtatgtgattaaggaggggaggctaggctgtcacgcatcctagctgcaagagagaatatggcaatatggcagctcttctactctgttaaggcagtggacccttcagctcagggaagggccagtaagagaccctattcctgcgacagaagctggaaatactcaatattgacaattttagtgacattgattcttgctaggattgacatgactgacccatctaaggaaacaccaacctatgtgccttgcacacagtggtgctcgatagacatatgttgaatgaacagaggtaaagtacaggtatgtgtagggactccaggacaaatacatggaggtagaaagtggagatggaaagaaccactcttaaaagtacttgattgaaaagtaaagacaaagtattgcagtccacaagtcataataattgaatttaaaagtgagaggagatgccaatgtgtgacaagtgttattcatttaaaacattgctttccgttatacttatttaaaataagtggttaacacaaatattagcaaagctaagattcttttgtattcataacaaggataagcatatttattcaatgctaatgatgtgccagatacaatactaaatccttttacatgaaacacattatttagtcttattaatgacgctgtgaggtaggtaggtaatatttccattcaacacatgggtaaactgtggcacagaaagatggagtatcttgcccaagattgctcagccagaaagccatggctctgactccaaaagaaggtattcttaaccattatacaacacaagggtaggaatgctatcttaaacaggggttgatctctgaaggtagcacatgctctgaaggtagcacatgaggcaacgactatgtaaggtcaaatttccttttgaaattcacttcattgcccataatgtacattacaaatacaacatacatgcacacatttgtctattcaaatctgtatagtatgcactatatatcctggacatagtaacatatggtataaactggatatataaacaaaataaaaacttacagtagaaccactggaatgagatgcccatagtatgagaggcacacaccaagcctgacaggaaatatcagactcatgctcccgtctcgtacttgctctgggacacatgcacattgtttagagtggagttgcagaattacacaccctactgaatgtgcaatctgtaaatgtggtgtttcctgctgtgggcaaagagttgaactgcagaaataaacggtatagatagtgtaactctgctctttggtggctggcttgtttttccctctcctctcccaattattcatgcctaagacatcctcagctctgagcacattcccaccaatatgtaccacaatgagcagcctcaacagagcaggccttgtaaatccaaaatcttactaatgccaaggcggaggtaacagtctccccccttttaactttgagagaaaaatcaggtagccccagcccccctccgccaaaccctcccccctcctcaaaatccccaaatctcaccctctgcataagtcttatttctaaaagtccctgtttttcctgattttacatttgaacaatttacttttgtgtgaaaccacccaattatacccctggagccaagtgaaggtcaaatctctttacacccagtagtcttgacaaccaacattccacttaacaacaagatttccaaatcccagacacaggctctcttaccggaaacatttcctctgtaagtaacagaatgaagtgatcacacacacacaaaagagctggggacaggctctctgggagtttgctgcatgtggcttgacctgaatgtcaggcacctgggggtccccttaatgaaggtcggtgaccttctcccctgcactgcacttctgttccctactgccgccacctctaaatggaacgcctctttcttttccagagggaaggggctgaaataccagactgcgatgtaccatctcttggttgctatgactgaggccattaaaatggcaggcattaaaagactgcacctcagtacccagctacaaagcctcaaggtcactgcattccacagcttcccgtcgcctttcattcctggcctcagagcttcaatatcctggcgagatcccctcgcattatatttcatgaggcttaaatgcaagctctcccacagcaagcccgagagtataatgggggttttaatacattccttttacctaaggctgggatccatttcaaaaagttacccaataggtttcctttcaggtgagctcattgctctgacattccaaaatgacattaaaaaataaatcctctgatgactatattaatacagtacctgggacactgagagttatgccggaaaacgtcttagatgtctataaataaatcttagaaaaaaaacccagcaggaggaatgtgaggagctaatggaattcaaaaggcctcattgctacccccttagagttgaaatccactccgggccgactgtcgcagcagatataaaaagccagccacaggctgaagctgtattagaaaatactgaggcaatagaatattaatctttttctccaaagaaaagccacggactatgctccttggaagatggcttcctttgctataagaagtacactaattaaacatgtacaaggttaaatcctggcaacatgcagctgcttcagggatcagtccttcttgacttcaggtgggaggcattccccgcagaggcaagatatacatgaggcagtgtggggagaatgacgtcagcctcccaaactggcacaaggacctgtgtgtggccttaggatcaaaagcgtccttctttctgctttcctaaaaacatatcttgaaattgccttttatgcctcaacccatcttccttgagatgccgtttctccaaggaagtgctctgtgccctctcagccttgcaggtctggctgtgtcaagtgccactgtgcactactgagggactggaggaactgaaaagcattttggtcataggagggaatagccacgggagaagtcaggcctcagacactcttgtttgaatatggatgtttgagccttagctggtagaataaaacactctttcagagtttgaaatagttttactgcaaatggagtggaaagcgaagtttccaaggttttataaacaacctgatataaacacagcagtgttgtaggtcaaagcagatgtggtgaacagaacttacaaagacatatatgtgtatcagtttattttttccacgttcatttcaacctcagcagagctagcaacactaacactccccagtggcagagccaacaacagggctctagaggctccaaacttggggtcctcttgggtgtccttggatagaattcaaggggtccataaactagaatagaaaaaattatatattttcactagtctctagctgaaagataatgtttacttcaattatggatgtagaaaaatccctatagtgttagtactactgtgattttctcaatagaaatcatgatattttcacatcaattacagttgtagatataaatctgtaatatacctgtagcatctgtttcactgtaaatatatattacatataatatatagagatgattccccttgaaattcgaagtattttattttacttatttgaaaccattctaagaggagactcgtagccttcttcaggttgctaaaggggtccatatacaaaaatggttaggagtccctgtactagggaaacttcccagcagaatggagcaagtcgtgtcctaagacactatctacactactgaaatcctccattttggctaaatgacaaagcactggcaaaagagtcagaaggactgcgttctgatctctaacttattgcatgtcctttggcaagaaagacattcaagcttcttgctattcataagaacacagctactcatgcttacaatgtgccaggtgctctgctaactacatttggttgccacaatgatggttcagtcaacaacagaccacatgtatgacagtggtcctgtaagattataatatcatatttttactgtatttttctatgtttagatatgtttgaaatacacaaatacttaccattgtgttacaattgcctacagtagtcagtagaggaacatgctgtacaggtttgtagcctaggagcaataggttacaccatatggcctaggtatgtagtaagctataccatctaggtttgtgtaagtacactctatgatgttcccttaatgaggaactcacataatgatgcgtttctcagaatgcatccctctttgtaaatattacttcctgtagtcattacagcaaccttctgtggttctattgtaatatttattttgcagataagaaaattaaaccttagaactgttaagtaatccatccacagtcctatccagctaggaagcaacataaatgaaaactttctccaaagctattagatatcatagtctagcaagctaggataacaattcctgccctacttacctcgtaggatttttgtgatgctcaaatgaataatagatacattagatttaaacagtacttcccacccttcaaaacaagttatgaatattttaaaatgattgttattgagattttcaagtatagcaaaatgttgagttttggaaataaccagtgaaaagacaagatgctatcaaagagacttttgaattacatttcatatttaagtggcaatataattattacaaggaatagctgatggactgtataaggatctatgttaatgctagataaaaatggaatcaaatttatgcttgttagtgttgtgctacacggcttgataagtttttctcataagtaaataaaatatgtgcccttcaatctggctgtaggcttttaatttatttggaaacttttatctcctacaaggttttacggaaagagaaaatttagtccatttggccaggtgatatcaagacccagaaaaatatggcttgaccagctgtccagaattatggcctctctcctcctttcctcagtggctctattgaatttctgtgcagggtagagggatctctgcagagacattctcaccttgacatctcagggtccacttacctgactaacgatgaagaagatgacagtcatggcagcgcaggccaaggtgataagcatgaggaacttgaacctaaaaattagcccctattagaaaagaaagagtagtttaatactccatcagctaccaatccttttctcactatgtaaatctataaaaagcttaattttaaagaaatctgtaaaaccaaatccctaagaatgacagtaaaatagtttcccatagtaatatttcttctgcagaggtgagtgtggctgaaaatttcttgggccaagtatttcctatgttcttatcactcataaagcagcgatacgagagcctgggaaattatattcacaacacgtcgtgaggctgctaatttccctgctaagctggttatgcttctctgcaagggttcaaagttaccaaatccaagttttctgtggttgtaataaaattctgctccagtgaacaaaaagaaatgtgcatattaatcaacatgaagtggatttggttgaattttctcatgtcactccagctctggagacaggcaagccttagaaagtgcctgtggtttcctaagagcaggatttaagagaacctgtgtttcagagagggaggcctattattcaggggctcttctgtgcagatctactgcatataaaaactctgaggttctgtagtttctgcttctcttttcatacaggaattaggcttgtttctccaaggacagccacttaggcatgaacccaggggatccctgataaatcaaggatgtgttgcttgcattggggatttgaggatgttaagtgtttctcttgaatgaggaacataatctataaacagagattactgaactctgtctgagcatctgctggatattttaggggaatgtggcctgttaagagtctggaaatcagatcacgtgggctaaaccctgtttaattacaggacagggttgattctgggacagaactttgactaaagcctcatcccaacaaaatcccaattatgccatagtccaatctcccagctagtatgtaacctacattccatcaccaagctgaagaaccggctgaacaagtttattcattactgaaaatggaaacacatttgtaccacagaaaacaccaagatttaggccagctagatgcttctcagagtaagatttggcctctaattttgcccagagatcctacatgagaatctctcaatttgtatttcaaagtaaaggctttctatctccagggtgtgtgtgtttacacatcaagtggaaagatcaagcaagcaccagttccagaacgagccaagaaatctgcccacctcatagtgtagccgccggactttgctcatagctggcaggctggactgcttcccactgatgttccgaaacacctgaaataccatgaagcatagaaacaggaagtagaggcagaggcagattccagccacgatgatgaaggccatctggtcgtgtccagtaaaggaaacaacgggctagccaaggccaagttgagccgggtccaggcccttctccccaggtctgttggcaatacttgttttgtctccaaatatgtagaaaattttcaaggggataaaatattaaaacctgatattctaatgccaatgataggtttcttgacacattagtaccacagagggaggtgttcaatattgctttctaaaccaagtaagaaaagaaatggtgtcttgcttgttagaaatgaagaatctaggccctaccctagacctaatgaatcagaatctaccttttaaccaggtccccaggagatccgtatacacaataaatttgagaagcactaataaaccatatattcgtcactatggatcagatgaaaaaccacagtaaaatcaccagaagggttcaaatgtagatccccaggtccctccctagatatatggaatcagatattccagggctaggacatcaagtatgactatgtttgggaaccactgggctagtccttggagttttataagaatgcgattgagatactctggcataattgaagaggagatacgtgggggctcagtgcaggggacctgggcatgggcttgaaagtcttaaagtgaaaccagggatgaaggactatttgcaatcttctgtcaccacagaaaatcttgtccaacagaatggggattcaaggacacatggcacaggtgggagtctgggttgctgccagtatacttgagacccactagggagactgacctgccaattagagccagtctgagaaccaccaagtcttaggatagcgtgagctgccttggaaggcagatgacctgattccaacccctttctgctacaactttgcccaaattgcctttttttttttgagacagagttttgcttttgttgcccgggctgaagtgcgatggcacaatcttggctcaccacaacctcctcctcccaggttcaagcgattctcctgcctcagcctcccgagtagctgggattacagggataagccaccacacctggcccaaattgtctatttttaaaagcatttaataagtatgaacttggcgtgcatatttcattaaataatataatatctaatgcagtttctccttctttcctataatgaacatcatcctggaatgaagggaatatagttattttctgcaggacttgaaattttactcactccatcctatctacaaaattaaaaaagttgaactagatttaacattagaaacattcttcttgttgtgcagctaacatttggtgggggcataacagaggaagggtagagcttctctctcatctttgaggaaatgatactactgatttagtttgctcacaatgttcttgtgacactgagaaaccaatataaacatcatggcaagacaaaggatattccctagcacgtggcaagatatgagccatcaaggaagaatacaacccaagcctttctctccactccagagcagagtctttttctcccaagatcatttcacatactattccggaagataaaatatttaaatccagcatcctaaaagggataagctaagactgtcacttctgcttcatgaagatgacttagagtttatgccaaccaaccagaagccttggcgacttctctggaactaatcaccttagccttatctccacttggtctcaggaataaatagcagcagtgtgatttgccagcacaccaaggtcacttaagaagtctcacacataggtggtttcagaaacaggctcttccacaggggcccagagatgaacctccatggctccagggaaaagctagtcatgcttcagtctgcaggaaacagtgtataacagataattcagacaggctgcagtaagcctagcaactcggatccctctgctgtgaggataggctgtgaccttctcattttgcctgctctcacccaggcttgaaagcaagcagtaattcttcttattattagccttaattgtgctgttatgattggcctgagaatcaaagccctggctgagtacatatggggagcatcagcagagccttagaaaatgatcttggggactgggtggccaggggaagaaataaaaccctgagcccatcaaggaaggatacggccagctctgttccaatgtctgtagtccagatactgtagaagggattcgtgagttgtacccctctacaaagaaaatgagatggaaaggcaagacacaattaatacaaaggcaacgggaactttccttttcacatattcttagcttttcagctgcaggggtgagggctgtatttaggctaaaaaacattacagaaatcctaaagagaaatgaagcttgtagaatacatcggcccaaatatttttcaactgtaaagagctgtgcctttgatttgatcccagaccttgtctgaggatgtgaccacgtccagtgcttccaaaccaaaggttcccgaccaccattctccttttcaaacactcctcctaaaatgacaggagtgggcgtggtgatgcacagtttggctcagtgtcccacaaacacttgctcacctctcacacatgtcaaatatgaagaggcagaaggagccaacggcaatgggtccgacttgcttccaataccctgcgatgtggttccgctcgtgctgatcctgaggaaaaccaaattgagaagggagatagaggggagaggaagaccaagcaattctatgggggagtcagcattcgaaggacacttgccgaccacctattgtgtatcaagcactatgctagattctaggtatgagaacaaagaagatgaaaatctcttcttcaggagctcatctctgtgggggagtctggcacatacgtagaacatgacaaagcccagccataagggctctgagagtaataagaacaggatgccatgggaacacaaagaaaggcctcggctcccaggcaggggacattttgtggtccacaaaataactcattctgaattaaatttctacgtgacttgtaacttgtgtttataaaagtgactgatcctcagaagacaaagtaaagacattaaagcatttaaatatgtaaagtgtgtctattatggtgaggaaaataggcatattttctccccatccttattaaaaccaggaatgagtccccttgataaacaaagacaccaagagaaagaaaaggaaggaatgtagaatgagaaaaaagggaaagcaaagatgatcttagcctccaggtggggccccaggtgggtcagtccacaccagctccctgcggacaatccttggctggcttcctggtgctggaccaagttccatccactcccccgccctgctgctgaggcctcattctcagcgcatctctgctggaggacacctcatggagaaagaccccttaatgtagacagtttagcagtaggaagaagtctctctctctgctctcacactgctctcctggaagggcagcaggacttgagaggtctggttttcatgattgagccataatggaatttaaaaacagtccactctgctgtgaagcccatgtgcctgacgtgaagaccaagttccagctggcatatcatcttagccacaatgtgatgatgacaccattcttatttttaaccatggtaccttcaatccctcttgaaatatgatttggtgtctgtgcaaactgaggagaccgggaaggtctgtatttcagagtaataggggttactaggccacctggacacattgccagctggaaagagccaggcccacattctctgatggttaacctgtattcctggggacaggacaagcagggcagaagccagcagacaagaaactcaagctcaagggcaagaaataatactaatcattagaatgtgtgtgtttatcttaagttactcacattctgtcatttaattctcatgaaaaccccatgcagtaggtctttacatcccattttatagatgagggacccgagattcagagtgataatgtcatttgcctaaagccactcagctggtcagcaggtggtgaagcaggaatgtgaaccagagggtctgcctccagagttcccacttgtaactactagtttattctgtctcacccactgctgactagaggcaaaggggggcaggtgtcagcttggcagcctgcacagagcagctggtacagacgtctgtccctcccggcggctcttaccatcatgtgctcgccacagaagatgatccagaaggacagaagcatcgcatagaagatgccctgtcggatgtcaccaaacagcagcatccaggtccagtcaaacccgatggaaaaccattccactgggatattgataaaggtcatggaaatcccaagggcaaagatgactctgatggtgagaaaatatcaggacagccactttattcatctggaaggcagattttcaaacaattccccgaattcagttttgagacatgagatgttacttattgggtctgaagccatatgatcaatttcttctgcacagagatgcaaaacgtcctatgtagttggcactgctgcagaatgagggagtgctataccaacctttctatggaagtgaacctgacctccttaatgcctcacactttactttggtaccactgcagatggcagtcttcctataatgtttgtgtccccttgccttctcacccaggcctcagtgagtacaattgtcctctttcacctattcaggttatcattcatctgatcattaagaacactcattattattgtgatatcctcagcaactatgaattatataagcatatttgtttcaataatacatgactccaaacacatttgaaatgtaaattctcttgactgcttgtttagcttttattttactcttcccctgtcacactaagaactgccaattctctactaaaatataattcttaagtcactgatttattcatacttttttccatccccttgaaacacatatgttaattaagcacagatcatgtaccaggtattgtgttagcactatggaatcctaaatgaacaggacctgttttttcactcacgggagatacagttagtagaggagccagataaagagacaactgaatagattaggatcaggaacatcatagagttttaaagcatagagggctgctaccaggacttctgactttgacacagacaggaatggagctgacttgtgagtcaaagtgagggaagtggaaagggtgtttggaggagagggcagagcctggatggaggcatagaggcctggaagaacctgctgcatttggggatctgcatgtggcacatcaggaaatgacaggacatgagaccagagaaacaaagagggctgtgctcatgaagaaacttgcataccccactggagaactgaaatttatcttgaagagactttttattggaatccaataaaaagtttaaacaatggagtgacatgattcattcaaaaaatatttattaaactcctactatgtgtcagtcactattctaagatgctgggaatataactgtgaacaagaaaagcaaggattgtgctcttgtgatgcttgcatagagatggaatgagagagggagtacaagaaaaagataataaatgaagaatgagcatcatgaaaaaaaaagctaggcaagagagtggagagcaatggggatgtgattttacgtaaggtggacagacgaagagatcagcaggtgtgaaggccctggggtgtgggtttgagcacaataaagggggctggtgggtggtggagaggacaagtgacaagatcagaggtggaaggcacccaatcatcaaggggcttataggtcagggcaaaggagatgaaaagccagtggagagctttgagcagaggggtgacaggatctgattaacacttgaaagggggcactcctggctatcctgtgaataggctgcagggaggcacgtgatggaagcaaggaaaggggttgcgaggctgttcccactgatccaggtgagaagcgatggttggttagttagattagggtggcagcagtggaattggtgagatttcctggtgaggttgatgagaagtgtgaaaaacagagacatacaggatgactcactgctacatttccagtctgaacaactgaaaggatggagttgccttttactgaaatggggatcctgggagggaataggttggaaatgggacacaatcaagtgttgttcttggtacatgtgacattttcaatgcaaatgaagacattaagtaaagagctggaatatttgggtccagagttgggagaggctgaggctaaagatacagattaagagtcatcagagaatagatgatttttcagaccacaaaggtaggtgaaatcaacccccctagggaaagcacagctaataaagagaagaggtccaaagcaggtgccccagtcccaaagtctaagagtctggaaagatggaaggagacaggaatggaatctaaatgctggtcagcaaagaagaatgaccaacagaagggtagaggagactctgggaagaaaaactgatcaattatgtcagatgctgggatgaataaaaaaaaagtgaggaacaaaaaatgacctttggatttggactatgaaggttgttggtgatcccgtgaaaagcagttttagtagagtggtggagatgaatccagactggaaaggactcaagagagaacagaggagaagacatatgcacaaggtttttgagaagcattgctgtaaagaggagcagaaaaagggtatgtggcttcagggggaagtgggaaatgggagaattttgtctaagaatgggagatggcaggacatgtttgtatattaatagaatccagcagaaagggagaagtcaatgatgtggagagaaagtaggtacatctacaggagcactgtctttctgtaagtgagaggagctgggcttaggggagtttcttcactacaacacagacaagtatctgattctgaccacggaatatcccgaagagcaaagacaggttaaagaaccagaaaggtcagctgggtgtggtggctcacacctgtaatcccagcactttgggaagctgaagcgggcaaatcacttgagctcaggatttcgagatcagcctgggcaacatagggaaaccctgtctctacaaaaaatacaaaaaactagctgggaagcatacacctgtggttctagctaccgggaggctgaggtgggatgaccactggagcctggaaagtcaaggctgcagcaagctgagatcccagcactgcactccagcctggacaacagagtgagaccttgtctccaaaaaataaattaattaattaaaaagagccagaaaggtgagagaggtagaaccccgaggatttacttaataacaacttgcataggaaaactgcaggagaaaaaggagtccaggatgactcctggtcaaatcactggcctaagtcacacactggctgcttgaactggacaccagcaaaagcaagagcttggcagatcatgagaagccagtattcctgaagagcgctccaaaaccagctcttacttttccagaagcactgggggtcgggacatcatggtgatcctcctccaataccacaccataatgatgaagatgctgggcgtaaggaaggtcttcatggcaaaccacaccttggtgaagcctccattttggtggatcccctaggcagagaccagtgataattttgaaggtgaatattatcttagcatttccttctactagcaaatgcttttgtgggagaggtaagtggagacctcgtctgcgaatgttcacgatcaagagctttcacattcatagcaggtactgccctcatacacccttggactctcctcagagataatagaaatacatattaaaagagccctgtgctatggacctgagaccagagaaataaagagggcatcccattcacaataacggctttcatgttctggggtctgaaagaagaacatggggctttggggcagggtcactatttccaagagacttcgaattatcttaccttggactcatcccactgatattaaaatgctaatacctaaagatacactttagaggtacggattaatagggcaggtatggattaatagggcatacagggtgtatgatatctacccagctaccacccccacagtgtaccccccaaaaaagccacatttgaggtagaaccagaaatttcaggtaaaaagcagagatatcctctatctcttaacacctctcttggccgtttaatcctcattctaccctcacatcttactaatctggtctactaaggctacaagagctttttccctatgctaagattacgattaagtacatgatcaattttttttgtaagcttttcattagaaagttgcagatatcctagatggtcaatatgttgagattggtaagtgttaaggtaaatctattctataaaatgctaatcaatattggaaagtatatttatattacattcaccaatttatattacatataccattaaataaagaaagcaaggaaaacagtcagttcaatatgatcctactttttgtaagggaattactacgtataaaaaaaagcctggaaggagatatatcaaaacctgaacagtgattatttctctaaatagtaggacattacaggtaattattatgcttttctgtgtctctacacaattcttgtgggactttgttgagattgaaaagaaatggcctccttgcagcaagttctaacttttccccaattaaacaaatatgatggaaagaacctaaaccacccctattccttttaacatttgtgcttgcaaggtgaaacacataaaaaagaaaatttacttttatctcagtgttattcattatgcaatcatgactatttcatgatcttatcatcattgtaatgatcttaagtgatcttaagcccatttaaaatcttaagtgggcacaataattgcattgtttcccatttctgtaatctctcacacaaattagttcactttatgatctcagccatcatgagtatgttattattcccatttctcagatgagacaggtgaggcatagaggtgccaagagtgagatggagttcccctccaatacacatgtcaagatcaattacattcacttaccaccaaccggatatcctttatctccccaattcccacattgattttcttcttctcattcacaggcagccggatgtttaaaaggtaaaacttatgggccacagacccaatttccatgaaaggaaggacatcacattcatagtaacggccctcatgctctggagtctggaaaaagagcagagggtttgaggcagggtcactatttccaatagactggctctgaattctgttaccctggatccataacatcaattgtaagcagctaatgcttaaaggtacactttagacgtacagagtaacaatgcatactggaggcatggcgtctacccagctatcccaacctaaaacaaacatcaacaacaacaacaacaaaaaacagctgtattcaaggtagaaccagaaattttaggtagaaagcagagataccttccttctatctcctaacacctttctaggctgtttaatcttcattagaacctcgcatcttacgaatcttgtctgccagggctacaagagtttttatctgcagtgtgttgtcagggtcctctaaggctctgtggaacagtcagcttcttaaacgttcaggtggaagctcttgctgaatcattacactctttaatgacggctaattattctcctgattttggcctgagggagaagctagaagaagctgaaaatatcttctttttattcacttgccaggaaaaaaaaagacacaaggagccgttggtatttagggaaggtcgaaacagaagaaagaaagataataagattagtggccagagatacccactaagaattttctgcctccggtgcttcctaacagtccaagatggcagaagggaatagaagttttaatgaaataagaatttagcccagtgtctaggaaagcctcttggacttcgtgccaaacaatttaagagatactgcccagagcacggtggtgggaaattggacagtagggagacaccttttttttgaaaactaaattctgctccacctcaccaggactcccggctgtgtacctgctgaggggtgggggccaggggtaaagatgagcataaagaggcatgagcttcagcaggccgggacttttccctgatatagaagatgagagtctaccatcaatgttgggtttctatgtcagcttcaatgtttccttggcacctcctgatcaagtgataggggagatctaatttgtcgttcctaagcctgaatttgcaagacctccataatttgtcataaatcttcagagcaaagatccactgaagaagtgagaagaaagaagataacaaagagtccatagtctaagagtatgtaggaaggggctaggaaggggctctgccccttctgagatcttggctggtggggagggttccttactgaacagtcagagcttagaatgcagtaaacagacctttgtacagagacagagacacacacggcaaggtagaggtggggaggtgcttctacctcctcttgcccaccacggcacacataaccaatcagtcgtcaacagtttttatccctaaggtgtgagcagctcttgtcagacacaccagttgattagagttggcatgtgagatttttaaaaattcttctgtagaaagaatgctgctttttcaaacctcagctgcaggtcagatgattcttcctatatagatcatctttctctcccctccactcctttctctcttatactttcaaatcagggaggatgggggctctgcaggtactactaaaagttcactgcaggctctaattctccctcagattaagctgcagtgaggaggctgattatcctctgtggtaacagcaagagggtattttctgatttgtttccagttagggccttattttattgatggaaattgagaacttgagggcggaagggaacaaaacctacttagtctaattccatctggtgtgtgtctcgcccagggtcccaaaagtagtagcagaattgggagaaggacatgggccctgcccaaaggcaggcattgtgctgtgataaagactcctgaactccaggccaggaggctgattctagtcctgaccatgttccttgctgggtaccttgggtcaccctgcctcatttggcctcagtttcctcctaagtgagaaagttaagtaagatgatctccagggtcacttctaatcccccacgatgggtctctgggtgccccacacttccctgtcactactgagtgagtaacatggacacccttgacacaaatttacctaagttcaaattaaaagagacacattggcatctgggacactggctcaaccttcctgtctcagagacaagttcgttgtatcctgttagagacttttcttcatgcactaaagtcctgcctctgccagtatttagggcatttaagaagattcctctctctccttcctttgccccacccccagttctcccccaactccagcatgagactagctcattaggacaaattacagcaggtggcaacttgacttttttttttttaacttcacaatccaccagggactcaaaagctttaaagcaatttctcatttaatcttgagactcaagactaaatttcactgcaatcaaaaagcagagacttgatgattcatttccttcgcacttttcaagatttaatatctttcttgcaagggatcaacacatcctaaagataattaagcattaagaagcagttgcaggcaaacacccttccccctcgctactcagtgccctccatgtgtataaatgagaaatgacttttcccttttctatggataaaattctgtatccgaaagccatctagcttagatgttcaaccagtatttcaaagatgcagtcaacttgcagagatagctagaaaggtttttaattttcttggttgcatgcaaagatctgaaaatgttagctgttcctctctcctgcttcctctagtttgtctatcattcatttctacctacaaatggctttctctggaggacagccctatatttagcactcagcagagggtctagggcagtggctctcaaacttcatagagtttaataaactgaaggcctgttaaaacacagattccttgctcctacaccctgagacattgacttaataggttctgggtgtgccctgggaatctgcctttcctaaaacctctcaggtgatgctgccactgttggttctcagaacacattttctgtagctttgttctaggaaacctgcgggagggagactcccctagtgtttcaaaaaacactgcaatgggtacttaggtttacccatggagggccttagtttatatgttttctcctagtggcccatctggttaatatccgctttgactctcaaatatgtcccagacaagatgttaaattagaaggtcatcctgcctacgtcattgtatcatctagtccaggggtgtccaatcttttggcttctctgggccaaaccggaaggaggagaattgtcttgagccacacataaaatacactaataatagctgatgagctaaaaaaaaaaaaaatcacaaaaagaaattataatgttttaagaaagtaatgaatttacattgggccacattcaaagccgtcctgggctgcatgcggcccgcaggcagagttggacaagcttgatctagcccttaaacagactcccaaggtaggtactcttatctcatcttgcagaagaaaaactgaagctcagacagattatgtaagcttacctgaggtcacaccgtcagtgataaaaccacctaatctttctcctctttaggaaaaaaatggctaaagctggggcaaggtactcagaggcttcaacctcatgtttttactattttgcaggaaatcttaacagtaataggcaaaagcaaagttaggaaaggcccgtggcaggagagaagaggaaataaaatgctccgcagagcaggtattaccaaagctgtcctcatgcgaagaagggacacacctatgaaaagtaagcaaatctttccacatacctgagaaccaaataaaaactgtcagcttagacagcaaggggtcataccttgggagatgtgaaggtgcatttgagtttccgtggtactctttcatgggccatttcagtccactcagcaaacgcgtcatcacggtaagccagggaaacgtccatggagacttctgcattttctcctgcaagagaaaggatgcacgtttcagaaatgacttttggaaagatattttagaaacagctcaaaaaattcttataggctttgacttggaaaccaacgagacaaaagggaaatattaatttctatcaaactccaaacctgaagacttagaagtcataggatgaaagtctaagccaaatgctgggtcccctctcatgtccactctgccagagtcaagagcctccatttaaactcttccagagacaggggcctcactctctctgagggagcacaaatggtcagacctcatcctcccataacttgtaccatgggtcctaggtctgcctgtagaagccacgtggaaggtgatgtccttccttcttccataaaaagtgccttatgttcttgaaaaccataccacatctgcctgcattctctttcctctctgataaacatgaccaagtttttcaaccacctctcagacacgtccctctggggctcttctctggtcacactctgtctgaaaacatccttctcaaacttattcccgaaagttctcaaatataggatttgctacttttccaaaagtcaaaatcccttcatattgtggatgaagttaatgtaaaaggcaaagtgtttttccaaaattaaagacttatacacagataggaataatacataattgcacaaatgaatgttcacacatacttccatatgtgtggactggaccacgaatgagttaaactcaccacagaactcattaaggagatgagattaataaaacattgcacctattaattttgtctgttttatactatgatgagcaagttcaagagcagagaagtcttttttttttttttttttttttgagtataaaggtttaattctatttaaaaagaaagtccattaaatcaacttcaagttcttaactcatgggactattttggaacacttctttgtaaatatcattttgttaggttattggcaaaacagtttcaaggttcacttccctcccttgaaccaggtccaggtcattttgctttggggtaaattaaaatcagaattctaaaagttgagcaactttgtttttttttaattgacttagctctaacccaccattacaacttaaggacggcatgacttgataatgatggacttgtgtgaggttttgagttttcaattaaactttgtatcacatgaggtaattgtcagcattcttgagtctggttatggaataggcagatagaaccctgtagtaacaagagttggaaattggctaattgacaacgcacttgccttaaacatctcaagtagagaacttttacattagtgagatgtacttgaatttcagaactcaacaaattttaattactttttactgaaaactgcagtgaatgctaaatgtctacgtttacaataaacaaatacagtaacagtaactcacactgaaacaaaacatacttctgatagccattatttttctgcttgggacaattttaaagtttttcttttgtcacaaaaacaggaatgtatccaaacaaaggctcaaaagaggccatcttttcaaacaaaaaggcaatgattcacaaaagactgtgaatagaacatgtaactagttgatacaaatctaataggatttgttaaaatcagtcacatctaatacatctgaagtgctcttgtataaaatatcacgtgaagaaaagaagactttatcaatgtctaaaaaagtgggtttgttcatagacaatctgacaagttaccataaaaagtgtttcctgagacataaggaaatgcaacattattcttcttgaaccgttttagctcaactttccactcaataaaacagcagaggatctgaaactgagaaaatgtatttgagtacaaacagcttgtgaaagttaatactttttttttgcatcagagggtttttactgaacttacaaccaacttgcccactcagtatgcagttcagatgtgagagatgcttctctgtacaggagcctgtactgtcttcaatcctatgcgagcaagtgtctaccacaggcaaacagttttctccccattttgtagtaatgtaattttcctattagcaaaaggaggtcaccagcccctgtagacttaagggactcaagtcacaggatggggatatcctcttaatattttttattttgttgtttgaactcttgatgcaacattgtagagcagggtgttcaggacctgctgtgcccaagggactgataaaggaaaaagctctatttattctttgtgatttgatgcacagatgaaaaacttaacacacaataacagaagttggtcgttaataaatcacatcctagtctttcagcgcttccgtaagcagacgacatcttcagttttctagctcttgtagttttaacactgcagcatcaatgatgcataagtccagaatcagttacaaagaccatcatattctttttctcttagttcatcatttttcactatctcttggtcccaaatgtatctgaatgattaccttccggcattctctgctattgctcgttggagtgctctcgattgtccccgtgttttgtgggctggttgggagagggcgcctgggaaggatgtgccactgttgggaggttgtgagtcactgggatgcctccagggatgatcccttccacggctgcaggaagtcctcctggagccacgcccacgatgcctggcggatatctgtatgtggcaccattgagctcaggatgaattgcttgctggtctattactgaccaaggcgctgatgtgacagagaattccttgttcacacagtttcttaagctttctgggatgtgacctgtgatggctcggcggatctcagtggcagctgcctccctcatctccagtgacgcctgcttgctgtaccaggcagtgtgaggagtgcagataagattcggtgcatctttcaacggaccctgagcaaagctaaagggctccgactcacgcacatagagggctgcccctcgtatcctgccctccttgagagcttgtgctaaggctttctcgtccaccaggccaccacggggtgcgttcacaaggaatgctccctgcctcatctgctttatggtaaagtcattgatgaggtggtggttatgttcgttgagattgcagtgcaaggagacgcagtcgctctgatacagcaaatcctacagagtgtagaccctctgcacgcccagggatcgctcgatcccatcctgcaagtaggggtcataaaatatgacgctgaatccaaaggccttggctcgaactgcaaccgcctaccccctgcgatcaaagccgatgaggcccagcatttccccacggatgctggccgatcccgaggccaactcgcggttctgctccatgctctgaacccgtgtgccttaccgcagtgcttggtacagccatgtgttcctctggtacagattgaggatgtggcagatggtagagtccggtgtctcttccacggctgcagacgggatattgcacacagcaattccgagctcgctggcagccttgatgtccacgttatcgtagccactgcctatctgcacgatcactctcggggccttaaacttttctaggtcctccctggtgaggatgatggtgtggtacatcatggtacccatggcttcgttagaaccttctcgtggatttcctgcgtggactgcgcgtcacagaaggccacagtggccaggtctttcaggatgggcatctccacagtgcagtcgcggccgtccagcagcgccaccagggggcaggagtgcagggggccgttcatgatctgggggcggataccttcacaaattctgtccaattgctgtctcttgactttgtgcttatccacaagggccatactttatggaactttgcaactctcagatcaaaaggcaaagcagtcctctaagaacttaggggaactcgcaggagtctccgtgcatgacgccactatgaacccactataaatctgtacacactataaatctgtacactataaatctatagttcacacgatgggctgtccgtctttttaagggaatacagcttcattggttcaaaaccatttaaggtgatgaaaccctcgtcccggacggtcagcgtccacggcaaaaggcgcccactctggaggccgcggtggcggtggctcccgcccctcccaccccaccctgcggcggtggcggtggcggtggctgcagctgtgcagcctcccctcagcgcagcatggctcccttttcggtccctcgctcctccgggccgctcccgagccaccttaaaatgacgctcgcacacagggacacacaacacaaaaacttaatctctccagctccccaccactccccctccctccctccgctaccccgctctccccaccctacccctccagagaagtcttaatgaggaaaaaaaaaaaaaaagcacaaatcacatttccaaaatgactggagatcctgccaccactagggttatgaaaatgggcacaattttaggctctggctattcagccttgaagaagtctcagtatccaggcacctgagtttgctccatacccacctcctccagggctgcgacaaggattaaaagtcaagttagtgaaagcactgcatgctgcctcatatgcagtaggtgcttaataaatgtttactaaacctgaacacatacaaatcacaagggaaacagataggaataactgccctctgaaaagcagggcttttctacggtggcttaaagctgacatggcagcatggcagatccctggttctcagaagaaatctcggaaaaggaagagatgatccatggaagaaggaatttgaggccattctgatatagaggaaaccctcgatgaacatcagtacccactattctattattcctatttttatcctcagttaaacatagtgaattagccactgtgttttcctcctgaaattccacaaaataaagacaaagacagtaaaaagaaaagcaaaagatattaaatcacaaggggaaaaaactaactgtagacacatgagcagacaagagatttcatttttttttttttaagacagagttttgctcttgttacccaggctggagtgcaatggcatgatctcggctcactgcaacctctgcctcccgggttcaagcaattctcctgcctcagcctcctgagtagctgggattacaggcgtgcaccaccatgcctggctaattttgtatttttagcagagtcagggtttatccatggtggtcaggctggtcttgaactcctgacctcaggtgatccgcctgcctcagcttcccaaagtgttgggatcacaggcgtgaaccactgtgcctggcctcaaaatttttttaaaacataaaaaatacatgaagtagggtttcctggcagccacagcctacactcctatagaggggatattctagaaaagtgagccaacatatctgcaggaacctgaagccactcagaatttgaaagtaccaggggttgcagaaggcagaacaaagcatggcactgacaatggggtgactgggtcaaagtctgcacacaaaactgctggacctcagttctcccacatcttcccatctgtgcaagatccaaggagagactctggacttgaggacaccaggggaatatgtagacccagggctggaggtggagaagagcaagagtctgtagaagaaactgtgccactcccagcttggcagaaacaatgttcagagttggtatctccccttggtcagggaccaagctggctacaacttctccccacttagtagcctcagtggtcaacagaaagaatcagtcagagctcccatggagtcaaatcttaggcaataaagtacatcctacttataacgctgggagtaggaattgggactttaaactgtgttgaaaagggtgcttggagaaacacaagagtataaatatgaaaagctgtaaaaaatgtcatcagctcacacacaggttacaaattactcacaggttgttctccttggagccatagggttcagagcaacactagccttagacacaggcaagaggggcctttgaagtttgggccccacacttttaaagggtcccacacttttaaagggtcccactctgtcaactgttcccttctttataggacaagaagactcccaagtgaaggggatatatatacccagagcctacagaccccctcacttctagaccacgctccgagatgtcagactccagaacattctgcctagacagctctgaactcttatcttacttccaaggtctgtgtggcctctttccaggtctggcttcccaagaagaactagacaaccacctgtatactcttggatgttcggtgggggtgggagtgaaaaggctgctatttgttggaagatatgaacagagcttgagctcggaggttagggtgtccatgtagaagcacgcaaggcccctctctttatgggatggagccagcggtggggagaaaaggggtgtaggggcccacacttcctgaccagtcacattttggcacagaattccaagtcgtccatgagtcctcaattcgaacctggccatcctgttcattatgcaagtaactcatcatcagaggatgcaacgtacttggcttaacagtttgctggcctgatttatcacttctaaatatttagacacatgataggcatgccttcattcatactgtttccccaagccagacaaatgtttgtagtgggcctggttcagagcaggtgcctcacagagacaaggctagataggattgcttccttgcctggtcccagcttcaaaagttattctaatctgttgaggatcctcaaaggaaaaactattttaaaatatgcggtttaaaatgaaaattgtgcacagtattttaatgtacaattactccatgttaagctcctgtggtttctgtgctttaaattacctcatttaatgttcccaacaattccatgaagtggacagaatattttattttaattaatgagtaaagtgatgccctcagatcttaaggaacttgtataaagtcattgaaattgccttaaaataaaatcacttttttggtattgcttaaagaaaactggctaacttgtgatagaagaagcccctcaaagcagtcacacaatatgaatatgctaagtctttaataatagcaacagctctccttcatcagaggctaacatgcaccagccttcttcaggcctcacatccatcctgggaggaagacgttatataaattgcccaagaacatatggctagtaaacagcagagctcaagtctggatcacgtaagggccccactgcactctactacctttgctggtgaaaacaaacaaacacagtagaattcaaaagaagctaacagctgaatcaagcatacttggtcaaagagccactcaacacaaactaaatacctttccagctttctacaggagagaaacaggcaatgttcctgggaggctgcaagtatggctcataagaatgtctggaattatctaatctaagctttctaaagccatctattgttggctgttaaaattatagcatgttctgccgtctcttcacgttaccatctccttacttcccgtgcaatctgaagcagaggtgttattcctgtttatgaggtgaagacgccataactcagaaagccctaccctagaaataccagactcaggaccctagagcttcatagccaatagtctcatagcatcctgccatcttttatgatgtacataaaaaaatagaaatcacagggagaatggcctgttcaagtgacctttactagactgtgatatcactcctcacccccagacagatagcacacatgaggtagcacaggtcaatcttagcagacctggttccttacctgttaggataagacttaacgcctagaatttcatgattattacactagttactgcatgaaaaatgctcaagacagagcagaaagcatgaagggtaaggtattgttgttgacattttattagggaagtgaaactcttatccttaattcaaaataattaccaggtttcaggaacatggagcttcccactatgaatccctaatccaaacctagatcacaaaacccagaaacgggaaagcactggacagaggaatacagtaaaactgcgaagctggttacctgaattgttttctcttctgcctccagtggacttggaaataaagttcagcattaatgatgatgttgcatttaataaaacactggtttcatgactcctgggatactgtgtgggcaatacttcccctccaccctccagagataatgaaggcgaggaatccaatttgaactccctgggagaatggcaggaaggctaagctacatttggcactatattagaactttccctataaaacaaggacactggttatatcagtttcatgggggtacagttgtaaggtatcagcatagggcatttatagatttgaaatccatggttttccatacctatactataccagcagctttggtatagaagcccataggtcctatgggctagccaagcttcacatttctcaaatagctttggagacatattttagttgggtggagaattcattcagaggaggaagggaagtgtggaaaggcactgtcgttcgttacacttactatttccatcctgttatgggggcagtttcccctatgctccagggttccataggagcagacctagactgcaaagtgtggttacagacagaaagatccatgcctttccatgttgggaagcatcaactaattgtatccttaggaagtctgtctctataccagttatactgccctgccctgcttgagaaaagcaaagccaatcagtttttctgcaggcaagtggaaagtcagagaggagggcaagtaccttctataagccagaaatggtgggaggggggtgctagaaatcgctaggaaagaggtctagtgtccccaagaaatctagggcagctgcttaatgtaagaatggtccctggggtgggaatgtggggagaaggaaaagcaatgaaaaggccactagagccttaattgaggaagacatcagaatgcttgtcacctaagctctacaccttctatatttgaaacaggtatttcccagccaggatagtacaaagtgtataaattgggcaccaaatggatgtgattttgaattctccttttatgacttcccacctgaacaaccttgaataagtctcagtttccacctttgcagtatggaaacagtgggaactactccctaagtctgttaaccaataccagttccttctccatctagtcccagggtggctgggttatattgttgacctattaactggaataaaaggggaaaaaggagaggacaagatatattagaggaaatcaggaatgattttatggttgtcaaaagcttttaggttcctagagacactttgactttcctgggcctttgccctgggaaaaaaattaaagaggtttcaatgctcgtgtgcattcccacattacataggggagctgccagtcaccagagtttgtttgggtaacctcagaaagaggccacagagacaaatctcctcccagcctctggcagacatataatctggagttatttatgccagcattccttccccaataaaaaactctctgacctggcttgaatttttcttgacgctttcaattaaggaaataacaaaaccaaccctgtcttatacatggttaggtctggcaaaaatggactcagctaattacaaatttggccctggcggttttcttaagatgccctacaggcctgggtgtgagtggttataaaaatgaatgagtacaattattttgcaaaccagcctaacagtttagttcacattgcttctcgtctttcctcatcaaatcaagcatttgaattgcagagaattatcttccacatgtaagaaaacatatttctaagcattgcaaaactggttccttgctgtattctgatgcattatcatctggttgaagtcacatatctgtctatggaacatgacaaggacaagggagaacggtgctcacattaggttctcttcaaagtgacatgcagttagaaaacatccacttacccctattgtagccaaggctactagtacttaaatgctataccactgaaaaagtaagtggagacatcaatttttttaaataaatgaatctgaagtaccaccgaatatagaaaaaaaccatatctattgttcaccaggttggagagtagctctttcctcatctaactcaacacgttcaccctgaaggatttcatctgctcctgggatgcaagtcaccctctccagtccagatttccctcttgatatttgaatttgcatgctcacttttcaccagtctctcctctttcatggtttagaaatgcaaaccaccaaatttggtcaactctactaggtgtctttcagatttagcctcctctcctcactgatatgccgcttgttcaggccaccattatctccagcctccatgactaaaacacctgccctgttcctgtctaattttcacacttcctgctacagaaatgatttctaaaacactttcaatgcctttatattgtcttcagtgtgatattaagactccttaaatggcataattggctaaggtgttatgtagcagcctaggttctagttctatgaacgttcactaccccttctacctaggttggccacttcaaatacagcccctctcctctccagccttggaagatgagtaagagctcagctttggagacagacaggctgggaccacagcccaccttagctacttggtgcctatgcaatgttgggagtcactaaatgtctctatctgtaagatgaggataatggtaatggtaatgcccttctcctatcactgtgaggagtaaatgagataatgggtgccaagcactcagcacaggcctggcatatagtaagcactcagtcaatgctggctactatttcttttttttttttttttttttttgagatggagtttcgctcttcttgcccaggctggagtgcaatggcacgatctccgctcactgcaaccttcgcctcctgggttcaagcgattctcctgcctcagcctcctgagtaactgggattacatgcatgggccaccatgcctggctaatttttttgtatttttagtagagacggggtttctccatgttggtcaggctggtcttgaactcccaacctcaggtgatccacccgcctcggactcccaaagtgttgggattacaggtgtgagccaccgcgctcggccgctggctgctatttcaaggctagtactcaaggttatctacacctgctgtactcagggtccccataatcacaccaaattttatgaagagatgcctcctttgagagggtaaattacaaaaggcttctttatctgggctgcagacagtgcttggcatccccgctcgtgccagactcctactcatcttctggaattccccccagatttactcttgccttcttttactcacccaaactcaatatggcaccccccccttgctcccacagtaccttgttcacccagcaatatgacacttatgacacttattctccatgttgcttctcctgactacttatccccatctctctccctacccatctcctatttaggctgggttcctaaaagccagggactgactcagtcttgttcacagttatatcactcatgtctttgcacaatagatattcattgaatatttaccaaattaatgattatcatccttctttctccaaataactcttacaaacctaaatttcctgtcactctaccatcaaacaagtggtttgctctatattttggtgacattcatactttctttctccatcacctgcctttttacttctactccccccaaacccctgcacacacacccctgaaatccctgtgctagatggaccatccaactctatttttgtttccaccaaatatttttgagcacctactggtgtcctcgcacaagattggatgtaaagcctaaaaccataaaaaccctagaagacaacctaggcaataccattcaggacataggcatgggcaaagacttcatgactaaaacaccaaaagcaatggcaacaaaagccaaaattgacaaatgggatctaattaaactaaacagcttctgcacagcaaaagaaactatcatcagagtaaataggcaactacagaatgggagaaaatttttgcagtctatccatctggcaaagggctaatatccagaatctacaaggaatttaaatttacaagaaaaaaaaacaaaaaaccccatcaaaaagtgggtgaaggatatgaacagccacttcgcaaaagaagattctaatgcagccaacaaacgtgaaaaaaagctcatcatcactggtcatcagagaaatgcaaatcaaaaccacaatgagataccatctcatgccagttagaatggcgatcattgaaaagtcaggagacaacagatgctggagaggatgtggagaaataggaacacttttacactgttggtaagagtgtaaattagttcaaccattgtggaagacagtgtggcgattcctcaaggatctagaaccagaaataccatttgaactagtaatcccattactgggtatatacccaaaggattataaatcattctactataaagacacatgcacacgtatgtttattgtggcactattcacaatagcaaagacttggaaccaactcaaatgcccagcaatgatagactggataaagaaaatgtgccacatatacaccatggaatactatgcagccataacaaaggatgagttcatgtcctttgtagggacatggatgaagctggaaaccatcattctcagcaaactaacacaggaacagaaaaccaaacaccacatgttctcactcataagtgggagttgaacaatgagaacacatggacacagggaggggaacatcacacctgggcctgttgaggggtggggggatgggggagggatagtattaggagaaatacctaatgtagatgacgggttgatgggtacagcaaaccaccatggcacatgtatacctatgtaacaaacctgcacattctgcacatgtatcccagaacttaaagtataattaaaaaaaaaaaatactcagagaagttccaaatgctgtatataaataaatacaaatcttatatagaaataggatttggaactatatacatgtatataaacataaaaatgtatgtttatatatgtctataaagagtgaaacaattaaacttcttctataaaaaaaagagtagggataaaaaggcatataaggcaaagtcattgccctcaaattgtttacagtaaagtggtgaaggcaggtatataaataagtataattccatgtagtttgtactgcattagaagtatatatgaagtatacagtcagcacaaaaagatcaagagttctgagtagaaggtcaagaattgtagcacagaagacacaatcttctggctcaccctactgagaagaggtgatatttaccaatgaattgcagaataggagttcactaggcagcgagataggaaaaggcattacaggcagaggaagccccatgtataaaaagtcacataagcacaaaatagcagggaaagcaactaattcaatatggcagggaatgtgagagggactggagggaacagggaaggctagagaacaggaagggtctaatgacaaagggaagaagcttgccctgagtgctgcagcattttgcttagaggatgttaaagcaaaggaggagattctggcagctgtgcggaagacggactgggatggggggccaggtagacaaagagacatcctaaggaaactgaggcccactgctaacacagttctcagtgtgcttaagacgatttaaccttgtggaaaatactgccaggaggatattttctaaggaatttgtttaccaaagaatctgaacccaatgatgaaccaatctttcgctaacaaagctagagaactcagaaccatctaagttagcaagtgttaaaacactggaaagcaaatgtggcaacagcactttcctatttgaccataatcaacatcaatgtggaaagaaaacaaacctgaaagcaagtgaggaaaacacacagtgggtttctttgctttctctccaggacactgtcagtacacagagcatttagaatagctgatttgatcgttgtgaaaatctacctgcgtgcccctctctctctctctctctctctgaatgcaattagagaagacagcttcattcacactgtgtctaaaaatagatgatggcagagttcacagactgacagctgcattgtcatacagtaaccaggaaaggaaagggatggctaatttaacttaacaacttccaaaacaaacagtgcagagggagtccaggataaagaaaaaacacacaggtcagttcttcaaagagctggcagagggatggggtcgctccatggcagtttattagtcctcccaaaatcctgacgaaaccagctaagtattttgcccagatctacccagagtccttcagacaagagctctggcagatgaaccgctacagagattcaggcaatattaggcagcagggccaggactttccctgctgacttcttcatacatcccctggacacaagtaagctaagaagagtcatgacgtttttctaggcaagataaataaatgagttttttccccctttgccatatctaaattatactctgcctagcctggggcatttaaaaaaaagttatccaggaaataaacatgcatcattaaggggcagaaaccaggtgtctaaaagaagcaaaccatttctttccctcccttcagtcctaaaatgttttctgttttcctcctcagtctgccttgcccagggaagggattacggttgggcttcaaaagaaacaagggaataatgcctgtggacgggtagcagattctctctgcagctctcccgcagctccatgttggctctcagcgctgctgccagccagctaaatgtcagatcacggcaccccaacattccctcactgcatacctccatcgccctggtgactaagctgtttcaacagctgtgttattgctggagtcaggccagtgttattcacacgaagtatttgtttcatacggcttatgtggggaattattgcactcagctttggggttctatttaaagataaggtccttcccttgatcaatcagccaggacattcctcgagttgggctccaggagacagtgggacaatattctactgccacccggggttccagataatggacagattcataatactataaagaaggtggatgaagcatatgtgtgtgtgagagaatgggaagcataatggaaaaccatgacccttggtggagctgcggaagaactctgctgctcctccctcaataaaagccacccacaacacaagagtgttaagctggactccctttctgctcttcttctccagccatcaccctcagcctttcccttaaaatcattgctctttcctttcgggtcacgctagcactgttgcgttggtctctacatgcatcactccacacacctgccccgaatgccatctcctccctcagcccttggcttctcctatctcatcaaatggtttatgaccattgatgttcctatcatgtaggaagcaagttgggcctgttggcctggtgacctcctccactactccacatcctcttctgagtgtgagtaagataagggctgtgttactaactgctgagttaatcaacccaaactcccttatatggagggacaactgggaaaaggaaaaggcattacatccatgagctttatgtcctgtaggtgggactaatttctatttctagctcattctaggctgaatctccatcaaagaggcctactggcctgttctccctccaaagttgttctcaccaagagcaatcgggcaccattttctgatgctgaaaagatctcagaaatatgttttcttataaatgaagtatttttaaaagaaataaaacaatgattcctaagagctcacattttttactgcctactatgtgtagacattttcacccatgcagatgccagccagatggaaaccatcacaggcaatttcaaagtgaggaaactgaggcccatggccatgctaccaatgtgagagggaggcaaaatgagaacccaggtttgcctgactcagcagctcaagtactttccccttatgtctctcagtcatggggtaggaaagttaggacacccgcttcttgctctaaaaaggccactatttagccaaacaatttgagtaagtcactttacataatgtattatttcatgaaatactacagttggatcataggcttactaagatcctttctagttctaatatttcatgaatgtagaaatctaaaacacctccagctgttgactgccttctatacttaaggcactgaggccaaaacaaagagctataaaaccatgcctgtcctcagggcacttataatggagtttgagtgacaaaggataacaagttgagtttgactaatggaagagttaaacaattaacaaatacaaaaataccagagaaccagactacagggcagtgcttgagaaataacaccgcataccagcatgactatacaaggagaaaagtagatttcaacaatggtaacacccctaacccggaaaatacatttgtgctgccagcagaaagaaaagaagagacagaaaacgcttgcaggaaaagccagctactagaagggatcccgtctgtttcacaggaaagctttgtttctgacaagtttcgtaaaggaaaaagtaggctagaacaagcttttttatttccaacccaccttttcttcgttcccatgaatgaggaggggatacaaatgagagcaggcagccagggacaaaaataatatggctggtggttcctgacctcttggattcctgccaacagagaagcctgagaggcaacatttaattgtggaaaaaccagcctggctctcctcttatctttttcctctgtgacttaaacccacaattactggcaacccctagattccgagtcacccagctggtggtggcagcaatggctgtgtctgtagctgaaaagcaaaagggagtcagattttacctgcctccgaagccagccctgggagcacagccctaacccagcttgatgacttctcccattaaaaggttcacagatgccctcccgttgggaaaaccaccaagtgagaagtccagatgggaaaaaaagaaacacgattttcagctgctgtataattcaaaggacaagctacgagtctcaaatcctgaattccacattttatttcagcactagagatgtgatgttcaattccttttcttaagaaacaaactccaaatttcttagctggtcatcaaggcaactcacctaccaggccctctgtctttcagcagctcatcttttttctctaatatggacacttttctacagcccaacaaatgggcttaccgtcctttgcacatatgttatttcagagcatttcatgatagaaaaatatggtcttagtcctcactttctcacctagaaatcactttgaagaagtcacttaacttccataatttcatacttgtttaaatttaaaactttttctccagtaacagcctcacagaggacagtagagatttaaccttgaacatctagcattgagcctgcagaggagatgcataatcaacgtttccttctctatacctaatgcctttgctgagttaccttcatccaaaagaatgttcccattgctaactcttgtcctgatcttttcttaccactcttccactccaagaggttgtctcccatacacctctgctcccatcttaatattcttccatttcaaaatattttaatttacatgctgctatgtttatagtcaaatataattaaatcatgcctgtgggcacattctcctaaggatgctaagaattttccacatcttctattttaggactttatccaattgcttcagtgctgatcagcatgcattttggtactcatggggcataccctcatcgggattcataaacctctgaattccatgggtgagcttcagggcttccattgaaatatgaatactaaatgtgcaaatggggtctatgcatatttgtctcccaaggttaaagtccttgacctgaagttaataaccactgtccggaagtaatgaaaggcctgtggctaacatccatggacggggtcctttttctgaacactcagccctgccacctatgtttctgggcttctatgctctctctggaacacaattcctcctttctattcaagtccgagaataataactactcactcttatttatttatttagagacagaatctcaaccaggcaggagggcagtggcgcaaccttctgggcccaagcagtcctcctacctcagcctcccaagcagctgggactacaggggcacaccaccacatcctgataatttttgtattttttgtagagacagggtttcaccatgttgctcaggctggtctcgaactcctgggatcaagagatctgccctcctgggcctcccaaagtgctgggattacaggtgtgagccactgcgcccagccaactattcacttatattgagcatttactatatgtatccagcacttactatgtaaaagcctcacatacactattctagtttaatccttacaacaaccctataaaggtagtactactattctattttataagtgaggaaaatgaagtacaaggaagtttcaaaaacttccttgccaagggtctcataatttataagcagcaggccaaacattcataatttatgattcagcccaaacactctggcttgaaagtacttaacccagtgctggagttgtctctccaagctctttcactttccagaaaaaaataagactgcccttggactgtttctttgccttcacattgtaagtgatcacagattccaacgcctttaaaactccacctttgactcaatcaaaacatttccttttccgtgagttaatcatttccccttctatgtttatggactcctttgggtacttaatgcactgaacacactggtgtaattttttaattctctctccatgaattagactgtgagctcctaattattttgagtacacatggaatatttactgtgcctggaattgtgctaaggatataacaatgaacaacacagtgtccctgcctttaaataattcactcttaggccaggagtggtggcttacgcctgtaatcccagcactttgggactttgggaagccgaggtgggcagatcacaaggtcaggagtttgagaccagcctgactaacattgtgaaaccccgtctatactaaaaatacaaaattagctgggcatggtggcacacgcctgtaatcccagctactcaggaggctgagacgggagaatcacttgaacccaggagggggaggttgcggtgagccaagatcacgccactgcactccagcctaagcaacagatcgagactacatttcaaaaaaaaaaaaaagaaaagaaaagagaaaactaaacaaaagagggttatgatggtttctgaaattgtattatgaagaataaggacttatctttatttcttaaatcctgagcaaaatgctagcatgtagtacaagtcccaataatgcctatcgaatgaatgaatgaaattgggaaagggttttcagatactgaactgctaaactgaaagatctaccatcccatcatgaaactctttgaggttatttatacactgactcacctaaaaactgcttcctgtgttggtgtctatgatacattttttaatgtcagactaaaaatacacttccagtacaccaaccctgtctgcctacctaaggagtagaaatgaacacaaggtcgcatgtaacaaaagaaaagaaaattcactcatttcaacactaagctcaccctctaacaagagcatctgtcttgactgagcactatcttctagaatggttttcacttgagggtctctgaagtcatctatttacaaaaccaaaggataccaatgagattttttataaagtcagagaatcttaagtgagtcatggactctcaacttcagagagttagagtagatgggaccttaggggtcgtctagtataatttcccactcagaacaggaagcactccatagccctgtcaatagactcatggtgggatcaaggcactggagtcctaacatcatgtacactcatagcctctcgacttcccagctgggagactggcaaatcatgtaaactctgtcatcctcagtgtcctcactctgccagatataattgttccgatgatcagatgaaataaacgttgtcttaattagcgaacatttgtttgcaagtaacaggacttcacccccactaacttaaccagaaatcagctggagggatacaggagtgctttaggaaaatcaagggcagaaaatgctgagaagctggagggtctgaaaccaggaatagaaagctgtcaggaggaaagtcaactcttatagtctattgtaattacactaatagtcttcatctccatttcctctttgcatctggtcttcccactctgccagtcaacaatcacggcttctctgtgcacgtgtagaatgatgactgcccaggtggctctcatggcttttcagtttaagtgctaataaaggtagatctcgaattactgaaacacaatttcttataagagagaatttgattgcttcccctttggccaagggaccactgctagtctgatcagttatggcttggggactgatcatatggccagttgcccattcagtagaggtggtggaacatgctgagggagggggaagttaaggccaagttcaggccaagcaaatgactgacaacaaagacaagcaacagcatctctagtgcgatggtactttgcaaagaaagcactgccccatgccagctatcactgtggccatccttatgatcctcaccaaccatcttctgcttgaccactaccagtaacaggctgctcactactggtagaggcaaccttttcatcagcaaacaacttcagctattagaactcttttccatgtgacagcaacttaagatactaaactgaaatatttgtaatcttctcccaagccttaactttaatgaaggcataatcttgcttgttaggtcaagcctgggcttttctttctagtcaaaatatgaataatgggcaaagcaagatgttgaggaaaagctgagtgttgggagggaaactgaggcagggcttgcataatgtctttgggaatgtgtctagacttgctggttccttacttctagccctcataggctcctaggctcctattcccattatctcaagtagcagaacatgttccatataaatgctaaaccatcacagctgtagatcatgtgcctgctcttttgacctccacattttcaccacctgtttctttgttggattaccaataaatagcatgggctcccagagctcagggccttcacagcctctgtacactagtgatggccccctggtgtcccaactttctctctcaaactgtctttttctcaatcctttgactctgctggactttgtcacccccacaacctggtgttgggtctgatcaccccaacacaagagagatagattcactatgcaattattttagcaaacaacctggaccagaacaaagccagaacctcttcttcctataaagaattactactatctctctactaacaccattactaatgactcactaaagcaaaagaggatctggaactgtttctagcatcagtgtgtagacaataggtagggttggggaaaatggttttttccaatgtagagtccctagcacttttgcaagcagaattctgccttgctctcatttaacttccttttgcttagaaaaatataatccagaaaataatcttaacttcatttttttaagttaaccaagataaagttgtgaattccccataaaagaacctcataatagctatgttatgaccagctggcatttaaatactgaaagacccaaagttagaagaggaggtgaaaacaaaaaaataccttctatacattgggggcaccattaagggatgtgctgcttctggcttctctgctcttcacattagtcaatgatgtcaccaggtttttattttagtaatcaggatatacttgtatggatgcaaagagaatatcctcatttatattctaaactcagagcaggaaatgagacacgtgggtgatctgcagctgtggcactataaacagggccagcctaccacctagtctagattctagactgcacttcattccctgaaatactgattgggagattttaaaaaattgaaaatatatcattttagaaagaccagtgcatcttctgtgcaaggatcttagagtccgctgtttggtagaaggctgactcacctgtatggggtggtgcacgtgttgttaggtaccatctacctatctacaccactgatgtacaacgaggagatcctgccctggctccagccagctgtgccaccgtgggcgagtaccacagagttcaagctttctccagctgctaaattaaaggattagtgctttaacttgggtcaaccacccatttgcaaacctgacaagaaccacaaacactcttacttcaaaaatgcatataagcaaataccactgaaattttatgtagagtatcaaggggttctcttagcccttacactccagtctaaactgcttggttgatgattgttagaccagcagccctctagtattcctttcagcactccaagctaaaataaaacagctgatgtttagtaacaatttctgcaaattattcaacaccatagaagagtgttttgttaagactagagactaatctaacacaatctactcaacaatgttaaattgaccagtaaccaatagatgactagaagaaagtgtatgtaactagatataccaaactatagatactaattttaaaatcttggaaaggttttggaggagccctactgtttctgaattggaatttttcatttgcaaatacttaacaaaacccaccaagccagatagagctctatagcgatgcctatggaggagccttataatgatgttgtccaagtaatgtgcttaacaataatcacactcaaagccaaaggttcccatgctcctgccaatataacatgctcacaacggtcaattccaaaggaagagctgtcaagaagtgcctgaagatttcctcaaagggagagataattcatgagcaaacaaacatcatgtccctaatcttctctatcctggggtaaacaaaatatagttttctcccatgatttcagttgctttctataccaagtcagtaagtaaaactgattcatactggtaacttccaggttccagccttggtttgaaggggcacacaattcaataagagtaaagaagactggccatgtaagcccatcttgaatactgacaacttccgtaccatttacctaacactacaaaccctactccatttaagtctctgagatctttttgatgtattttgagcttttcaacttgccttttttggtgggagaggagggaggaggagaacaaagggagaatttgaagtttttatttctgcttgcattgactcaaattgtggtaaagaaacttaaaaggtaactttaaaattctagtgacactagccaacaatgaaaactatctaattagaatgttagaggttttttttgtttgagacagagttgctctgttgcccaggctggagtgcagtggtgcgatctcggcttgctgcaacctccacctcccaggttcaagtgattctcctgcctcagcctcccaagtagctgggattacaggcacacgccaccatgctgggctaatttttgtatagacagggtttcaccatattggtcaggctggtcttgaactcctgacctcaggtgatccacccacctcagcctcccaatgtgctgggattacaggtgtgaaccactgtgcccagccaaaatgttagatagttttaacacaggctataacatagtcataaattaaagaagacatggtcgtaaatgaaagaagacctctttttggtgggagtagtagtaggggtgggagagtagagttatacatttcttcttagcagttgcttcaacatattttattaataaggactatctgctgaagcacagaaatacaattatgtgaatatcatactaccaatggcctgttccatcatagcagggatagttcttatagtgtataaaatcctctgccccattcagctctctttatggagctttcctcagaagcatcagaaaacacagaattaaatatcacaattcttgttgaaggccaaaaattagttcccagaaggattctttgactttcatccttctacaaattcacccatcaccattgtagataatgtgaggggtgaatttgtagaaggatgaaattcagagaattgtttatgatcaatagattgttccctttattccagttgtcttcccttgatgtccacttaacattccataataaatggacaaatggaaaagcacaattactctgccaaaagtcagtcaacattctcccaggacactcagccatctaacttgaaaactgactggtaataatatcattctaattactttaactagaaatttgttatacagaaatgctttcagtgtggggaaagaaaaatcacttgccacttatagaaagaattctgcttcatgtgaccatttgcaataatgaaacaagtaagacaacactgggttccagtgtacagcacaaggatcaaggcgaaacataatgctttcattacgtaagaataggactgacattattctggctttcccctacccttcatcatttaccaatattttttcagtctcaggaatttttcaacccctgaaactcctagatttactactcaagacacagctatccatcttgaggctttctgccaatggctctagtgcttctatttcaacagcttatagatttgaaagctggaaagagagatatgtaaacaaattctctaactttgatctatgcacccaggtttctcaaaagaagcccttggagagtctggggtatactaagtgtatgacttgcagttgtaatcattagagtgacaacccatttccagtgggtaccgttttagccaacccaaacctttcttttcctaatgcatagagtgactttttaaaaaatggtatatttgggaaagtattttagaatggcatgttaacaaaacaaaaacactctagaatatattttcaaataacagaacttggccttaccaagaggtctaataccatcaggtaaataatcatttttatcagtgattcataatacatccagactctaaatgttaaggctgacttttttctgacactcttctctgcctattcatactccatttcctaactcctttagagtaaaaattgaaatcccatatccctaacaactagacagaagcatcatgtttacatcctgacaaattcattaattctgtacctctgaaatatttagcaaaaagccagcactgactcaatcatagatttccacagacaggtctgttcatatttgtaattggtattcactgaaaggtcaatgactcctgttcccaagtatctatgagtctctagattttcttaattggcctcttttcctcagctcttacagactattgttttaaaactaccaccatttagaagttgaactccgagtgaggggaaaaacaaacaaacaagcaaacaaaaaaaacactttttgattcccactccactcataatcaacataacacagactacttctgacccaggtgtgatggaaggagcggggcacagagtcgggggaggtttctccacacaccaagcaagcaatcaatcacttccacagcagacatcagctgggtgtccaaaaattcaattttgacaccacttacctggaaatagcatcaagtctcataggttgaaagctcagtcccataagactgctccccacttcagatgcccatcgaaaaaacaggttgtggcctgttataaatacgcgttcccatgaccctcctccttaggattgattgatttgctacagaggctcacagaactcagggaaacacttaacttatgcacgttataaaggatatgacaaaggatacacatgaacaaccagataaaagattgatagggtaaggcatgtggtatggcagggatccctgaccctctggcagcagacaggtaccagtcagtggcctgttaggaactgagccatatagtagggggtaagaggtgggtgagcaagtattatagcctgagttctgcctcctgtcagatcagctggcattatattctcataggagtgggaaccctattgtgaagtattcatgcaagggatctaggctgcatgctccttatgagaatctaatgcctgatgatctgaagcggaaccatttcatacccaaaccatcccccatcccctcatctgtggaaaaagtgtcttccatgaaaccggtccctggtgcccaaaaagttgaggatggctatgataaggcacagagcatccctgtcctctctagggtgccatgctccgggaacctctgcaagttcagctgtctggaagctcccagaacccagtccttttgagtttttatggaggcttcattacctaggcatgactgattacattattggccataagcgagtgactcaatctttaggcctcttccctcctggctgttggtgggtggggctgaaattagttccccacccttctaatcatgccttggtctttcaggtgaccattctgaagctatctgggagtccccagccatcagttgactcattagcatgcaaagaggcattcctatcactcaggagattccaagaattttagaagctgtgtatcaggaaatttattactataaagtaccttataatgccatcatttttctcccaaaggcactggcttgattaaattcagaaattaaaacaatggccagcttctatagtgtaagtcaatgcttttctagttttctgagggtttggaaactcaaatcctagctaaaacctgtatcacttttaaattgaaaaatttaaagggaataaacatttaaccccaagtgactagaagtcatttaaaatatgtagtacttagattattttatctactcaaagactcttcaaaagtagatgaaaacactaaccagatatatattataaacccaagctttaatttcagagcccaaacatgaaatctcttctcattgtttgaaatctgaaactcatttcaaagactgccacgaaaagttaaaaaaaaaaaaatggattggtcttgacttttccttacatatgaagtaatattgttacaggtgaatctctgataagcaggaagccatcatgtgtaataggatcttgtttgccacactcccaaactcttctctgaagtcctgttcattgctgtcagaaaggaatccaaagtaatgataaacaatataaaaagtagagagtctcatgcattcttaataccaaaatcagagagaaatctagacctgatgtgcctgttatactaaaacatgtgtgtatatgtatattgctgaatatatataacataatatatataatctgtataatcaatgccttgctcagtgtccataagcaaaggtagagaggataaatttaaggaaatgaatattcccacaaacacaacatgtaacttctcatataatagttagcagctggccaggcatggtagctcacgcctgtaatccccgcattttgggaggccgaggcgggcggatcacaaggtcaggagatcgagaccatcctggctaacacggtgaaacctcatctctactaaaaatacaaaaaaattagccgggcgtggtggcaggcgcctgtagtcccagctgctaggggaggctgaggcaggagaatggcatgaacccgggatcgtgccactgcactccagcctgggggacagagcaagactccatctccaaaaaaaaaaaaaaaaaaaaaattagcagccaaaatgtgttgctgctactcatgaaaagtattttttggtgtggttttcttgatagctctattaagaaagttattttatacatttatcaaatgaataattagtggtccatcttgttaactttttagtatgccccctattaagtgctagttctcatgttataagaaaattaaggattatttttaagtcagaaagcttgagtacagtatttttgtagatgaagataaaatattttaaagcatgaagatgtacatgagaaaaaaataagacattaatatttatatatagaaatgttttaaagctttgccaacatgggcatttttgttgtttaggattagtatttgctgggaagtaattcatctgtgaaattatttaacatgtagaattatttcttagtttctggtttgggagaaatgctcaagagttgagcttaaaatcattttattcacactgctaaagctgaaaaatgtaaacagggagctttcaatacatttcaaatgagtttggagaattctaaaatattcaatccatttataatgaatacaaaacatcattagaaactggcaaaaaaaaaagtagctaaaagtattcgagttatttcacattactgggaaagtttcttttaaaaagttcagttataaataacattcactaaacatatttatccttttttcaattttggtggtataattttagaaatttatcgttgacttttaaaatttcacctaaacttacctgaggctctgcattatgttactcaatgattctgatgccaagttttgaaatcaaattataggccagtcaccttcagtgatgtaaaaggtagaaccacaagataatccagcactttcctcacaacctgaaaacggaacctgtggcaagtacctgcccaagtgtcagactatgctctaaacaactgcctgtcatgtaacaggctgctcgaaagcagcaacatactactcctatagtcaattcttaacttcttaaccacaatttcatcagtgtaaaaaatataggagcagtggggaccagacttacatatactgaaatgttaaacaacagaactcttattttgaagtgtgggaggggaggaagcacctcaatcagttgctttatgttccttttagtggcagaagaatgatacaatccagtattttcatccacagctccctaaacacaaagctgtggatttcataaatgtaaatatactgcgtaatctgcccactgggagttcatagtttagtaaggactcagagaagacaatttcactgtgcagaacacaaggctgataaagtaaacatcacaaggccagtaatgaagaatgcgtaaggaaagacagattatatccaggaaggaatgaggacgggagataatatagaaaatacctaggaaggctccaggggaatgtaaaatttgggatgttgtgaagaatgagtaggtttatctgggaggagcccttcatttgtgagaagaggaatcacaagagaggaagaggcaggcaggatcaatatcagcgaagacgcaaagggagaaactctctggatgtgtttacagggcaggaaactactccttttgaggatgcagagaatggttactggccagcagtgaggaaggaggctagaaagaagccttgagccaggaagcgagaggactctgaacaccgagtcttatttgttagtcactgaagatgttttgagcaaggaaatgataaattaaagctaaaagagtctcctccttatcagaggtttcaccttcagtggtttcagttagcagaggtcaatcacagtgtaaaaatattagatgaaaaattccagaaataattcttaagttataaattgtgcactgttctgagtagcatcatgaaatcttgtgctgtcccctgataagaatcacccctctgtccagcatctccctgctcctgcctgttagtcacttagcagccatctaggttactagatcaactgctatgtattacagtacttgtgtgcaagtcatccttattttctctcattgccccaaggtgcaagagtagggatgctggcatttcagatgtgctaaagagataagtcaagtgcttcctttaagaagatgaaagttctcaacttaaaagaaaaaaaaatcttatgctgaggttgctaagatctacaataagaatgaatcttctgtccttaaaattgtgaacagtatattttttctttcattattaattattgttgttatcttttactgcacctaatttataatttaaactttattctaagtatgtatatatgtataggaagacacatcatgtatgtatatagggttcagtaccgtgattttaggcactgggtggtcttagaacatatcccctgtggataaggaagacttacctctaccacgtgcttcttttataaagactaatctcactaaccaaggtgtagaagtaagaattggaaaaatggctgaatttcagcaataaggataaatataattggataattgtaatagctacttttaatttttaactgttttaatagtacttactatgtccaggctgggtgcagtggctcacacctgtaatcccagcactttgggaggccgaggtgggtggatcacctaaggtcaggagttcgagaccagtctggccaacatggcgaaaccccgtctctactaaaaatacaaaaatttagtcccagctactcaggaggctgaggcaggagaatctcttgaacccaggaggcagagattgccgtgaaccaagatcatgccaccgtactccagcctgggtgacagagcgagactccgtctcaaaaaaaataaataaaaaataagtacttactatgtcctaaaagttttacataaactaatttattccttagagtgagttggttaattaggcattattatccatattttacaagggaggaaactggctaagagcggttctgtaacttccccaatactgcagagcttttaaaaagtggcacaaggatttaaacccattgctgtaggactcctaagtccatgctcttaaaaaactttctatcttaccccctaatctagatataaatcagggatcacatttcaaatgaaactgtgactccattgaaaagtatgccagcaggtagtcagcctctaagatggtccttaatgatccccatctcctggcattcatgctcttctgtaatcacctcccttgagtgtgggttgaacttactagttcacttctaaccaacagaatacagcagaagtgatggaatgtcgtttgcaagattcagcggtttccctctccagcactgctcaggctctctcttggctcactatccctgggggaagcccgctgccatgttgcgaggcagtcttatggagagacccatgtgggagggatggaagcctgccaacaaccatgtgagagagcttggaagcagatcccccttccccggtggagccctcatgcctgatgagactgcagaccaggccaacagcttaattgcaaccttgagagagtttgagccagagactcccaaactagattcttgacccacagaaatgaggagctaagaaatgtttataggtggccaggcacggtggctcacgcctgtaatcccagcactttgggaggccgaagtgagtggatcacctgaggtcgggagttctagaccatcctggccaacatggagaaaccccgtctctactaaaaatacaaaaattagccaggcgtggtggcacatgcctataatcccagctactcgggaggctgaggcaggagaatctcttgatcacgggaggtggaggttgtggtgagccaagatcgtaccattgcactccagcctgggcaacaagggtgaaactcagactcaaaaaaaaaaaaaaaaaatgtttatagttgaaagctcctaacttttagggtaatttgttacccagcattattaatacagtcagtagacagtaattatttattattacagggtaaatctttttctttatacttggagctagaagtagggatctgtctaggagagattatacctgaaataaccacaaccagcccaaataacagaataccacgtcctttacctttccacccaaacatacataaatcaggtaatctacctatctcatcctcccatggctcttcttgttgtccttattctcctttgcttgaatgcattcttaggaatagaaatgctaaaacccaaacctgcaggtttcaaaaaaaaatttttagacatacagttttgaatctcatagcaaactctttccttcccaaggctcctcacattacattgtgtattcttattatagcacataacatgttttttcttatttgtaggtttaagtgtctgttttccaggcaccctcttccctaacccgttacaagaatcatgtctcgtgtgatcttatatccccagtactgagtgttcgtatggctgggacttaataaagtttaaatgaactcatgaataaatgtgttgcacaaccaatgagtgagtgagtgaacaagtgagtcaataagcaagagtttagggacatgggaaccaccacttaaaagcttgaggctgttgtgcaaatttggaccttcatataagccatttccttctatatagaatgctctttcttttgctcatcctcacctcctcaccaggcttttctctctttaacattcacctcaaagagctgtctgattgcctctctacaactctccccgccaacacacacccacacaccctaccagggaagtcttccttttctctgctgtgaagccttttctttaagtttccatatcctcctgggcataacttggtcacagcacccagcataccacactgtaatgattagttatttgcctgtcatttccacttagccgtaagttccttaaaggacagcatattcagctaacagcagaatgcctagcagtggtaggcactcaaaaacagtttaaaataatgggcaagagaatgaatgaatgagaaaaagaaaactgtatctagaaaattatctcagcacaatctatttatttcaggtaagctatcagtcaggtatacatagtgctccaactcctaaacagagtaaaaataattgtacatcaagattattacagatacatgaaaatcatatttagaaatagtacttcagatcaggcatggtggctcacagctgtaaaccaaaaatttggggaggctaaagtgggaagattgcttgagctcaggagagacccccataaaattttaaaatttaaggccaggtgcagtggctcatgccagctactcaagaggctgaggtgggaagatcgcttgagcctgggaggttgaggctgcagtgagctgtgatgacaccactgcactccagcccaggcaaaagagaaagaacctgtcacacacacaaaaaaaaaagaataaaaaattacaaaattagcgtgcctgtagtcctagctattcatgaggctgaggtgggaggatagcttgaacccaggagttcgaggatgcagtgagctatgattatgctactgaactccagcctgggccagcattcgagatcagcctggggaacataggagactctgtctcttaaaaaaaaaaaaaaaaaaacagaagaagaaagaaatagttttcaggccaggcacagtggctcacacctgtaatcccagcactttgggaggccaaggtgggtggatcacctgagatcaggagttcaagagcagcctggccaacatggtaaaaccccatctccactaaaaatacaaaaaaaaaaaaaaaaaattttgctgggcgtggtggtgggtgcctgtaatcccagctacgtgggaggctgaggcaggagaatcacttgaacgcgggaggcggagattgcagtaagccgagattgagccactgcactccagcctgggcaacaagagcgaaactctgtttcaaaaaaaaaagaaaagaaaagaaaagaaaaagaaataatgtttcaatctatggacaggccctagacagagctgcctttaacacatctttttccctttccctcacatccttgatcccatctcagtcaaaaaggaaaaaacaaaaagttttcttacttctcagcctaagattcctgatactgtccccagatgccatacatgtattggcctcccagaaatcacccagtgattttctccccatgaaaagtttatatgtctcatgccctcagagtttttaactgcaaataagctaaaaaaaaaaaaaaaaaaaaaaaaaaaaaaaaaaaaaaaaaaaacgaaaaaaaaacctggtttggtggggaaatgggtgctcatgggttggcatttccattttggtaggcatctttttctaaggccatagctttactcaaagcccagtggaaaaagacatttaaaaaaaaataaaaacctttcaggaaccctcaagtcactccattggggtgaactcccctgtgacactagagaggtggtgaagcttggtggttagggcagttttctgagtcagaaatctcagcttttccactctctagtcttcagatcatgagtaacctcactggtgcccaagtgttccatctgtaaaatgaaataataagactacctcaaggaacctggtgggaagattaaatgggttaatacaggtaaagtacacagaaagtgcctgggaagtagtcaataattgtttgctattactattaccatttttacttttattagaattggctcaaaaagaacccaaagagggcaatgctcaaagggaagaaagggatgagaggagagtacacttaactgatttggttgtttagcttgaaggcaatgtccagctgcaggataaacagcatgaattggaaccaaggactcatctccatgtgggggaggggaatgtgaacagaaaacacgatgtcattggcttcaatttcccttggaattgcctcttcaatgtctcggatcttgtcacaatgattgggtccccaaggcacgaaccattttgtcttgtgatggttcttacgggcatccacacatttcaccgacatgtaggacactgccgttgtgggccctggagctgaaaagagaaagtttgtctgttttagaaaagccatctattgaaactactgtttctggttaatattctttccactgctgtgttccctccagcttttgtatcgccttctacaagtggggctcagcaatacttagggatcttccaaatctgggtgaggatctttcactgacctccagaggtgtcataacagtatctctgagaaccttcccattatgttttcaattgctgtgaaagaatacatttgtaaccagtctagttatacttccccacttcaaaacaatgtcacaaaaaatcaactgtgctacagttcccacctgattgaggtcttggagagctctggtgcttcatagagaacagtatctaaagtcagaagaccttagtcttcaaacctggattcgaagcctggttaaaaacctactgtcagtgaatcttgggtaagtcagttaaatctgtaatagcttcaggaccctcatctgagaaacggaagagtttctaagattccttttggctctaaaattgtacaacattgcttttgcttaagataaagaactaggggacaccagttagcttggtacctagcagagaatgggaactcaaacactgactgatacttcaaaagtgtactaaaatataaacgatgcacttcaagacagcaaagcaactttgaaatgtgtaactttaaaaacactattttgtgattatataatggttatatgattataatattaataacttggaaaatacagaaattttaagttcaaaacaacatttacccaaaatcccactagagggaagtaaccactgttggaaaatgtcaaaatgccatctgtcttttctatgactgtgtaattagataaaaagtttacacatgaattaaattgtgtaactttaaaatatacgcaaatattaacacatatttataaaatagttatatcatgcatagttttgtagtcttttctttttattcacttagaaaagcagagtattgtgtgataacaccagctctggaggcgacctgtctggtgtcaaatcctggctctctcatttttagttgtgtcaccacaaatccacactaggaaagttttgggcaaattactaagcctatctctgtatcggttttatcatctcttagatggcaataataatagtactgatctttccaagtcactgcatattttaaacaagttaacatatgaaagcactcagagtagtgcttgggcacacacaaagtataaaatattagccattatatcatattttctttataattaaaatctttcagttagtagttgcaaaatagtcaatcacacaatacaccaaaatcaacttctccttcatcagtttgtaaaggctatctataagaataatcctttgcctaatatgttttgttggaaatttctcctaaactttccatctgctatctaaatttgtttatgcacatttaaatagagaagttccagatcttatatggaatccctcttttatgtttttccccccatgcttttgtgtttagagaaactgaccttcttcatctcaaaattcaatagtcatctatattgacttctatttattttttgcaatttcattttttctaatatttaaacagttgatccatctgaaaattgctataagagatgcagtgaggttctagttttatttcttaaatatttaaattatagttgattgaacagaccctcccttttgttgatttatcatatcactgttaatctttatgtatgtaagcatgtttctgaacatctgttcttttccatgcattaaactgtcaattcacgggtcagcacaacattgctttgaattttataaatttattatttttatcaatatctgctagagtaactctcttccccaatccatttcaaatttacatctttttgctaggatattgaagattaaattaaatttataaataataaatatataataataaattaatgtggacagaattagcatccttccccagcgtttagttttcccatccaagaacagtacttgtttctccattgtctacaatctgtttttaaatttcttggaaaactttcattgttttctttatgtgggtcctactagtatattttaaaatagatacatctataaacctttgaaagttagtagttaaaagaaagtgtcatcaattatggtttatgtgtgtggtttaaatatgtgtatttctgtgcatctgatacttggtatattatgtttgcagaaattctctcttatttaatagagatcagatagcaatggagaaacatgaaaagcaaaaagaaagttatataacgggaaaaatgtgtattattaatattctgccctacttctaatgttcgaatccacattatttttctattctattaaacatctattttaatgatacatttttagtaaaatgttatgtttgtaagaagttaggacaatgcctattaatacttaccagaaaactcaacactactaagctctagctgaacatccttcatgtagaaggctgaacactgcaatacaagttgccactaacccctgctacagacgtttttctttaaaactcaaaactgtatcacgaagacctcacatctaatccatctaaaatcagacatctgacttattcttagaaatatgagtcaatcaaactttggttatcctgactcagctaaatagcccactgacattagaaaagccaaatggcacatttaactgaaccctttttaatgtggttggagaaataaacagtgagacaaaagtcatgaattctattttcggctaacatactcaaactgactatttgctgcagaaaatagttactacattttaaaacttctattcttccaaaatgaacctaacctttttttctttattttttaccttcttgaaaaacaagtctctcacttctcaggccaaaacgaaaaataactagctgagttcctcagctaagctccaaaaccacattccaaacttaataacagagaagctgaacactttatggtcacaaagtccgcatttttaatgaatgcagtgaacgcctgcctttttaggggcctgcattattttcatcctctcattagtctagtgtttcttctataaagaaaaaaaatcccagaaatactaatattttcataaatatcatggcagtgaacttggagaagcctcaagtgcatctcaagctatactgtgagaatcacaatttttttcacttgaataaattagtccttgagtctcaaaaatgctttccataacttcaaaacctgaagataattcaacattttccgtttttctaatagtgttcaaaagagaaaacacaagtattgcttgagaaagtaaacagacatcctgatattcaaacatggacagttaatgttcccccaataatatatttacagctcagtgcaatgtcctactccagctaaaagtgaattcccaagtgtttctttatatagacagcattatcacgtaaaccaaaagcaaagcttacagctggtagctggtcacctaccatagaatgtgttttcattagctatagtcaaaattttagctacatgggtcacaaattgtgtctagaatcaaaaaaagtttgatctgtctgtaaatttttttaaagtgtgtgggattaagagaaaagagctaaatggaggaagtttaaatcatcttcaacctttgaacaagccacaataacaggtatttgtaatgaaggccttacttagtcacttgcgtggttctagggattaatagagtttgtgtattcaagagggggctggatagattcaggtcaacaaactgagtcatgtttgctcaggtgaaagctaaaaataaccactccccagtattcctaggagagtaatgcaatattacccagctgcctcagcacacattataaatgtctcctccacccacccatagtataaggtttaactgaaaacaagtaggccaaaaactacttctacaccagaccaattcaatgacagaataatttggccaaaactaaatatgcctagtcactgtaaactggttaactcatggttggttaagatagccttgggaatatgcacagaagttataaaaccatgagctattcattgaaaatgcagtccattatgaattcagttctttttactttatcaaacatgaccattttattttgtctgtatttcaatacagtatttttggcctccacttttccactacagcacatgaattgtgaaatgtgattctatataacatttaatgttaaagtgatatgaaatcaataagacttctaacaaattcaaggtgtgaagaaatgtacaaacacaacctgaagtctctatgaaaattcagtggtccctcagttacacacattactatggctcacagtatattgtccaaatttgtcttgagtatctaccatgcactagacactgccggttctggagtaaacctgataggcaccaaccatatggaacgtacaaataacggaggaagcagacaataaataaacaatttcaggaaaaaataattttgatgaatgttatatgtaacctgacattccctgagaaagggcaacagtcagatatttgggaggtgggagaaatgaatacaccagaatgacagaaaaatccagtcatcgttacaacataaccttgaataaaaatgtaagtgaacaatgactaaacctgtagtacttcttttggaagaatattcattgactccagtcagcttcctgttatttcacttcaaatggctatccagtttacaaattactatctagccaaccgctagcatttatcatgcttaaaattgagtcaacattaaatcattagcccctattccttccagaacctgtaatttaagagttagagagagacaagacttggttgcctcttagaaaagttaaaataaaactaaaacaacaggctgacatgacacattgtctccatttaagccaacatagactatttatttctttgctttattatgagtaatgaacatttctttagcaatcacctaggagcattactattatgcaggtaccgtactaactaaagacagagacgaatggcctcccagacccccatttgctcacaggctagtgtgggaggctgagaagttcacaaagaattacaccctgattggaaatttctttgacagaggtttgcacaggatgctccagttgtaaaaagagctgagggtagctttcggcagggcttagccttggaagagagcaggtaatagccaagggagaatgggggatggccaaggagggaaggtgctgaggtagagatagaacatgtgctgggtcatagaatatctaaaacaatcatattttctgcagatatctgtgcttgaatattaaaaattaaaaagagatcatttaacggtgaaaactgtagtactactcttatctctgtgtccacccttgccttttctaatcagtggtataattctactagagtgccttggcctctgctcccaatcatccctgctgtactctatagagcaccataaagaaggaataataaacagagccacacataacaaagaacttttatttggcaggaatgtttccttttatgacacctatctctgccctgtaagtagccacaaggccagaccagagatctgctggaaggaggcggagtgagagggtagtcaggtgggaatgaagaagctccccgtcctattcccacaaatggccccaaagagcctttgaagtctcagtcatcaggtaataatagccttcctctaaattagaggaagaatgtctgccttgcaacaaagatgatatttaaagaataatctgctttggggtacaaggggaaggaatgcagagaatagaccagttgaaaaggtaattcctgtttataagaattaataatcagaacagcaccattttaaaaagtaatgacttaaagtaaaaatggtcaaagatttcagaaatgttttagagaattttatgtttacaatagaatttatctaacaaaaatgataggaacaatacacattgatttaaaaacatacaaaaagttggtagcagatactttctcctactgacttgagacattgatttaacacctgaaaactaatctcagttaaaaagctgccagcaccatctctccacctgtaaaaatgtgaatatttatttatattttataatttcattttatttattctctatcttgttccataaaacattttggggtactagaactggttattagcctttattttttaaaaataattgggactgatttcaacggatagaattaatgttggggcgggggtgggcagagactacaaattacttggtctatgtctatatcttcaaaagtttggggagcttatattctccagctattgctttttttttttttttccagctattgcttttgaaacaacagctgggaaatataagctcctcaaacttttgaagcaatagctgaagaatgaatataagctcccaaaacttttacctgatctatgaagttgaatggctcaatatccattttactttgaaatgtagagaaaacctccattgcactatgaatggtatttataagaactaaaaggcatatgcccaagttggttctaagctctgcctatctaaatatctctgcttgccttatgagaacttatataaaacatattgagcacttaaacccttgggcaattgcagagtgtgctttggattttttgagtatcaaggtggggagggtcgaaaagagggagaaagggaacacaggtgtcagaaaagactagatgaattcctgttatgtaactactttttcaaatgcccccaaagtacttatttaacctaagaaaatctttagctaagtttagaaattagctttaaatatgctcaattgattttccttagacattccacatgcctttcgccagctcaaaagccttaattctggttaaaaggaaacatgtgaaatatactgcacaacttcagtggccagatcatattaactggctgagctgtgaggtcttatgagccaaacctgcttaccattcactgaaagtcagttcctaaaaagatttcttaatatctgccataccacttatctaagttttgggtggctaattagaatgagctcttcaaaaagttcagctaaagaaagtgcaaatatttgcattaaattgacttagtacttaaatgattcagtgtgttaattcttttactgaaattgctctgaagttatagtagacacttatgctttctccaccacctactttgaagagaagattctcctatatttcaaccatacccattaaatcttactagcttactaaatgaagtattatttcacaattcaatctcaattactggagagctgaaagtgtgtctacagagactagaccagaagtgatttttacaattatcaaagctatgcccttgtgcatgaaatggggtacgctaagtgaaatgaaattcattcttgccagccactttcagtcagttagttatgctaacatctgttctaggaaagctaattttttttaatacagcagaacattcctttacactgaaccactaccaccaaaacacaaacatacatactacatagcagagttgaatgcaaaataatttgtaccgtacacacaaaagtcaagcacttatttaaaaatagttctttacaatataaacttatgaaattatggacattttgacagcaattttccaaaaattgtagcaaacacttgtaaatacattccgactcaaaaatattgaaaatatcatatgtttacattttaggcagatgaggattttaaatgcttcgcctacaacctcaattgttgtggagccaaagatgcaacagctttgaagaatagaagaattactctatatttgtcaggatctacgtggcaaacaagcgccacttggcttacattacttgcctggcttggatcccatggaatggaggagcattggaaccaagaggaaaaaaattaaagtgctttgggacagcgagccaaactcttacatagtatttgaaatggtgtggcaaacatgaaattattttaggctcaagattggtgctagttttttaccctctttttgaaaaaatagtaaaatgcacataaagggccctgccagaggtttagctcataaaatctgccaatcattggatgtgctaattggtgtagcaatccagtggtggcctggattaggactcaaaaactgacccttaccacccttggtgtcctgcagcaaagacagcctaaatcgaaaagactgatggaagtatatcaaattacgaatttctctatccctgaaaaatgcctgcaatttctgtttctccatcactccagaaatactcaaaacagcaaaaattaaatacatatgaagtgaacacaaaagacctccacagaaaaatcagtggctcatctgttgacgctattgctcattgctcggctggccagtcatctgggctaagttttgactttgggccagtgcttcaaaatcagcaacctttcagccaaaagactgtggaatgcagccaagaccacctgtggaaagtgaattatagcatctttaatttactaccttgggctatgatgtcagaaacccagcatggagggcgcaccagttcttgtgtgggaaatctctcagagcccccatggaggcccccaaagtggctctggcaaagctgtaggggtggaggtaacaaaaaaggggacacctggctctccttcttaaatcagctcaccatgggcacacatttatattggaattttagggtcagaaaataccaaaattaaatcttctagaag

SEQ ID NO: 843 - DNA, 107190 bp, Homo sapiens
gtatgagttttagcaggaggggatatgcatgtacacatatgcatatacatacaggtttatttaaatgattggatctacacttttggaggctatttgaagtatcttatcaaaataaaacgcattttaagcaagaagttaaaaaagcttttcagacccgaaggccatttaatacagtaaatcttacttgggtagtttagcaaacattttttaaaacccacatccaacagattggttagtattagatacacagatttggtttcaaagctgaaatacccctggtggaataaatcttctcatgaaattcagttatattatgccacaaaacagggacacttatctattgacaacttaaatattaactcagtgggctacctggtgatataaataggaaaaaaacagtggtcatggattaggagtgagaagactatgacaccagcctaccttggactgggaccgcaaaggatgttaaaatctatcctagaatttaaaacaggaaaaatgtcaaatattccactccccattcggcccaaaccatcccccaaggaatacacccccaccccacccccacatgaggtttactaaccagctgctacagatgttactatgtcactaattaacaatgatcacagaaaatgtgtcataccagagtttttgttatcatacacaatgcattagtggctgcaggaatcttcctccaaaagctaccgtcagaaggcaaactgacaaatgtccatgccgctggtccaagaaaccacagctaagagccatgaggcattcatttgtacattgagctctctctggcatgctccccactctagttagaggggctggggtatggagagaccgtcccagccgggcgctgcagcctcctactcctgggcctccttgcgggtcaacttgtagatctcagtgggtccgtccacatgggtgatagtggtggtgagctggagttcttccccactatggacacccagatcgcctgaaacagggttttcggtgttagatgcattcaaggaggaaggagaagcaagctggggttcatctcatggacaactgccctgatgctagccctctttgacattctgagcacacagagacacctagggcacacaacattcagaacaaggactaactccaaacctgttcacttggactttgcagaactttttaaaataccatttttggctcctagatgacagtcattaagatacgtgagtcagctcactgctgatattattcatagtaatcattaacatttaatgagcatttactttgtgcctgacgctattctaatcactttgtaagtgatcttctttaatcctcgcagaagccctctgaagtaggcagtatgaacgtgccagccttacagatgaggaagctgggaggtaggcaaggtaattgtcctgggtggaggagcaggcccacaagagagctggcaaaggaacatctgatgccaagaccaatgtgatgggctaaaccagcataacacccctcccaacggatgggtcagtcaggcaccaacacatttgctatgaataatttacaaaataggagccaggtgcagtggctcaggcctgcaatctcagctactcgagaagcaggggtaggaggactgcttgtggccaggagtttaagatcagccttggcaacagagcgagaccctgactctaaaaaaaaaatttgttttaattacctgcgtgcagtaactcacacttgtaacctcagctactcaggaggctgaggcaggaggatcactggagcacaggaattctaggctgcagtgagctatgattgcaccactcactccagcctgggtgacagagtaagactttgactctaaaaaaataaaaaaataaactacaaagcatctatgtcacgtgaaagcaaataagacctgcttatatctatccatagattggggaaggagccatgtctaacacatctaggaacaatgaggggctttattctccaggaaaaaagaagtgccagaaacgtgctgtgcatttccttctgccctcaggattgtcctaagtgttctgaactcattatcagtggacagtgttctgctaaaatggaataatttgaacttttctaaattagtaggagaaaaaaattttctctaagttaaacctcgaaaactctgctacctgccataagacaagtgaatgtataaacaacaaagggaaaatggaaaacgcaaccacgctcagtctgactgtgtgtgggggtgcacgtgtgcacacatgtttgtggagaggggtgctggggaatagaaagttaaacttgtgtcagtgatttttatattgtgcacatatcatatgataagttttctggaactgaagtttttctaatttaaagcatagaattaagtaactaaatgctgttttccattgaaatgccataccataacttagaagcagccttggccctacccttaggactagtaatcttatcactaatttaagaactgctaggcatcaatgaatctggtggccttagaaccccagatgtcactcccacccactggcccagcaggctgcttggctggttcccttcacgtgtgccacgcagtattagtttctcatcgtagacccatttctctgtggctgcacagcaaaatcagtcctattattaaatgccaccctgtaagctctctacccaggagattccctggcctcagaagcagactcattggctgctgcagaggactgctgaagacatttggggctgttttggcaagggtctaatccacaggactatgggtagagaaggcattaaaggggcatcagtccagcctccagcacatccacattcatctgccctcaagccagagcatagatgccaagtaaggctggtgagaggctttagctgggctactttgggccaagctgaaccaccacttgtacagtgagcaactactcccaggccaataacttgtattctcactgctgcaacatctagtccacacctcagtcaagcacaagcagtctaagcttcacatttctcagtcaaagctatttctggatttgcatatctgggctagccatcagaacttcaaagccagtttcatgatctgcatgtctgtgtgagtcatcaaaatttcaaagagtcctgaccaccccagtggacccattagcactcataaccgtttacctaaggaatccctttccctgaggacttcttagaaatagatgctagagagtaattctactcaggctttgaaccaaagatgttaattctttaaacttaaaatatgactccaattagcagatcttagaatatgcatatgatcctacagatcacttgaaaaaacagccaaaattgccttggcttctttatttaaatggatacctatgtcataatgcttaacacgtgcctgacacagttctaaatactgtacaaatattaatgcacttaattctcatagcagtcctcagaggcactattatcatcactcccattctgccgatgaagaaactgaggcacagagaggctaagtaacttgcccaaggcccaagctgctaaatagtgtgtgggattcaaataaataggtgccaggatgcaggctctcaacttttgggttctgctgcctcttcttaaatattcaagtttccagcagccagtgagactgccagtgaggtatgaagtccacacacacagcattacagctaaaaatatccgcatacagccgggtgcggtggctcacatctgtaatcccggcactttgggaggctgacggcggcggatcacttgaggtcaggagtttgaaccagcctggtcaacatggcaaaaccctgtctctactaaaattaaaaaaattaaccgggtgtggtggcgcatgcctgtaagtcccagctactcagtaggctcaggcagaagaatggtttgaacccggaaggcggaggttgcattaagtcaagatcgtgcccttgcactccagcctgggtgagagagtgtctcaaaaactaaacaaaacaaaaaactacacataaaataatttgaataaattgtttagcatatttactttgcttttgtatctgataaatttatagcatataaatcagtgcactgacaggagagctgttataaatttatgagtattggccatatgcactgttaggggtttagcatgccctgtatttccttgtacgatgtgaagctactgtggcataattaatttctctactgtgctggatgaggacccagataatgggactccatgcaccaaaatctatgtttcacatgtgattttattgtaccttgaaggccaactgttcccccttggggaatgggtgtgtgaacgtggcagtaacatagcacgagtggagatccctccacttgcctcctaattccatcacctcctacttctgccaaggtcttgctccatctgttagtttccccctctcttggctcctgctgttcagtgcacaaacatgctcaaaagtctcttcccatctcagacaagaaaaaacccttctgaaaatgtgatatgtgtcttggggtgaaaaagagtgagaaagaaaaaagaaaagaatgctttagtttgcagtaaatttctctccctggttatgatgtcaaattcatcacagctcattaacaattagatgacggtctatttcttcctaaccttgtgaaatgagaccaatctctggcacagatttcatcccaaaggactacggcaatgcatccatatgtgtggagtcacatccacaggtgtgtaagcggctgcttggttgtaactgcctggaatgcctaatgaggatgaagaaagccatatgcactggagacagcttcttaggaccggcagcattttaatgacaattgtttgtgtatctgtgcccacttcaataaaaatgacaacagctactctcattctgaggatgtattacagattccgggagagatcggaggtaccactagaggtcttctaatattaataaggcctacgtacttccatcctcaccactaccaatgcaaattaacaccccactgcccaagtgtgaaagccagggagctcccataccatgagttcatatttgttctcaaggtcatacacaatgtgtgccggagccaagattccaaaccatctgtgtctacctccaaagcttatgttctttccagaacattcatgacctatccttttttgtagaattttccctaggcccacaccaacctctctcctattcaccttcaaagctaagttcaaatgataactttttgtaacgaagtctctggttcacagcagaatgagaaaaacagaaaagtgtagtattttaaagccaaattattttcatgcaaagaactgcttaagaatatgtctgccttacatttttggtgttaatatgattgttatgttaaagaacaaaatagtgtcgctggtgcagtggcttacatctgtaatcccagcactttgggagacagaggcaggaggaccacttgagcccaggagctggagaccagcctgggcaacatagaaagatcttaaccaaaagaaaaaataataataaaatggtgaatggtaggtttcttcttctttttttttttttttttttttttagatggagtcttgctctgtcacccaggctggagtggagtggagcgatctcagcactgcaacctccgcctccagggttcaaagagattctcctgcctcagtttcctgagcagctgggactacaggcgcatgccaccatgcccagctaattttgtgtgtgtgtgtgtgtgtgtgtgtttttaagtagagacagggtttcaccgcattagccaggatggtctcgatctcctgaccttgtgatccacctgccttggactcccaaagtgctgggattacaggcgtgagccaccgcacctggccttttttttttttccaaagaaagtaaatacccaggacagtatgtggtatatagtaagtgctcaaaacacccatgaaagatttgcctggtgcaggcaagggcagttcctctgtactctgcatggctgggtctagcctagcatatcggcactggtgttcttccccactggcatttaggaaaacaccctcagttagaaaacaagtgtgccttgggatagctcagctttgaggatcccttctgggagatggggcagagtggctttggtggacagggttaagagccctgggtccagttgtctctcggtgcctgtcaaccccagaggtcatttattccaggcttggagcgagccattgcccatggacctccaaagcacctcctgacacttactgccaggcagtaactgcaagtgggagaagaacacaatagaacttattagtttgggggtaaaatcttggtgttacaggctgaattgtatctcccccaaactctcaaattcatatattgaagttctaacccctagaacctcagaatgtgactgtgtttagagatagggccttcttaaagaagtaattaagttaacaatgaggtcaattggggatgggccctactccaacagactggtgtcctttgaaagaaaaggagattagaatatagatatacacaaagggaagaccacgtgaagacacagggagaaagtatccatctacaagccagacagagaggtctcggaagaaacccacgttggtgataccttaatatcagactgtgagaaaacaagcttctgttgtttaggacaccctgtctgtagtattcgtatagcaactctagcaaacatttaggaagccgaaggttcttcccaagaaggtaactgagatgtccctatcatggtggggtgacaagaattctaagactcagaaaaaatgattttaattgactgggccaggaaaggtcaggtcactggcacagcaatagccctgggagaggcagggggcagaagacacctgattacaaacagctgagcaaggggtgccaggctggtgacggtccatcagttggttcccaccttcactggggaatgggaaaacgcttttaagacctgctttagggtctgggtccagcccgtgtgacaagaccaatcccatcagtgctcacagacatcaagaagctcagctggccatgggcagatcatctaatgtacaatcagggagatggcgtcaataaaagggggcaaccaatgtcagggcctcaggacttaatccaacgctttaccgaggcaacaaagccaaagccatctttcctatgaaacaaggggcaggagacctcagaaacctccaggagtaaaactgacatcacactgtagctagctgccaagacgcggaaccagtgttgccgcttttgctccccgcagagtgggtgcattagacagaaaatgcttagcgtgaacagaaataggagggaatggtggcagtgagggcatcttgtgttccctctgccacagtcatctagttgggaattctgtgtctcacttctttttttaaaacattctgacaagaattttataatcaaaagaacacaaaaatcaaagctattatcaagaattgtctgacttcataagcagctccaacttcttattcccacctgaattgtggttgagtgggtttgcacagtttttcatgtgtgcagggctttgctgctggagccccgggaggtggtatttttgctctgagaagaggattcactttagcctgctgcaattcatatctgcctgggaagacatccagaatgattcacaaattggttatggcaacaggtaaaaagaacaactgtcatgaaaaggcagcagcagcaacagcaacagcagcagcagcagcagcagggcagaaaatataagtgttccttgaaggaaaggtaactaaaatatctttgctaaatttaaaaatctatatgtgcacgtgtgtgtgtgtacactcagacacatatgcataaaatgattacacatataattctatgtacataaaaataaaatgattaatgtgaatgagtttgcacattcactgccgctatggtccaccagccaataggaaggaacccaggggaagtccacgaaagcctgtggctataaagaatgtggcgccacactcccgcagcacctatctgctggtgagaacactccagtgtggagttgtcctgccacctttcaagaggtagatgaggaaatcttgtcccccagaccaggctaaagaccccttgagagcaaggactatgtctctgtcactccttcgagcttcacttcactccatctcattcaagatggcacaaggctaagtactaaggaactaaggtatgaggtatgagctaagtactgaggtgctccgtggttcatttgtaaagggtcactttctgatccatactatgaaagagaaacagaaatatatgagaaaatgctctttggaaagtgaccttgtcttgaacctgtggcccactttgttcttctctgtccattctatgaccaaaagagagaagaaaaagtctatcgtgaaatgctcaatgattccatttccttcctacccacttctacttcctcctgacacttggcatgtccctccaactcacataccaaacaacctccatcaaagattctttcccttttcttattgcctttggcatcagaaactgcttgtctgtgctccgtccaggatccatctaacaaaggctgaagccccacacacctgggattcactctctgtagcaagatatctgaattcctagctctgaagcttcaaagcaaaggagagaaagaaatagggagggaaaggccaaagccaacttaaagacttcccatgagaatggaaaaggagcatgggaatgctggaggtggagagagaatgccatccagagactcagagaatgtaaagacacatgtatccttccttgcaagagttcttctttgaggtttccacataatattccaaactaggtctttccaaggaacttcgaaatcttggcaaatgctccgtaattcctaggatacatcgtgtgatctggtggcagatgaagagatgaaaagtgaaacaaaatagagaagaaaaataagcagaatgcccaacatggaagagaccccttccaaatgcacaaggtcacagcaccatgcaggaaagggaagggcccacaagctgccaggggttcccgggggtgctgggaaatcacagatcatgttaccaaaggagaactgctaaatcttatgacttttgtgtttaggatcagcatatggtccccaaatagtttgcccactaaattgcctgaagaatgttttttcacagagggtctacttggcatttcacaggcaggacatttctttatgacatgagccttgttttgcctattgaacaacatttagtagcacccctagaatctggacactaaatgccaaaggcatgtcccagttatagtcacaaaccaaaacaactgtgaacatttaaaaacacccacttagcagaggattcaggggatatgacctcttgttgagaattatttgcaagttttccatgaaattacagatcaagctgtctttgatgaaaaactctgttgaggaagagtgaagtgcttttctcaattgcaacatttcaagcctaggagactggctactgtgtagggtgggaagtcctgatgggagctgcctaatatatggctcaaatctcaagaatctgtccaacatggtggtctgtagtcatcctgcctctgcagggttggccacagctctgggctcccacttgctgaacagtgttaaagttggacacgttctcaccagtgtttggaaatcccttacctatgacagatatcactctctgggctgccacttagtggcaagaagtgttcttctgccccttccctgctaataggaagaaagacaaccatggactttcttttcttttcttttcttttcttttgagacagggcctcctctatctatcacccaggttagagtacagtggtacaatcatggcttactgcagcctcaaactccttgggctcaagggatccttctgcctcagcctcctgaatatctgggactacaggtgcacaccaccatgcctggctttttttttttttttttttttttttgtagagatggggtttcactatgttgcctaggctggtctcaaacttctgggctcaagcaatcctccagccttggcctcccaaagtgctaggactataggtgtgagccattgcacccaggctaaccacagaaattcgtagttcaaaaggacttttaggagatcacttacatttgggagcagtggtgcacagagggttaagtgttttgccaacagtcacacagtaaaaacaaccaaaagaatttatgtacataaagtgctgtagcacacagtcagtacttgataattatttcccaccggtattatcattccatcatccaggaagtccagccattgctttaagtggtatttctctggaaggtagaaactctacctactcacatcaaggacaaggccacatggtttccttcagtgtcccccacaggatgaccatggaatgaaatcaagattcttgtccacaagcccagcagtgcttgctgctcgtgttgtggaagcccactgcttgacaggctgaatgctcccattttccacatgtacagtaaaaacaccgagtggtgtttttactagaaatggaaaggaagaaggctgcctagctcacaagccttctagcaaaacagtcagtcaaaccaaagttgggcagggggtaggtaagtaaatattctgtattctcacctcagaccagagatgggcttgaaactgattgtaacatgtctactccaaagaggtcaaggggtgagggaaactcatgtccagcatgctctcgcatggacatggcaaatacaggatgaagacagacagtggctgagaccactccacgtcccttgacccccagcacagatgccttcctctcctgctccacttcatctcatctctcaagtaactacccccctcccttctccccacaagatcactgaaggctaatctagaactcttacttctaagcattaattcactcaatattttaaaagtatcctaaagaactggtccttgccctgaaggagtcgatgatccagcaggagcataaaggcacagatgactcatcttccacctctacacaataaatgtcatgtggaaagtagactcatgatcccctaggcatattccttaggacaacagtttcaagagatacactgcctaaagaaagggtgccagggccaaatgatctaataattctggaaaatgctgttaccaccccccgctttgtaaagactgacagtacaaattaatgtactaaaggcattaacatgtattgcagtgaaaagccttattagtgctgatcaactcaatcattctcaagcatgtttgactacctaaatttatcaacatttcatggagacaatattccattgaatgtcatttgctggattctaattggggtgattgggaataggtgttaaagaagatgctgcattttgactgggcccaaaagatgagtagagtttcattagtcccagatggaggcagaatgtgcaatccactcatgcaacacacactcactgagtacttcctaaaggtgaggccaacccttggctctggggggctgctaccctggtttccactgcaaggcagagtgaaaggcactagagcactgatttgagaaagggcttcctatgtttggggaatagcaaatgcatggctagagtaaagcaggtgtaaaaagagacagaatgaggaataaggctgaaccaaacagaaaaagcatctattagatcagttgtttatcaggccacctgttacctgttaacagcactggcctagacagtgttaatcatttctgtctgctgtggctagtgaagaaaccctgagcaagatcttcccttctctaggcctcagtttctttatctataaaatgactggattctctaaggctacttgcagcatccatgtctcagtgttctgtgattataagatataaaaaggcagcagcacataccagcactaaaggacaggaagaactggggacaggagaatagctattggtttagacatacatcgaaaaatcaccttgaagaaaaatgagcagaagaaaaatgaagcctattccatcttcagctctcagggcccagactccctccacctgatatcttaggattctgcttctcaaatgggaagaataaacatggcatagtttccaacagtcaattgtgctcaaaaatgtaaagaagaaaatttgactcttgttctaaaatcaagacatattttagacttagcatgcaatattctcaatgtattttagagatttaaaaatgaggacttaaagaaagatctggcttgtgtgggctttttgtcttatgggtgagtcccctgggtgctcattcaccgtctcccagtgtgaggagtatacttggagggaaagtttcactgggcatctcagagctttagccatttaaatcttgtaaagacagaagcctatttatcctgacttaagctgttctaaagagacagaaactcaccattggactggtcttctccatagtttttatgggatggtgcatacaagaacatcagagcaaagacatacagattccacatcccatagatgcctgtgaaaaaggcactgttcacttggactgtgacgccgccccatttccaatggccttccgttacctgcggagaaaggatggtgatattcaattgaaacagagaagaaacagaagaaacataacaccaataaaggaaccaaccaacatgaaaaccaagtctcttctacatgtgggaaacatgaagggccatgtaagactccatcttttaatctgaatcatttcggtgtaaattaaggtcaactgaaggttctctagctttctgtcaggcacagtcagtggtccttaccttgcccacagattagtatcacctggggagtgtctcttcctaaaaacagcaattcattgctatccctaagttaaacaaactgtgtttgagcccatcacttattcacaattataattcctcctctgctgtctgtcttcccagctagatgtcaattccctgcaggcagagaccagttctctgctgccatgtctttaaggcctgatgcaccatagattaattcaaatccagtgtctaccactcactcggcttaatgtaagacaagatgaagactccagacttcagaacttcagtgtccgtaagtgtaacataaaagcttgcaggttatcgaagagaattaagtaaaaatatttctagaacctgcctggcaggtactcagtaaatattagttatttctataacatcccttgaagtaagccactcatgaaaataattatgaagctttcatatgcttcaaaattctgcaagagatgttttgaagctgcttttgtctgtgttaatgatttggtaattgtcttaagggctgcctaaagatatatggattacactaagaactgtcaacagagctgctgagctaagtgactaatttgtgccagctctgagacaaatgaaatgattttgaccacttctgcttactacgggacacttaaaatggaaatagaagaaagtattgggtaaatattcctttgacagctgaatgaggctgcgttgtataaactttctctaggaatcacttttaaattgtaagatggcaggctagattgaaatgttaagaactttaacaagcaggtggatttcattgcctgtttatgatacagtgggtctgtgttcattatcttctgtataatccataacccacttggggccctaggccaaattaaggtctaagtataggtatttttttctgaaagaccaggagtgtcagttaaccacattagccaattatagacttagcagttttagtttggccttggtgatacataattcttcactttttgtgactcataaacaaaccactattatgaactcttatttattttggaaaataatgcattttatataaaatgcccagaagtgttttctggcaaagatggatttcataaccattactaattttaggacaatgtaccagcattcaagctacttaggacttcttagaaatgtctccaaatgtcgctcttctttaagtgcagaatatactaactttataaaaactatattacttagagcatcttatgatgatttttattgcatataatggaaaggaaaagaaagcattaagatagtttccagaaatacaggtacctgctgtcataacacagagaactcttctgtatgtgattaaggaggggaggctaggctgtcacgcatcctagctgcaagagagaatatggcaatatggcagctcttctactctgttaaggcagtggacccttcagctcagggaagggccagtaagagaccctattcctgcgacagaagctggaaatactcaatattgacaattttagtgacattgattcttgctaggattgacatgactgacccatctaaggaaacaccaacctatgtgccttgcacacagtggtgctcgatagacatatgttgaatgaacagaggtaaagtacaggtatgtgtagggactccaggacaaatacatggaggtagaaagtggagatggaaagaaccactcttaaaagtacttgattgaaaagtaaagacaaagtattgcagtccacaagtcataataattgaatttaaaagtgagaggagatgccaatgtgtgacaagtgttattcatttaaaacattgctttccgttatacttatttaaaataagtggttaacacaaatattagcaaagctaagattcttttgtattcataacaaggataagcatatttattcaatgctaatgatgtgccagatacaatactaaatccttttacatgaaacacattatttagtcttattaatgacgctgtgaggtaggtaggtaatatttccattcaacacatgggtaaactgtggcacagaaagatggagtatcttgcccaagattgctcagccagaaagccatggctctgactccaaaagaaggtattcttaaccattatacaacacaagggtaggaatgctatcttaaacaggggttgatctctgaaggtagcacatgctctgaaggtagcacatgaggcaacgactatgtaaggtcaaatttccttttgaaattcacttcattgcccataatgtacattacaaatacaacatacatgcacacatttgtctattcaaatctgtatagtatgcactatatatcctggacatagtaacatatggtataaactggatatataaacaaaataaaaacttacagtagaaccactggaatgagatgcccatagtatgagaggcacacaccaagcctgacaggaaatatcagactcatgctcccgtctcgtacttgctctgggacacatgcacattgtttagagtggagttgcagaattacacaccctactgaatgtgcaatctgtaaatgtggtgtttcctgctgtgggcaaagagttgaactgcagaaataaacggtatagatagtgtaactctgctctttggtggctggcttgtttttccctctcctctcccaattattcatgcctaagacatcctcagctctgagcacattcccaccaatatgtaccacaatgagcagcctcaacagagcaggccttgtaaatccaaaatcttactaatgccaaggcggaggtaacagtctccccccttttaactttgagagaaaaatcaggtagccccagcccccctccgccaaaccctcccccctcctcaaaatccccaaatctcaccctctgcataagtcttatttctaaaagtccctgtttttcctgattttacatttgaacaatttacttttgtgtgaaaccacccaattatacccctggagccaagtgaaggtcaaatctctttacacccagtagtcttgacaaccaacattccacttaacaacaagatttccaaatcccagacacaggctctcttaccggaaacatttcctctgtaagtaacagaatgaagtgatcacacacacacaaaagagctggggacaggctctctgggagtttgctgcatgtggcttgacctgaatgtcaggcacctgggggtccccttaatgaaggtcggtgaccttctcccctgcactgcacttctgttccctactgccgccacctctaaatggaacgcctctttcttttccagagggaaggggctgaaataccagactgcgatgtaccatctcttggttgctatgactgaggccattaaaatggcaggcattaaaagactgcacctcagtacccagctacaaagcctcaaggtcactgcattccacagcttcccgtcgcctttcattcctggcctcagagcttcaatatcctggcgagatcccctcgcattatatttcatgaggcttaaatgcaagctctcccacagcaagcccgagagtataatgggggttttaatacattccttttacctaaggctgggatccatttcaaaaagttacccaataggtttcctttcaggtgagctcattgctctgacattccaaaatgacattaaaaaataaatcctctgatgactatattaatacagtacctgggacactgagagttatgccggaaaacgtcttagatgtctataaataaatcttagaaaaaaaacccagcaggaggaatgtgaggagctaatggaattcaaaaggcctcattgctacccccttagagttgaaatccactccgggccgactgtcgcagcagatataaaaagccagccacaggctgaagctgtattagaaaatactgaggcaatagaatattaatctttttctccaaagaaaagccacggactatgctccttggaagatggcttcctttgctataagaagtacactaattaaacatgtacaaggttaaatcctggcaacatgcagctgcttcagggatcagtccttcttgacttcaggtgggaggcattccccgcagaggcaagatatacatgaggcagtgtggggagaatgacgtcagcctcccaaactggcacaaggacctgtgtgtggccttaggatcaaaagcgtccttctttctgctttcctaaaaacatatcttgaaattgccttttatgcctcaacccatcttccttgagatgccgtttctccaaggaagtgctctgtgccctctcagccttgcaggtctggctgtgtcaagtgccactgtgcactactgagggactggaggaactgaaaagcattttggtcataggagggaatagccacgggagaagtcaggcctcagacactcttgtttgaatatggatgtttgagccttagctggtagaataaaacactctttcagagtttgaaatagttttactgcaaatggagtggaaagcgaagtttccaaggttttataaacaacctgatataaacacagcagtgttgtaggtcaaagcagatgtggtgaacagaacttacaaagacatatatgtgtatcagtttattttttccacgttcatttcaacctcagcagagctagcaacactaacactccccagtggcagagccaacaacagggctctagaggctccaaacttggggtcctcttgggtgtccttggatagaattcaaggggtccataaactagaatagaaaaaattatatattttcactagtctctagctgaaagataatgtttacttcaattatggatgtagaaaaatccctatagtgttagtactactgtgattttctcaatagaaatcatgatattttcacatcaattacagttgtagatataaatctgtaatatacctgtagcatctgtttcactgtaaatatatattacatataatatatagagatgattccccttgaaattcgaagtattttattttacttatttgaaaccattctaagaggagactcgtagccttcttcaggttgctaaaggggtccatatacaaaaatggttaggagtccctgtactagggaaacttcccagcagaatggagcaagtcgtgtcctaagacactatctacactactgaaatcctccattttggctaaatgacaaagcactggcaaaagagtcagaaggactgcgttctgatctctaacttattgcatgtcctttggcaagaaagacattcaagcttcttgctattcataagaacacagctactcatgcttacaatgtgccaggtgctctgctaactacatttggttgccacaatgatggttcagtcaacaacagaccacatgtatgacagtggtcctgtaagattataatatcatatttttactgtatttttctatgtttagatatgtttgaaatacacaaatacttaccattgtgttacaattgcctacagtagtcagtagaggaacatgctgtacaggtttgtagcctaggagcaataggttacaccatatggcctaggtatgtagtaagctataccatctaggtttgtgtaagtacactctatgatgttcccttaatgaggaactcacataatgatgcgtttctcagaatgcatccctctttgtaaatattacttcctgtagtcattacagcaaccttctgtggttctattgtaatatttattttgcagataagaaaattaaaccttagaactgttaagtaatccatccacagtcctatccagctaggaagcaacataaatgaaaactttctccaaagctattagatatcatagtctagcaagctaggataacaattcctgccctacttacctcgtaggatttttgtgatgctcaaatgaataatagatacattagatttaaacagtacttcccacccttcaaaacaagttatgaatattttaaaatgattgttattgagattttcaagtatagcaaaatgttgagttttggaaataaccagtgaaaagacaagatgctatcaaagagacttttgaattacatttcatatttaagtggcaatataattattacaaggaatagctgatggactgtataaggatctatgttaatgctagataaaaatggaatcaaatttatgcttgttagtgttgtgctacacggcttgataagtttttctcataagtaaataaaatatgtgcccttcaatctggctgtaggcttttaatttatttggaaacttttatctcctacaaggttttacggaaagagaaaatttagtccatttggccaggtgatatcaagacccagaaaaatatggcttgaccagctgtccagaattatggcctctctcctcctttcctcagtggctctattgaatttctgtgcagggtagagggatctctgcagagacattctcaccttgacatctcagggtccacttacctgactaacgatgaagaagatgacagtcatggcagcgcaggccaaggtgataagcatgaggaacttgaacctaaaaattagcccctattagaaaagaaagagtagtttaatactccatcagctaccaatccttttctcactatgtaaatctataaaaagcttaattttaaagaaatctgtaaaaccaaatccctaagaatgacagtaaaatagtttcccatagtaatatttcttctgcagaggtgagtgtggctgaaaatttcttgggccaagtatttcctatgttcttatcactcataaagcagcgatacgagagcctgggaaattatattcacaacacgtcgtgaggctgctaatttccctgctaagctggttatgcttctctgcaagggttcaaagttaccaaatccaagttttctgtggttgtaataaaattctgctccagtgaacaaaaagaaatgtgcatattaatcaacatgaagtggatttggttgaattttctcatgtcactccagctctggagacaggcaagccttagaaagtgcctgtggtttcctaagagcaggatttaagagaacctgtgtttcagagagggaggcctattattcaggggctcttctgtgcagatctactgcatataaaaactctgaggttctgtagtttctgcttctcttttcatacaggaattaggcttgtttctccaaggacagccacttaggcatgaacccaggggatccctgataaatcaaggatgtgttgcttgcattggggatttgaggatgttaagtgtttctcttgaatgaggaacataatctataaacagagattactgaactctgtctgagcatctgctggatattttaggggaatgtggcctgttaagagtctggaaatcagatcacgtgggctaaaccctgtttaattacaggacagggttgattctgggacagaactttgactaaagcctcatcccaacaaaatcccaattatgccatagtccaatctcccagctagtatgtaacctacattccatcaccaagctgaagaaccggctgaacaagtttattcattactgaaaatggaaacacatttgtaccacagaaaacaccaagatttaggccagctagatgcttctcagagtaagatttggcctctaattttgcccagagatcctacatgagaatctctcaatttgtatttcaaagtaaaggctttctatctccagggtgtgtgtgtttacacatcaagtggaaagatcaagcaagcaccagttccagaacgagccaagaaatctgcccacctcatagtgtagccgccggactttgctcatagctggcaggctggactgcttcccactgatgttccgaaacacctgaaataccatgaagcatagaaacaggaagtagaggcagaggcagattccagccacgatgatgaaggccatctggtcgtgtccagtaaaggaaacaacgggctagccaaggccaagttgagccgggtccaggcccttctccccaggtctgttggcaatacttgttttgtctccaaatatgtagaaaattttcaaggggataaaatattaaaacctgatattctaatgccaatgataggtttcttgacacattagtaccacagagggaggtgttcaatattgctttctaaaccaagtaagaaaagaaatggtgtcttgcttgttagaaatgaagaatctaggccctaccctagacctaatgaatcagaatctaccttttaaccaggtccccaggagatccgtatacacaataaatttgagaagcactaataaaccatatattcgtcactatggatcagatgaaaaaccacagtaaaatcaccagaagggttcaaatgtagatccccaggtccctccctagatatatggaatcagatattccagggctaggacatcaagtatgactatgtttgggaaccactgggctagtccttggagttttataagaatgcgattgagatactctggcataattgaagaggagatacgtgggggctcagtgcaggggacctgggcatgggcttgaaagtcttaaagtgaaaccagggatgaaggactatttgcaatcttctgtcaccacagaaaatcttgtccaacagaatggggattcaaggacacatggcacaggtgggagtctgggttgctgccagtatacttgagacccactagggagactgacctgccaattagagccagtctgagaaccaccaagtcttaggatagcgtgagctgccttggaaggcagatgacctgattccaacccctttctgctacaactttgcccaaattgcctttttttttttgagacagagttttgcttttgttgcccgggctgaagtgcgatggcacaatcttggctcaccacaacctcctcctcccaggttcaagcgattctcctgcctcagcctcccgagtagctgggattacagggataagccaccacacctggcccaaattgtctatttttaaaagcatttaataagtatgaacttggcgtgcatatttcattaaataatataatatctaatgcagtttctccttctttcctataatgaacatcatcctggaatgaagggaatatagttattttctgcaggacttgaaattttactcactccatcctatctacaaaattaaaaaagttgaactagatttaacattagaaacattcttcttgttgtgcagctaacatttggtgggggcataacagaggaagggtagagcttctctctcatctttgaggaaatgatactactgatttagtttgctcacaatgttcttgtgacactgagaaaccaatataaacatcatggcaagacaaaggatattccctagcacgtggcaagatatgagccatcaaggaagaatacaacccaagcctttctctccactccagagcagagtctttttctcccaagatcatttcacatactattccggaagataaaatatttaaatccagcatcctaaaagggataagctaagactgtcacttctgcttcatgaagatgacttagagtttatgccaaccaaccagaagccttggcgacttctctggaactaatcaccttagccttatctccacttggtctcaggaataaatagcagcagtgtgatttgccagcacaccaaggtcacttaagaagtctcacacataggtggtttcagaaacaggctcttccacaggggcccagagatgaacctccatggctccagggaaaagctagtcatgcttcagtctgcaggaaacagtgtataacagataattcagacaggctgcagtaagcctagcaactcggatccctctgctgtgaggataggctgtgaccttctcattttgcctgctctcacccaggcttgaaagcaagcagtaattcttcttattattagccttaattgtgctgttatgattggcctgagaatcaaagccctggctgagtacatatggggagcatcagcagagccttagaaaatgatcttggggactgggtggccaggggaagaaataaaaccctgagcccatcaaggaaggatacggccagctctgttccaatgtctgtagtccagatactgtagaagggattcgtgagttgtacccctctacaaagaaaatgagatggaaaggcaagacacaattaatacaaaggcaacgggaactttccttttcacatattcttagcttttcagctgcaggggtgagggctgtatttaggctaaaaaacattacagaaatcctaaagagaaatgaagcttgtagaatacatcggcccaaatatttttcaactgtaaagagctgtgcctttgatttgatcccagaccttgtctgaggatgtgaccacgtccagtgcttccaaaccaaaggttcccgaccaccattctccttttcaaacactcctcctaaaatgacaggagtgggcgtggtgatgcacagtttggctcagtgtcccacaaacacttgctcacctctcacacatgtcaaatatgaagaggcagaaggagccaacggcaatgggtccgacttgcttccaataccctgcgatgtggttccgctcgtgctgatcctgaggaaaaccaaattgagaagggagatagaggggagaggaagaccaagcaattctatgggggagtcagcattcgaaggacacttgccgaccacctattgtgtatcaagcactatgctagattctaggtatgagaacaaagaagatgaaaatctcttcttcaggagctcatctctgtgggggagtctggcacatacgtagaacatgacaaagcccagccataagggctctgagagtaataagaacaggatgccatgggaacacaaagaaaggcctcggctcccaggcaggggacattttgtggtccacaaaataactcattctgaattaaatttctacgtgacttgtaacttgtgtttataaaagtgactgatcctcagaagacaaagtaaagacattaaagcatttaaatatgtaaagtgtgtctattatggtgaggaaaataggcatattttctccccatccttattaaaaccaggaatgagtccccttgataaacaaagacaccaagagaaagaaaaggaaggaatgtagaatgagaaaaaagggaaagcaaagatgatcttagcctccaggtggggccccaggtgggtcagtccacaccagctccctgcggacaatccttggctggcttcctggtgctggaccaagttccatccactcccccgccctgctgctgaggcctcattctcagcgcatctctgctggaggacacctcatggagaaagaccccttaatgtagacagtttagcagtaggaagaagtctctctctctgctctcacactgctctcctggaagggcagcaggacttgagaggtctggttttcatgattgagccataatggaatttaaaaacagtccactctgctgtgaagcccatgtgcctgacgtgaagaccaagttccagctggcatatcatcttagccacaatgtgatgatgacaccattcttatttttaaccatggtaccttcaatccctcttgaaatatgatttggtgtctgtgcaaactgaggagaccgggaaggtctgtatttcagagtaataggggttactaggccacctggacacattgccagctggaaagagccaggcccacattctctgatggttaacctgtattcctggggacaggacaagcagggcagaagccagcagacaagaaactcaagctcaagggcaagaaataatactaatcattagaatgtgtgtgtttatcttaagttactcacattctgtcatttaattctcatgaaaaccccatgcagtaggtctttacatcccattttatagatgagggacccgagattcagagtgataatgtcatttgcctaaagccactcagctggtcagcaggtggtgaagcaggaatgtgaaccagagggtctgcctccagagttcccacttgtaactactagtttattctgtctcacccactgctgactagaggcaaaggggggcaggtgtcagcttggcagcctgcacagagcagctggtacagacgtctgtccctcccggcggctcttaccatcatgtgctcgccacagaagatgatccagaaggacagaagcatcgcatagaagatgccctgtcggatgtcaccaaacagcagcatccaggtccagtcaaacccgatggaaaaccattccactgggatattgataaaggtcatggaaatcccaagggcaaagatgactctgatggtgagaaaatatcaggacagccactttattcatctggaaggcagattttcaaacaattccccgaattcagttttgagacatgagatgttacttattgggtctgaagccatatgatcaatttcttctgcacagagatgcaaaacgtcctatgtagttggcactgctgcagaatgagggagtgctataccaacctttctatggaagtgaacctgacctccttaatgcctcacactttactttggtaccactgcagatggcagtcttcctataatgtttgtgtccccttgccttctcacccaggcctcagtgagtacaattgtcctctttcacctattcaggttatcattcatctgatcattaagaacactcattattattgtgatatcctcagcaactatgaattatataagcatatttgtttcaataatacatgactccaaacacatttgaaatgtaaattctcttgactgcttgtttagcttttattttactcttcccctgtcacactaagaactgccaattctctactaaaatataattcttaagtcactgatttattcatacttttttccatccccttgaaacacatatgttaattaagcacagatcatgtaccaggtattgtgttagcactatggaatcctaaatgaacaggacctgttttttcactcacgggagatacagttagtagaggagccagataaagagacaactgaatagattaggatcaggaacatcatagagttttaaagcatagagggctgctaccaggacttctgactttgacacagacaggaatggagctgacttgtgagtcaaagtgagggaagtggaaagggtgtttggaggagagggcagagcctggatggaggcatagaggcctggaagaacctgctgcatttggggatctgcatgtggcacatcaggaaatgacaggacatgagaccagagaaacaaagagggctgtgctcatgaagaaacttgcataccccactggagaactgaaatttatcttgaagagactttttattggaatccaataaaaagtttaaacaatggagtgacatgattcattcaaaaaatatttattaaactcctactatgtgtcagtcactattctaagatgctgggaatataactgtgaacaagaaaagcaaggattgtgctcttgtgatgcttgcatagagatggaatgagagagggagtacaagaaaaagataataaatgaagaatgagcatcatgaaaaaaaaagctaggcaagagagtggagagcaatggggatgtgattttacgtaaggtggacagacgaagagatcagcaggtgtgaaggccctggggtgtgggtttgagcacaataaagggggctggtgggtggtggagaggacaagtgacaagatcagaggtggaaggcacccaatcatcaaggggcttataggtcagggcaaaggagatgaaaagccagtggagagctttgagcagaggggtgacaggatctgattaacacttgaaagggggcactcctggctatcctgtgaataggctgcagggaggcacgtgatggaagcaaggaaaggggttgcgaggctgttcccactgatccaggtgagaagcgatggttggttagttagattagggtggcagcagtggaattggtgagatttcctggtgaggttgatgagaagtgtgaaaaacagagacatacaggatgactcactgctacatttccagtctgaacaactgaaaggatggagttgccttttactgaaatggggatcctgggagggaataggttggaaatgggacacaatcaagtgttgttcttggtacatgtgacattttcaatgcaaatgaagacattaagtaaagagctggaatatttgggtccagagttgggagaggctgaggctaaagatacagattaagagtcatcagagaatagatgatttttcagaccacaaaggtaggtgaaatcaacccccctagggaaagcacagctaataaagagaagaggtccaaagcaggtgccccagtcccaaagtctaagagtctggaaagatggaaggagacaggaatggaatctaaatgctggtcagcaaagaagaatgaccaacagaagggtagaggagactctgggaagaaaaactgatcaattatgtcagatgctgggatgaataaaaaaaaagtgaggaacaaaaaatgacctttggatttggactatgaaggttgttggtgatcccgtgaaaagcagttttagtagagtggtggagatgaatccagactggaaaggactcaagagagaacagaggagaagacatatgcacaaggtttttgagaagcattgctgtaaagaggagcagaaaaagggtatgtggcttcagggggaagtgggaaatgggagaattttgtctaagaatgggagatggcaggacatgtttgtatattaatagaatccagcagaaagggagaagtcaatgatgtggagagaaagtaggtacatctacaggagcactgtctttctgtaagtgagaggagctgggcttaggggagtttcttcactacaacacagacaagtatctgattctgaccacggaatatcccgaagagcaaagacaggttaaagaaccagaaaggtcagctgggtgtggtggctcacacctgtaatcccagcactttgggaagctgaagcgggcaaatcacttgagctcaggatttcgagatcagcctgggcaacatagggaaaccctgtctctacaaaaaatacaaaaaactagctgggaagcatacacctgtggttctagctaccgggaggctgaggtgggatgaccactggagcctggaaagtcaaggctgcagcaagctgagatcccagcactgcactccagcctggacaacagagtgagaccttgtctccaaaaaataaattaattaattaaaaagagccagaaaggtgagagaggtagaaccccgaggatttacttaataacaacttgcataggaaaactgcaggagaaaaaggagtccaggatgactcctggtcaaatcactggcctaagtcacacactggctgcttgaactggacaccagcaaaagcaagagcttggcagatcatgagaagccagtattcctgaagagcgctccaaaaccagctcttacttttccagaagcactgggggtcgggacatcatggtgatcctcctccaataccacaccataatgatgaagatgctgggcgtaaggaaggtcttcatggcaaaccacaccttggtgaagcctccattttggtggatcccctaggcagagaccagtgataattttgaaggtgaatattatcttagcatttccttctactagcaaatgcttttgtgggagaggtaagtggagacctcgtctgcgaatgttcacgatcaagagctttcacattcatagcaggtactgccctcatacacccttggactctcctcagagataatagaaatacatattaaaagagccctgtgctatggacctgagaccagagaaataaagagggcatcccattcacaataacggctttcatgttctggggtctgaaagaagaacatggggctttggggcagggtcactatttccaagagacttcgaattatcttaccttggactcatcccactgatattaaaatgctaatacctaaagatacactttagaggtacggattaatagggcaggtatggattaatagggcatacagggtgtatgatatctacccagctaccacccccacagtgtaccccccaaaaaagccacatttgaggtagaaccagaaatttcaggtaaaaagcagagatatcctctatctcttaacacctctcttggccgtttaatcctcattctaccctcacatcttactaatctggtctactaaggctacaagagctttttccctatgctaagattacgattaagtacatgatcaattttttttgtaagcttttcattagaaagttgcagatatcctagatggtcaatatgttgagattggtaagtgttaaggtaaatctattctataaaatgctaatcaatattggaaagtatatttatattacattcaccaatttatattacatataccattaaataaagaaagcaaggaaaacagtcagttcaatatgatcctactttttgtaagggaattactacgtataaaaaaaagcctggaaggagatatatcaaaacctgaacagtgattatttctctaaatagtaggacattacaggtaattattatgcttttctgtgtctctacacaattcttgtgggactttgttgagattgaaaagaaatggcctccttgcagcaagttctaacttttccccaattaaacaaatatgatggaaagaacctaaaccacccctattccttttaacatttgtgcttgcaaggtgaaacacataaaaaagaaaatttacttttatctcagtgttattcattatgcaatcatgactatttcatgatcttatcatcattgtaatgatcttaagtgatcttaagcccatttaaaatcttaagtgggcacaataattgcattgtttcccatttctgtaatctctcacacaaattagttcactttatgatctcagccatcatgagtatgttattattcccatttctcagatgagacaggtgaggcatagaggtgccaagagtgagatggagttcccctccaatacacatgtcaagatcaattacattcacttaccaccaaccggatatcctttatctccccaattcccacattgattttcttcttctcattcacaggcagccggatgtttaaaaggtaaaacttatgggccacagacccaatttccatgaaaggaaggacatcacattcatagtaacggccctcatgctctggagtctggaaaaagagcagagggtttgaggcagggtcactatttccaatagactggctctgaattctgttaccctggatccataacatcaattgtaagcagctaatgcttaaaggtacactttagacgtacagagtaacaatgcatactggaggcatggcgtctacccagctatcccaacctaaaacaaacatcaacaacaacaacaacaaaaaacagctgtattcaaggtagaaccagaaattttaggtagaaagcagagataccttccttctatctcctaacacctttctaggctgtttaatcttcattagaacctcgcatcttacgaatcttgtctgccagggctacaagagtttttatctgcagtgtgttgtcagggtcctctaaggctctgtggaacagtcagcttcttaaacgttcaggtggaagctcttgctgaatcattacactctttaatgacggctaattattctcctgattttggcctgagggagaagctagaagaagctgaaaatatcttctttttattcacttgccaggaaaaaaaaagacacaaggagccgttggtatttagggaaggtcgaaacagaagaaagaaagataataagattagtggccagagatacccactaagaattttctgcctccggtgcttcctaacagtccaagatggcagaagggaatagaagttttaatgaaataagaatttagcccagtgtctaggaaagcctcttggacttcgtgccaaacaatttaagagatactgcccagagcacggtggtgggaaattggacagtagggagacaccttttttttgaaaactaaattctgctccacctcaccaggactcccggctgtgtacctgctgaggggtgggggccaggggtaaagatgagcataaagaggcatgagcttcagcaggccgggacttttccctgatatagaagatgagagtctaccatcaatgttgggtttctatgtcagcttcaatgtttccttggcacctcctgatcaagtgataggggagatctaatttgtcgttcctaagcctgaatttgcaagacctccataatttgtcataaatcttcagagcaaagatccactgaagaagtgagaagaaagaagataacaaagagtccatagtctaagagtatgtaggaaggggctaggaaggggctctgccccttctgagatcttggctggtggggagggttccttactgaacagtcagagcttagaatgcagtaaacagacctttgtacagagacagagacacacacggcaaggtagaggtggggaggtgcttctacctcctcttgcccaccacggcacacataaccaatcagtcgtcaacagtttttatccctaaggtgtgagcagctcttgtcagacacaccagttgattagagttggcatgtgagatttttaaaaattcttctgtagaaagaatgctgctttttcaaacctcagctgcaggtcagatgattcttcctatatagatcatctttctctcccctccactcctttctctcttatactttcaaatcagggaggatgggggctctgcaggtactactaaaagttcactgcaggctctaattctccctcagattaagctgcagtgaggaggctgattatcctctgtggtaacagcaagagggtattttctgatttgtttccagttagggccttattttattgatggaaattgagaacttgagggcggaagggaacaaaacctacttagtctaattccatctggtgtgtgtctcgcccagggtcccaaaagtagtagcagaattgggagaaggacatgggccctgcccaaaggcaggcattgtgctgtgataaagactcctgaactccaggccaggaggctgattctagtcctgaccatgttccttgctgggtaccttgggtcaccctgcctcatttggcctcagtttcctcctaagtgagaaagttaagtaagatgatctccagggtcacttctaatcccccacgatgggtctctgggtgccccacacttccctgtcactactgagtgagtaacatggacacccttgacacaaatttacctaagttcaaattaaaagagacacattggcatctgggacactggctcaaccttcctgtctcagagacaagttcgttgtatcctgttagagacttttcttcatgcactaaagtcctgcctctgccagtatttagggcatttaagaagattcctctctctccttcctttgccccacccccagttctcccccaactccagcatgagactagctcattaggacaaattacagcaggtggcaacttgacttttttttttttaacttcacaatccaccagggactcaaaagctttaaagcaatttctcatttaatcttgagactcaagactaaatttcactgcaatcaaaaagcagagacttgatgattcatttccttcgcacttttcaagatttaatatctttcttgcaagggatcaacacatcctaaagataattaagcattaagaagcagttgcaggcaaacacccttccccctcgctactcagtgccctccatgtgtataaatgagaaatgacttttcccttttctatggataaaattctgtatccgaaagccatctagcttagatgttcaaccagtatttcaaagatgcagtcaacttgcagagatagctagaaaggtttttaattttcttggttgcatgcaaagatctgaaaatgttagctgttcctctctcctgcttcctctagtttgtctatcattcatttctacctacaaatggctttctctggaggacagccctatatttagcactcagcagagggtctagggcagtggctctcaaacttcatagagtttaataaactgaaggcctgttaaaacacagattccttgctcctacaccctgagacattgacttaataggttctgggtgtgccctgggaatctgcctttcctaaaacctctcaggtgatgctgccactgttggttctcagaacacattttctgtagctttgttctaggaaacctgcgggagggagactcccctagtgtttcaaaaaacactgcaatgggtacttaggtttacccatggagggccttagtttatatgttttctcctagtggcccatctggttaatatccgctttgactctcaaatatgtcccagacaagatgttaaattagaaggtcatcctgcctacgtcattgtatcatctagtccaggggtgtccaatcttttggcttctctgggccaaaccggaaggaggagaattgtcttgagccacacataaaatacactaataatagctgatgagctaaaaaaaaaaaaaatcacaaaaagaaattataatgttttaagaaagtaatgaatttacattgggccacattcaaagccgtcctgggctgcatgcggcccgcaggcagagttggacaagcttgatctagcccttaaacagactcccaaggtaggtactcttatctcatcttgcagaagaaaaactgaagctcagacagattatgtaagcttacctgaggtcacaccgtcagtgataaaaccacctaatctttctcctctttaggaaaaaaatggctaaagctggggcaaggtactcagaggcttcaacctcatgtttttactattttgcaggaaatcttaacagtaataggcaaaagcaaagttaggaaaggcccgtggcaggagagaagaggaaataaaatgctccgcagagcaggtattaccaaagctgtcctcatgcgaagaagggacacacctatgaaaagtaagcaaatctttccacatacctgagaaccaaataaaaactgtcagcttagacagcaaggggtcataccttgggagatgtgaaggtgcatttgagtttccgtggtactctttcatgggccatttcagtccactcagcaaacgcgtcatcacggtaagccagggaaacgtccatggagacttctgcattttctcctgcaagagaaaggatgcacgtttcagaaatgacttttggaaagatattttagaaacagctcaaaaaattcttataggctttgacttggaaaccaacgagacaaaagggaaatattaatttctatcaaactccaaacctgaagacttagaagtcataggatgaaagtctaagccaaatgctgggtcccctctcatgtccactctgccagagtcaagagcctccatttaaactcttccagagacaggggcctcactctctctgagggagcacaaatggtcagacctcatcctcccataacttgtaccatgggtcctaggtctgcctgtagaagccacgtggaaggtgatgtccttccttcttccataaaaagtgccttatgttcttgaaaaccataccacatctgcctgcattctctttcctctctgataaacatgaccaagtttttcaaccacctctcagacacgtccctctggggctcttctctggtcacactctgtctgaaaacatccttctcaaacttattcccgaaagttctcaaatataggatttgctacttttccaaaagtcaaaatcccttcatattgtggatgaagttaatgtaaaaggcaaagtgtttttccaaaattaaagacttatacacagataggaataatacataattgcacaaatgaatgttcacacatacttccatatgtgtggactggaccacgaatgagttaaactcaccacagaactcattaaggagatgagattaataaaacattgcacctattaattttgtctgttttatactatgatgagcaagttcaagagcagagaagtcttttttttttttttttttttttgagtataaaggtttaattctatttaaaaagaaagtccattaaatcaacttcaagttcttaactcatgggactattttggaacacttctttgtaaatatcattttgttaggttattggcaaaacagtttcaaggttcacttccctcccttgaaccaggtccaggtcattttgctttggggtaaattaaaatcagaattctaaaagttgagcaactttgtttttttttaattgacttagctctaacccaccattacaacttaaggacggcatgacttgataatgatggacttgtgtgaggttttgagttttcaattaaactttgtatcacatgaggtaattgtcagcattcttgagtctggttatggaataggcagatagaaccctgtagtaacaagagttggaaattggctaattgacaacgcacttgccttaaacatctcaagtagagaacttttacattagtgagatgtacttgaatttcagaactcaacaaattttaattactttttactgaaaactgcagtgaatgctaaatgtctacgtttacaataaacaaatacagtaacagtaactcacactgaaacaaaacatacttctgatagccattatttttctgcttgggacaattttaaagtttttcttttgtcacaaaaacaggaatgtatccaaacaaaggctcaaaagaggccatcttttcaaacaaaaaggcaatgattcacaaaagactgtgaatagaacatgtaactagttgatacaaatctaataggatttgttaaaatcagtcacatctaatacatctgaagtgctcttgtataaaatatcacgtgaagaaaagaagactttatcaatgtctaaaaaagtgggtttgttcatagacaatctgacaagttaccataaaaagtgtttcctgagacataaggaaatgcaacattattcttcttgaaccgttttagctcaactttccactcaataaaacagcagaggatctgaaactgagaaaatgtatttgagtacaaacagcttgtgaaagttaatactttttttttgcatcagagggtttttactgaacttacaaccaacttgcccactcagtatgcagttcagatgtgagagatgcttctctgtacaggagcctgtactgtcttcaatcctatgcgagcaagtgtctaccacaggcaaacagttttctccccattttgtagtaatgtaattttcctattagcaaaaggaggtcaccagcccctgtagacttaagggactcaagtcacaggatggggatatcctcttaatattttttattttgttgtttgaactcttgatgcaacattgtagagcagggtgttcaggacctgctgtgcccaagggactgataaaggaaaaagctctatttattctttgtgatttgatgcacagatgaaaaacttaacacacaataacagaagttggtcgttaataaatcacatcctagtctttcagcgcttccgtaagcagacgacatcttcagttttctagctcttgtagttttaacactgcagcatcaatgatgcataagtccagaatcagttacaaagaccatcatattctttttctcttagttcatcatttttcactatctcttggtcccaaatgtatctgaatgattaccttccggcattctctgctattgctcgttggagtgctctcgattgtccccgtgttttgtgggctggttgggagagggcgcctgggaaggatgtgccactgttgggaggttgtgagtcactgggatgcctccagggatgatcccttccacggctgcaggaagtcctcctggagccacgcccacgatgcctggcggatatctgtatgtggcaccattgagctcaggatgaattgcttgctggtctattactgaccaaggcgctgatgtgacagagaattccttgttcacacagtttcttaagctttctgggatgtgacctgtgatggctcggcggatctcagtggcagctgcctccctcatctccagtgacgcctgcttgctgtaccaggcagtgtgaggagtgcagataagattcggtgcatctttcaacggaccctgagcaaagctaaagggctccgactcacgcacatagagggctgcccctcgtatcctgccctccttgagagcttgtgctaaggctttctcgtccaccaggccaccacggggtgcgttcacaaggaatgctccctgcctcatctgctttatggtaaagtcattgatgaggtggtggttatgttcgttgagattgcagtgcaaggagacgcagtcgctctgatacagcaaatcctacagagtgtagaccctctgcacgcccagggatcgctcgatcccatcctgcaagtaggggtcataaaatatgacgctgaatccaaaggccttggctcgaactgcaaccgcctaccccctgcgatcaaagccgatgaggcccagcatttccccacggatgctggccgatcccgaggccaactcgcggttctgctccatgctctgaacccgtgtgccttaccgcagtgcttggtacagccatgtgttcctctggtacagattgaggatgtggcagatggtagagtccggtgtctcttccacggctgcagacgggatattgcacacagcaattccgagctcgctggcagccttgatgtccacgttatcgtagccactgcctatctgcacgatcactctcggggccttaaacttttctaggtcctccctggtgaggatgatggtgtggtacatcatggtacccatggcttcgttagaaccttctcgtggatttcctgcgtggactgcgcgtcacagaaggccacagtggccaggtctttcaggatgggcatctccacagtgcagtcgcggccgtccagcagcgccaccagggggcaggagtgcagggggccgttcatgatctgggggcggataccttcacaaattctgtccaattgctgtctcttgactttgtgcttatccacaagggccatactttatggaactttgcaactctcagatcaaaaggcaaagcagtcctctaagaacttaggggaactcgcaggagtctccgtgcatgacgccactatgaacccactataaatctgtacacactataaatctgtacactataaatctatagttcacacgatgggctgtccgtctttttaagggaatacagcttcattggttcaaaaccatttaaggtgatgaaaccctcgtcccggacggtcagcgtccacggcaaaaggcgcccactctggaggccgcggtggcggtggctcccgcccctcccaccccaccctgcggcggtggcggtggcggtggctgcagctgtgcagcctcccctcagcgcagcatggctcccttttcggtccctcgctcctccgggccgctcccgagccaccttaaaatgacgctcgcacacagggacacacaacacaaaaacttaatctctccagctccccaccactccccctccctccctccgctaccccgctctccccaccctacccctccagagaagtcttaatgaggaaaaaaaaaaaaaaagcacaaatcacatttccaaaatgactggagatcctgccaccactagggttatgaaaatgggcacaattttaggctctggctattcagccttgaagaagtctcagtatccaggcacctgagtttgctccatacccacctcctccagggctgcgacaaggattaaaagtcaagttagtgaaagcactgcatgctgcctcatatgcagtaggtgcttaataaatgtttactaaacctgaacacatacaaatcacaagggaaacagataggaataactgccctctgaaaagcagggcttttctacggtggcttaaagctgacatggcagcatggcagatccctggttctcagaagaaatctcggaaaaggaagagatgatccatggaagaaggaatttgaggccattctgatatagaggaaaccctcgatgaacatcagtacccactattctattattcctatttttatcctcagttaaacatagtgaattagccactgtgttttcctcctgaaattccacaaaataaagacaaagacagtaaaaagaaaagcaaaagatattaaatcacaaggggaaaaaactaactgtagacacatgagcagacaagagatttcatttttttttttttaagacagagttttgctcttgttacccaggctggagtgcaatggcatgatctcggctcactgcaacctctgcctcccgggttcaagcaattctcctgcctcagcctcctgagtagctgggattacaggcgtgcaccaccatgcctggctaattttgtatttttagcagagtcagggtttatccatggtggtcaggctggtcttgaactcctgacctcaggtgatccgcctgcctcagcttcccaaagtgttgggatcacaggcgtgaaccactgtgcctggcctcaaaatttttttaaaacataaaaaatacatgaagtagggtttcctggcagccacagcctacactcctatagaggggatattctagaaaagtgagccaacatatctgcaggaacctgaagccactcagaatttgaaagtaccaggggttgcagaaggcagaacaaagcatggcactgacaatggggtgactgggtcaaagtctgcacacaaaactgctggacctcagttctcccacatcttcccatctgtgcaagatccaaggagagactctggacttgaggacaccaggggaatatgtagacccagggctggaggtggagaagagcaagagtctgtagaagaaactgtgccactcccagcttggcagaaacaatgttcagagttggtatctccccttggtcagggaccaagctggctacaacttctccccacttagtagcctcagtggtcaacagaaagaatcagtcagagctcccatggagtcaaatcttaggcaataaagtacatcctacttataacgctgggagtaggaattgggactttaaactgtgttgaaaagggtgcttggagaaacacaagagtataaatatgaaaagctgtaaaaaatgtcatcagctcacacacaggttacaaattactcacaggttgttctccttggagccatagggttcagagcaacactagccttagacacaggcaagaggggcctttgaagtttgggccccacacttttaaagggtcccacacttttaaagggtcccactctgtcaactgttcccttctttataggacaagaagactcccaagtgaaggggatatatatacccagagcctacagaccccctcacttctagaccacgctccgagatgtcagactccagaacattctgcctagacagctctgaactcttatcttacttccaaggtctgtgtggcctctttccaggtctggcttcccaagaagaactagacaaccacctgtatactcttggatgttcggtgggggtgggagtgaaaaggctgctatttgttggaagatatgaacagagcttgagctcggaggttagggtgtccatgtagaagcacgcaaggcccctctctttatgggatggagccagcggtggggagaaaaggggtgtaggggcccacacttcctgaccagtcacattttggcacagaattccaagtcgtccatgagtcctcaattcgaacctggccatcctgttcattatgcaagtaactcatcatcagaggatgcaacgtacttggcttaacagtttgctggcctgatttatcacttctaaatatttagacacatgataggcatgccttcattcatactgtttccccaagccagacaaatgtttgtagtgggcctggttcagagcaggtgcctcacagagacaaggctagataggattgcttccttgcctggtcccagcttcaaaagttattctaatctgttgaggatcctcaaaggaaaaactattttaaaatatgcggtttaaaatgaaaattgtgcacagtattttaatgtacaattactccatgttaagctcctgtggtttctgtgctttaaattacctcatttaatgttcccaacaattccatgaagtggacagaatattttattttaattaatgagtaaagtgatgccctcagatcttaaggaacttgtataaagtcattgaaattgccttaaaataaaatcacttttttggtattgcttaaagaaaactggctaacttgtgatagaagaagcccctcaaagcagtcacacaatatgaatatgctaagtctttaataatagcaacagctctccttcatcagaggctaacatgcaccagccttcttcaggcctcacatccatcctgggaggaagacgttatataaattgcccaagaacatatggctagtaaacagcagagctcaagtctggatcacgtaagggccccactgcactctactacctttgctggtgaaaacaaacaaacacagtagaattcaaaagaagctaacagctgaatcaagcatacttggtcaaagagccactcaacacaaactaaatacctttccagctttctacaggagagaaacaggcaatgttcctgggaggctgcaagtatggctcataagaatgtctggaattatctaatctaagctttctaaagccatctattgttggctgttaaaattatagcatgttctgccgtctcttcacgttaccatctccttacttcccgtgcaatctgaagcagaggtgttattcctgtttatgaggtgaagacgccataactcagaaagccctaccctagaaataccagactcaggaccctagagcttcatagccaatagtctcatagcatcctgccatcttttatgatgtacataaaaaaatagaaatcacagggagaatggcctgttcaagtgacctttactagactgtgatatcactcctcacccccagacagatagcacacatgaggtagcacaggtcaatcttagcagacctggttccttacctgttaggataagacttaacgcctagaatttcatgattattacactagttactgcatgaaaaatgctcaagacagagcagaaagcatgaagggtaaggtattgttgttgacattttattagggaagtgaaactcttatccttaattcaaaataattaccaggtttcaggaacatggagcttcccactatgaatccctaatccaaacctagatcacaaaacccagaaacgggaaagcactggacagaggaatacagtaaaactgcgaagctggttacctgaattgttttctcttctgcctccagtggacttggaaataaagttcagcattaatgatgatgttgcatttaataaaacactggtttcatgactcctgggatactgtgtgggcaatacttcccctccaccctccagagataatgaaggcgaggaatccaatttgaactccctgggagaatggcaggaaggctaagctacatttggcactatattagaactttccctataaaacaaggacactggttatatcagtttcatgggggtacagttgtaaggtatcagcatagggcatttatagatttgaaatccatggttttccatacctatactataccagcagctttggtatagaagcccataggtcctatgggctagccaagcttcacatttctcaaatagctttggagacatattttagttgggtggagaattcattcagaggaggaagggaagtgtggaaaggcactgtcgttcgttacacttactatttccatcctgttatgggggcagtttcccctatgctccagggttccataggagcagacctagactgcaaagtgtggttacagacagaaagatccatgcctttccatgttgggaagcatcaactaattgtatccttaggaagtctgtctctataccagttatactgccctgccctgcttgagaaaagcaaagccaatcagtttttctgcaggcaagtggaaagtcagagaggagggcaagtaccttctataagccagaaatggtgggaggggggtgctagaaatcgctaggaaagaggtctagtgtccccaagaaatctagggcagctgcttaatgtaagaatggtccctggggtgggaatgtggggagaaggaaaagcaatgaaaaggccactagagccttaattgaggaagacatcagaatgcttgtcacctaagctctacaccttctatatttgaaacaggtatttcccagccaggatagtacaaagtgtataaattgggcaccaaatggatgtgattttgaattctccttttatgacttcccacctgaacaaccttgaataagtctcagtttccacctttgcagtatggaaacagtgggaactactccctaagtctgttaaccaataccagttccttctccatctagtcccagggtggctgggttatattgttgacctattaactggaataaaaggggaaaaaggagaggacaagatatattagaggaaatcaggaatgattttatggttgtcaaaagcttttaggttcctagagacactttgactttcctgggcctttgccctgggaaaaaaattaaagaggtttcaatgctcgtgtgcattcccacattacataggggagctgccagtcaccagagtttgtttgggtaacctcagaaagaggccacagagacaaatctcctcccagcctctggcagacatataatctggagttatttatgccagcattccttccccaataaaaaactctctgacctggcttgaatttttcttgacgctttcaattaaggaaataacaaaaccaaccctgtcttatacatggttaggtctggcaaaaatggactcagctaattacaaatttggccctggcggttttcttaagatgccctacaggcctgggtgtgagtggttataaaaatgaatgagtacaattattttgcaaaccagcctaacagtttagttcacattgcttctcgtctttcctcatcaaatcaagcatttgaattgcagagaattatcttccacatgtaagaaaacatatttctaagcattgcaaaactggttccttgctgtattctgatgcattatcatctggttgaagtcacatatctgtctatggaacatgacaaggacaagggagaacggtgctcacattaggttctcttcaaagtgacatgcagttagaaaacatccacttacccctattgtagccaaggctactagtacttaaatgctataccactgaaaaagtaagtggagacatcaatttttttaaataaatgaatctgaagtaccaccgaatatagaaaaaaaccatatctattgttcaccaggttggagagtagctctttcctcatctaactcaacacgttcaccctgaaggatttcatctgctcctgggatgcaagtcaccctctccagtccagatttccctcttgatatttgaatttgcatgctcacttttcaccagtctctcctctttcatggtttagaaatgcaaaccaccaaatttggtcaactctactaggtgtctttcagatttagcctcctctcctcactgatatgccgcttgttcaggccaccattatctccagcctccatgactaaaacacctgccctgttcctgtctaattttcacacttcctgctacagaaatgatttctaaaacactttcaatgcctttatattgtcttcagtgtgatattaagactccttaaatggcataattggctaaggtgttatgtagcagcctaggttctagttctatgaacgttcactaccccttctacctaggttggccacttcaaatacagcccctctcctctccagccttggaagatgagtaagagctcagctttggagacagacaggctgggaccacagcccaccttagctacttggtgcctatgcaatgttgggagtcactaaatgtctctatctgtaagatgaggataatggtaatggtaatgcccttctcctatcactgtgaggagtaaatgagataatgggtgccaagcactcagcacaggcctggcatatagtaagcactcagtcaatgctggctactatttcttttttttttttttttttttttgagatggagtttcgctcttcttgcccaggctggagtgcaatggcacgatctccgctcactgcaaccttcgcctcctgggttcaagcgattctcctgcctcagcctcctgagtaactgggattacatgcatgggccaccatgcctggctaatttttttgtatttttagtagagacggggtttctccatgttggtcaggctggtcttgaactcccaacctcaggtgatccacccgcctcggactcccaaagtgttgggattacaggtgtgagccaccgcgctcggccgctggctgctatttcaaggctagtactcaaggttatctacacctgctgtactcagggtccccataatcacaccaaattttatgaagagatgcctcctttgagagggtaaattacaaaaggcttctttatctgggctgcagacagtgcttggcatccccgctcgtgccagactcctactcatcttctggaattccccccagatttactcttgccttcttttactcacccaaactcaatatggcaccccccccttgctcccacagtaccttgttcacccagcaatatgacacttatgacacttattctccatgttgcttctcctgactacttatccccatctctctccctacccatctcctatttaggctgggttcctaaaagccagggactgactcagtcttgttcacagttatatcactcatgtctttgcacaatagatattcattgaatatttaccaaattaatgattatcatccttctttctccaaataactcttacaaacctaaatttcctgtcactctaccatcaaacaagtggtttgctctatattttggtgacattcatactttctttctccatcacctgcctttttacttctactccccccaaacccctgcacacacacccctgaaatccctgtgctagatggaccatccaactctatttttgtttccaccaaatatttttgagcacctactggtgtcctcgcacaagattggatgtaaagcctaaaaccataaaaaccctagaagacaacctaggcaataccattcaggacataggcatgggcaaagacttcatgactaaaacaccaaaagcaatggcaacaaaagccaaaattgacaaatgggatctaattaaactaaacagcttctgcacagcaaaagaaactatcatcagagtaaataggcaactacagaatgggagaaaatttttgcagtctatccatctggcaaagggctaatatccagaatctacaaggaatttaaatttacaagaaaaaaaaacaaaaaaccccatcaaaaagtgggtgaaggatatgaacagccacttcgcaaaagaagattctaatgcagccaacaaacgtgaaaaaaagctcatcatcactggtcatcagagaaatgcaaatcaaaaccacaatgagataccatctcatgccagttagaatggcgatcattgaaaagtcaggagacaacagatgctggagaggatgtggagaaataggaacacttttacactgttggtaagagtgtaaattagttcaaccattgtggaagacagtgtggcgattcctcaaggatctagaaccagaaataccatttgaactagtaatcccattactgggtatatacccaaaggattataaatcattctactataaagacacatgcacacgtatgtttattgtggcactattcacaatagcaaagacttggaaccaactcaaatgcccagcaatgatagactggataaagaaaatgtgccacatatacaccatggaatactatgcagccataacaaaggatgagttcatgtcctttgtagggacatggatgaagctggaaaccatcattctcagcaaactaacacaggaacagaaaaccaaacaccacatgttctcactcataagtgggagttgaacaatgagaacacatggacacagggaggggaacatcacacctgggcctgttgaggggtggggggatgggggagggatagtattaggagaaatacctaatgtagatgacgggttgatgggtacagcaaaccaccatggcacatgtatacctatgtaacaaacctgcacattctgcacatgtatcccagaacttaaagtataattaaaaaaaaaaaatactcagagaagttccaaatgctgtatataaataaatacaaatcttatatagaaataggatttggaactatatacatgtatataaacataaaaatgtatgtttatatatgtctataaagagtgaaacaattaaacttcttctataaaaaaaagagtagggataaaaaggcatataaggcaaagtcattgccctcaaattgtttacagtaaagtggtgaaggcaggtatataaataagtataattccatgtagtttgtactgcattagaagtatatatgaagtatacagtcagcacaaaaagatcaagagttctgagtagaaggtcaagaattgtagcacagaagacacaatcttctggctcaccctactgagaagaggtgatatttaccaatgaattgcagaataggagttcactaggcagcgagataggaaaaggcattacaggcagaggaagccccatgtataaaaagtcacataagcacaaaatagcagggaaagcaactaattcaatatggcagggaatgtgagagggactggagggaacagggaaggctagagaacaggaagggtctaatgacaaagggaagaagcttgccctgagtgctgcagcattttgcttagaggatgttaaagcaaaggaggagattctggcagctgtgcggaagacggactgggatggggggccaggtagacaaagagacatcctaaggaaactgaggcccactgctaacacagttctcagtgtgcttaagacgatttaaccttgtggaaaatactgccaggaggatattttctaaggaatttgtttaccaaagaatctgaacccaatgatgaaccaatctttcgctaacaaagctagagaactcagaaccatctaagttagcaagtgttaaaacactggaaagcaaatgtggcaacagcactttcctatttgaccataatcaacatcaatgtggaaagaaaacaaacctgaaagcaagtgaggaaaacacacagtgggtttctttgctttctctccaggacactgtcagtacacagagcatttagaatagctgatttgatcgttgtgaaaatctacctgcgtgcccctctctctctctctctctctctgaatgcaattagagaagacagcttcattcacactgtgtctaaaaatagatgatggcagagttcacagactgacagctgcattgtcatacagtaaccaggaaaggaaagggatggctaatttaacttaacaacttccaaaacaaacagtgcagagggagtccaggataaagaaaaaacacacaggtcagttcttcaaagagctggcagagggatggggtcgctccatggcagtttattagtcctcccaaaatcctgacgaaaccagctaagtattttgcccagatctacccagagtccttcagacaagagctctggcagatgaaccgctacagagattcaggcaatattaggcagcagggccaggactttccctgctgacttcttcatacatcccctggacacaagtaagctaagaagagtcatgacgtttttctaggcaagataaataaatgagttttttccccctttgccatatctaaattatactctgcctagcctggggcatttaaaaaaaagttatccaggaaataaacatgcatcattaaggggcagaaaccaggtgtctaaaagaagcaaaccatttctttccctcccttcagtcctaaaatgttttctgttttcctcctcagtctgccttgcccagggaagggattacggttgggcttcaaaagaaacaagggaataatgcctgtggacgggtagcagattctctctgcagctctcccgcagctccatgttggctctcagcgctgctgccagccagctaaatgtcagatcacggcaccccaacattccctcactgcatacctccatcgccctggtgactaagctgtttcaacagctgtgttattgctggagtcaggccagtgttattcacacgaagtatttgtttcatacggcttatgtggggaattattgcactcagctttggggttctatttaaagataaggtccttcccttgatcaatcagccaggacattcctcgagttgggctccaggagacagtgggacaatattctactgccacccggggttccagataatggacagattcataatactataaagaaggtggatgaagcatatgtgtgtgtgagagaatgggaagcataatggaaaaccatgacccttggtggagctgcggaagaactctgctgctcctccctcaataaaagccacccacaacacaagagtgttaagctggactccctttctgctcttcttctccagccatcaccctcagcctttcccttaaaatcattgctctttcctttcgggtcacgctagcactgttgcgttggtctctacatgcatcactccacacacctgccccgaatgccatctcctccctcagcccttggcttctcctatctcatcaaatggtttatgaccattgatgttcctatcatgtaggaagcaagttgggcctgttggcctggtgacctcctccactactccacatcctcttctgagtgtgagtaagataagggctgtgttactaactgctgagttaatcaacccaaactcccttatatggagggacaactgggaaaaggaaaaggcattacatccatgagctttatgtcctgtaggtgggactaatttctatttctagctcattctaggctgaatctccatcaaagaggcctactggcctgttctccctccaaagttgttctcaccaagagcaatcgggcaccattttctgatgctgaaaagatctcagaaatatgttttcttataaatgaagtatttttaaaagaaataaaacaatgattcctaagagctcacattttttactgcctactatgtgtagacattttcacccatgcagatgccagccagatggaaaccatcacaggcaatttcaaagtgaggaaactgaggcccatggccatgctaccaatgtgagagggaggcaaaatgagaacccaggtttgcctgactcagcagctcaagtactttccccttatgtctctcagtcatggggtaggaaagttaggacacccgcttcttgctctaaaaaggccactatttagccaaacaatttgagtaagtcactttacataatgtattatttcatgaaatactacagttggatcataggcttactaagatcctttctagttctaatatttcatgaatgtagaaatctaaaacacctccagctgttgactgccttctatacttaaggcactgaggccaaaacaaagagctataaaaccatgcctgtcctcagggcacttataatggagtttgagtgacaaaggataacaagttgagtttgactaatggaagagttaaacaattaacaaatacaaaaataccagagaaccagactacagggcagtgcttgagaaataacaccgcataccagcatgactatacaaggagaaaagtagatttcaacaatggtaacacccctaacccggaaaatacatttgtgctgccagcagaaagaaaagaagagacagaaaacgcttgcaggaaaagccagctactagaagggatcccgtctgtttcacaggaaagctttgtttctgacaagtttcgtaaaggaaaaagtaggctagaacaagcttttttatttccaacccaccttttcttcgttcccatgaatgaggaggggatacaaatgagagcaggcagccagggacaaaaataatatggctggtggttcctgacctcttggattcctgccaacagagaagcctgagaggcaacatttaattgtggaaaaaccagcctggctctcctcttatctttttcctctgtgacttaaacccacaattactggcaacccctagattccgagtcacccagctggtggtggcagcaatggctgtgtctgtagctgaaaagcaaaagggagtcagattttacctgcctccgaagccagccctgggagcacagccctaacccagcttgatgacttctcccattaaaaggttcacagatgccctcccgttgggaaaaccaccaagtgagaagtccagatgggaaaaaaagaaacacgattttcagctgctgtataattcaaaggacaagctacgagtctcaaatcctgaattccacattttatttcagcactagagatgtgatgttcaattccttttcttaagaaacaaactccaaatttcttagctggtcatcaaggcaactcacctaccaggccctctgtctttcagcagctcatcttttttctctaatatggacacttttctacagcccaacaaatgggcttaccgtcctttgcacatatgttatttcagagcatttcatgatagaaaaatatggtcttagtcctcactttctcacctagaaatcactttgaagaagtcacttaacttccataatttcatacttgtttaaatttaaaactttttctccagtaacagcctcacagaggacagtagagatttaaccttgaacatctagcattgagcctgcagaggagatgcataatcaacgtttccttctctatacctaatgcctttgctgagttaccttcatccaaaagaatgttcccattgctaactcttgtcctgatcttttcttaccactcttccactccaagaggttgtctcccatacacctctgctcccatcttaatattcttccatttcaaaatattttaatttacatgctgctatgtttatagtcaaatataattaaatcatgcctgtgggcacattctcctaaggatgctaagaattttccacatcttctattttaggactttatccaattgcttcagtgctgatcagcatgcattttggtactcatggggcataccctcatcgggattcataaacctctgaattccatgggtgagcttcagggcttccattgaaatatgaatactaaatgtgcaaatggggtctatgcatatttgtctcccaaggttaaagtccttgacctgaagttaataaccactgtccggaagtaatgaaaggcctgtggctaacatccatggacggggtcctttttctgaacactcagccctgccacctatgtttctgggcttctatgctctctctggaacacaattcctcctttctattcaagtccgagaataataactactcactcttatttatttatttagagacagaatctcaaccaggcaggagggcagtggcgcaaccttctgggcccaagcagtcctcctacctcagcctcccaagcagctgggactacaggggcacaccaccacatcctgataatttttgtattttttgtagagacagggtttcaccatgttgctcaggctggtctcgaactcctgggatcaagagatctgccctcctgggcctcccaaagtgctgggattacaggtgtgagccactgcgcccagccaactattcacttatattgagcatttactatatgtatccagcacttactatgtaaaagcctcacatacactattctagtttaatccttacaacaaccctataaaggtagtactactattctattttataagtgaggaaaatgaagtacaaggaagtttcaaaaacttccttgccaagggtctcataatttataagcagcaggccaaacattcataatttatgattcagcccaaacactctggcttgaaagtacttaacccagtgctggagttgtctctccaagctctttcactttccagaaaaaaataagactgcccttggactgtttctttgccttcacattgtaagtgatcacagattccaacgcctttaaaactccacctttgactcaatcaaaacatttccttttccgtgagttaatcatttccccttctatgtttatggactcctttgggtacttaatgcactgaacacactggtgtaattttttaattctctctccatgaattagactgtgagctcctaattattttgagtacacatggaatatttactgtgcctggaattgtgctaaggatataacaatgaacaacacagtgtccctgcctttaaataattcactcttaggccaggagtggtggcttacgcctgtaatcccagcactttgggactttgggaagccgaggtgggcagatcacaaggtcaggagtttgagaccagcctgactaacattgtgaaaccccgtctatactaaaaatacaaaattagctgggcatggtggcacacgcctgtaatcccagctactcaggaggctgagacgggagaatcacttgaacccaggagggggaggttgcggtgagccaagatcacgccactgcactccagcctaagcaacagatcgagactacatttcaaaaaaaaaaaaaagaaaagaaaagagaaaactaaacaaaagagggttatgatggtttctgaaattgtattatgaagaataaggacttatctttatttcttaaatcctgagcaaaatgctagcatgtagtacaagtcccaataatgcctatcgaatgaatgaatgaaattgggaaagggttttcagatactgaactgctaaactgaaagatctaccatcccatcatgaaactctttgaggttatttatacactgactcacctaaaaactgcttcctgtgttggtgtctatgatacattttttaatgtcagactaaaaatacacttccagtacaccaaccctgtctgcctacctaaggagtagaaatgaacacaaggtcgcatgtaacaaaagaaaagaaaattcactcatttcaacactaagctcaccctctaacaagagcatctgtcttgactgagcactatcttctagaatggttttcacttgagggtctctgaagtcatctatttacaaaaccaaaggataccaatgagattttttataaagtcagagaatcttaagtgagtcatggactctcaacttcagagagttagagtagatgggaccttaggggtcgtctagtataatttcccactcagaacaggaagcactccatagccctgtcaatagactcatggtgggatcaaggcactggagtcctaacatcatgtacactcatagcctctcgacttcccagctgggagactggcaaatcatgtaaactctgtcatcctcagtgtcctcactctgccagatataattgttccgatgatcagatgaaataaacgttgtcttaattagcgaacatttgtttgcaagtaacaggacttcacccccactaacttaaccagaaatcagctggagggatacaggagtgctttaggaaaatcaagggcagaaaatgctgagaagctggagggtctgaaaccaggaatagaaagctgtcaggaggaaagtcaactcttatagtctattgtaattacactaatagtcttcatctccatttcctctttgcatctggtcttcccactctgccagtcaacaatcacggcttctctgtgcacgtgtagaatgatgactgcccaggtggctctcatggcttttcagtttaagtgctaataaaggtagatctcgaattactgaaacacaatttcttataagagagaatttgattgcttcccctttggccaagggaccactgctagtctgatcagttatggcttggggactgatcatatggccagttgcccattcagtagaggtggtggaacatgctgagggagggggaagttaaggccaagttcaggccaagcaaatgactgacaacaaagacaagcaacagcatctctagtgcgatggtactttgcaaagaaagcactgccccatgccagctatcactgtggccatccttatgatcctcaccaaccatcttctgcttgaccactaccagtaacaggctgctcactactggtagaggcaaccttttcatcagcaaacaacttcagctattagaactcttttccatgtgacagcaacttaagatactaaactgaaatatttgtaatcttctcccaagccttaactttaatgaaggcataatcttgcttgttaggtcaagcctgggcttttctttctagtcaaaatatgaataatgggcaaagcaagatgttgaggaaaagctgagtgttgggagggaaactgaggcagggcttgcataatgtctttgggaatgtgtctagacttgctggttccttacttctagccctcataggctcctaggctcctattcccattatctcaagtagcagaacatgttccatataaatgctaaaccatcacagctgtagatcatgtgcctgctcttttgacctccacattttcaccacctgtttctttgttggattaccaataaatagcatgggctcccagagctcagggccttcacagcctctgtacactagtgatggccccctggtgtcccaactttctctctcaaactgtctttttctcaatcctttgactctgctggactttgtcacccccacaacctggtgttgggtctgatcaccccaacacaagagagatagattcactatgcaattattttagcaaacaacctggaccagaacaaagccagaacctcttcttcctataaagaattactactatctctctactaacaccattactaatgactcactaaagcaaaagaggatctggaactgtttctagcatcagtgtgtagacaataggtagggttggggaaaatggttttttccaatgtagagtccctagcacttttgcaagcagaattctgccttgctctcatttaacttccttttgcttagaaaaatataatccagaaaataatcttaacttcatttttttaagttaaccaagataaagttgtgaattccccataaaagaacctcataatagctatgttatgaccagctggcatttaaatactgaaagacccaaagttagaagaggaggtgaaaacaaaaaaataccttctatacattgggggcaccattaagggatgtgctgcttctggcttctctgctcttcacattagtcaatgatgtcaccaggtttttattttagtaatcaggatatacttgtatggatgcaaagagaatatcctcatttatattctaaactcagagcaggaaatgagacacgtgggtgatctgcagctgtggcactataaacagggccagcctaccacctagtctagattctagactgcacttcattccctgaaatactgattgggagattttaaaaaattgaaaatatatcattttagaaagaccagtgcatcttctgtgcaaggatcttagagtccgctgtttggtagaaggctgactcacctgtatggggtggtgcacgtgttgttaggtaccatctacctatctacaccactgatgtacaacgaggagatcctgccctggctccagccagctgtgccaccgtgggcgagtaccacagagttcaagctttctccagctgctaaattaaaggattagtgctttaacttgggtcaaccacccatttgcaaacctgacaagaaccacaaacactcttacttcaaaaatgcatataagcaaataccactgaaattttatgtagagtatcaaggggttctcttagcccttacactccagtctaaactgcttggttgatgattgttagaccagcagccctctagtattcctttcagcactccaagctaaaataaaacagctgatgtttagtaacaatttctgcaaattattcaacaccatagaagagtgttttgttaagactagagactaatctaacacaatctactcaacaatgttaaattgaccagtaaccaatagatgactagaagaaagtgtatgtaactagatataccaaactatagatactaattttaaaatcttggaaaggttttggaggagccctactgtttctgaattggaatttttcatttgcaaatacttaacaaaacccaccaagccagatagagctctatagcgatgcctatggaggagccttataatgatgttgtccaagtaatgtgcttaacaataatcacactcaaagccaaaggttcccatgctcctgccaatataacatgctcacaacggtcaattccaaaggaagagctgtcaagaagtgcctgaagatttcctcaaagggagagataattcatgagcaaacaaacatcatgtccctaatcttctctatcctggggtaaacaaaatatagttttctcccatgatttcagttgctttctataccaagtcagtaagtaaaactgattcatactggtaacttccaggttccagccttggtttgaaggggcacacaattcaataagagtaaagaagactggccatgtaagcccatcttgaatactgacaacttccgtaccatttacctaacactacaaaccctactccatttaagtctctgagatctttttgatgtattttgagcttttcaacttgccttttttggtgggagaggagggaggaggagaacaaagggagaatttgaagtttttatttctgcttgcattgactcaaattgtggtaaagaaacttaaaaggtaactttaaaattctagtgacactagccaacaatgaaaactatctaattagaatgttagaggttttttttgtttgagacagagttgctctgttgcccaggctggagtgcagtggtgcgatctcggcttgctgcaacctccacctcccaggttcaagtgattctcctgcctcagcctcccaagtagctgggattacaggcacacgccaccatgctgggctaatttttgtatagacagggtttcaccatattggtcaggctggtcttgaactcctgacctcaggtgatccacccacctcagcctcccaatgtgctgggattacaggtgtgaaccactgtgcccagccaaaatgttagatagttttaacacaggctataacatagtcataaattaaagaagacatggtcgtaaatgaaagaagacctctttttggtgggagtagtagtaggggtgggagagtagagttatacatttcttcttagcagttgcttcaacatattttattaataaggactatctgctgaagcacagaaatacaattatgtgaatatcatactaccaatggcctgttccatcatagcagggatagttcttatagtgtataaaatcctctgccccattcagctctctttatggagctttcctcagaagcatcagaaaacacagaattaaatatcacaattcttgttgaaggccaaaaattagttcccagaaggattctttgactttcatccttctacaaattcacccatcaccattgtagataatgtgaggggtgaatttgtagaaggatgaaattcagagaattgtttatgatcaatagattgttccctttattccagttgtcttcccttgatgtccacttaacattccataataaatggacaaatggaaaagcacaattactctgccaaaagtcagtcaacattctcccaggacactcagccatctaacttgaaaactgactggtaataatatcattctaattactttaactagaaatttgttatacagaaatgctttcagtgtggggaaagaaaaatcacttgccacttatagaaagaattctgcttcatgtgaccatttgcaataatgaaacaagtaagacaacactgggttccagtgtacagcacaaggatcaaggcgaaacataatgctttcattacgtaagaataggactgacattattctggctttcccctacccttcatcatttaccaatattttttcagtctcaggaatttttcaacccctgaaactcctagatttactactcaagacacagctatccatcttgaggctttctgccaatggctctagtgcttctatttcaacagcttatagatttgaaagctggaaagagagatatgtaaacaaattctctaactttgatctatgcacccaggtttctcaaaagaagcccttggagagtctggggtatactaagtgtatgacttgcagttgtaatcattagagtgacaacccatttccagtgggtaccgttttagccaacccaaacctttcttttcctaatgcatagagtgactttttaaaaaatggtatatttgggaaagtattttagaatggcatgttaacaaaacaaaaacactctagaatatattttcaaataacagaacttggccttaccaagaggtctaataccatcaggtaaataatcatttttatcagtgattcataatacatccagactctaaatgttaaggctgacttttttctgacactcttctctgcctattcatactccatttcctaactcctttagagtaaaaattgaaatcccatatccctaacaactagacagaagcatcatgtttacatcctgacaaattcattaattctgtacctctgaaatatttagcaaaaagccagcactgactcaatcatagatttccacagacaggtctgttcatatttgtaattggtattcactgaaaggtcaatgactcctgttcccaagtatctatgagtctctagattttcttaattggcctcttttcctcagctcttacagactattgttttaaaactaccaccatttagaagttgaactccgagtgaggggaaaaacaaacaaacaagcaaacaaaaaaaacactttttgattcccactccactcataatcaacataacacagactacttctgacccaggtgtgatggaaggagcggggcacagagtcgggggaggtttctccacacaccaagcaagcaatcaatcacttccacagcagacatcagctgggtgtccaaaaattcaattttgacaccacttacctggaaatagcatcaagtctcataggttgaaagctcagtcccataagactgctccccacttcagatgcccatcgaaaaaacaggttgtggcctgttataaatacgcgttcccatgaccctcctccttaggattgattgatttgctacagaggctcacagaactcagggaaacacttaacttatgcacgttataaaggatatgacaaaggatacacatgaacaaccagataaaagattgatagggtaaggcatgtggtatggcagggatccctgaccctctggcagcagacaggtaccagtcagtggcctgttaggaactgagccatatagtagggggtaagaggtgggtgagcaagtattatagcctgagttctgcctcctgtcagatcagctggcattatattctcataggagtgggaaccctattgtgaagtattcatgcaagggatctaggctgcatgctccttatgagaatctaatgcctgatgatctgaagcggaaccatttcatacccaaaccatcccccatcccctcatctgtggaaaaagtgtcttccatgaaaccggtccctggtgcccaaaaagttgaggatggctatgataaggcacagagcatccctgtcctctctagggtgccatgctccgggaacctctgcaagttcagctgtctggaagctcccagaacccagtccttttgagtttttatggaggcttcattacctaggcatgactgattacattattggccataagcgagtgactcaatctttaggcctcttccctcctggctgttggtgggtggggctgaaattagttccccacccttctaatcatgccttggtctttcaggtgaccattctgaagctatctgggagtccccagccatcagttgactcattagcatgcaaagaggcattcctatcactcaggagattccaagaattttagaagctgtgtatcaggaaatttattactataaagtaccttataatgccatcatttttctcccaaaggcactggcttgattaaattcagaaattaaaacaatggccagcttctatagtgtaagtcaatgcttttctagttttctgagggtttggaaactcaaatcctagctaaaacctgtatcacttttaaattgaaaaatttaaagggaataaacatttaaccccaagtgactagaagtcatttaaaatatgtagtacttagattattttatctactcaaagactcttcaaaagtagatgaaaacactaaccagatatatattataaacccaagctttaatttcagagcccaaacatgaaatctcttctcattgtttgaaatctgaaactcatttcaaagactgccacgaaaagttaaaaaaaaaaaaatggattggtcttgacttttccttacatatgaagtaatattgttacaggtgaatctctgataagcaggaagccatcatgtgtaataggatcttgtttgccacactcccaaactcttctctgaagtcctgttcattgctgtcagaaaggaatccaaagtaatgataaacaatataaaaagtagagagtctcatgcattcttaataccaaaatcagagagaaatctagacctgatgtgcctgttatactaaaacatgtgtgtatatgtatattgctgaatatatataacataatatatataatctgtataatcaatgccttgctcagtgtccataagcaaaggtagagaggataaatttaaggaaatgaatattcccacaaacacaacatgtaacttctcatataatagttagcagctggccaggcatggtagctcacgcctgtaatccccgcattttgggaggccgaggcgggcggatcacaaggtcaggagatcgagaccatcctggctaacacggtgaaacctcatctctactaaaaatacaaaaaaattagccgggcgtggtggcaggcgcctgtagtcccagctgctaggggaggctgaggcaggagaatggcatgaacccgggatcgtgccactgcactccagcctgggggacagagcaagactccatctccaaaaaaaaaaaaaaaaaaaaaattagcagccaaaatgtgttgctgctactcatgaaaagtattttttggtgtggttttcttgatagctctattaagaaagttattttatacatttatcaaatgaataattagtggtccatcttgttaactttttagtatgccccctattaagtgctagttctcatgttataagaaaattaaggattatttttaagtcagaaagcttgagtacagtatttttgtagatgaagataaaatattttaaagcatgaagatgtacatgagaaaaaaataagacattaatatttatatatagaaatgttttaaagctttgccaacatgggcatttttgttgtttaggattagtatttgctgggaagtaattcatctgtgaaattatttaacatgtagaattatttcttagtttctggtttgggagaaatgctcaagagttgagcttaaaatcattttattcacactgctaaagctgaaaaatgtaaacagggagctttcaatacatttcaaatgagtttggagaattctaaaatattcaatccatttataatgaatacaaaacatcattagaaactggcaaaaaaaaaagtagctaaaagtattcgagttatttcacattactgggaaagtttcttttaaaaagttcagttataaataacattcactaaacatatttatccttttttcaattttggtggtataattttagaaatttatcgttgacttttaaaatttcacctaaacttacctgaggctctgcattatgttactcaatgattctgatgccaagttttgaaatcaaattataggccagtcaccttcagtgatgtaaaaggtagaaccacaagataatccagcactttcctcacaacctgaaaacggaacctgtggcaagtacctgcccaagtgtcagactatgctctaaacaactgcctgtcatgtaacaggctgctcgaaagcagcaacatactactcctatagtcaattcttaacttcttaaccacaatttcatcagtgtaaaaaatataggagcagtggggaccagacttacatatactgaaatgttaaacaacagaactcttattttgaagtgtgggaggggaggaagcacctcaatcagttgctttatgttccttttagtggcagaagaatgatacaatccagtattttcatccacagctccctaaacacaaagctgtggatttcataaatgtaaatatactgcgtaatctgcccactgggagttcatagtttagtaaggactcagagaagacaatttcactgtgcagaacacaaggctgataaagtaaacatcacaaggccagtaatgaagaatgcgtaaggaaagacagattatatccaggaaggaatgaggacgggagataatatagaaaatacctaggaaggctccaggggaatgtaaaatttgggatgttgtgaagaatgagtaggtttatctgggaggagcccttcatttgtgagaagaggaatcacaagagaggaagaggcaggcaggatcaatatcagcgaagacgcaaagggagaaactctctggatgtgtttacagggcaggaaactactccttttgaggatgcagagaatggttactggccagcagtgaggaaggaggctagaaagaagccttgagccaggaagcgagaggactctgaacaccgagtcttatttgttagtcactgaagatgttttgagcaaggaaatgataaattaaagctaaaagagtctcctccttatcagaggtttcaccttcagtggtttcagttagcagaggtcaatcacagtgtaaaaatattagatgaaaaattccagaaataattcttaagttataaattgtgcactgttctgagtagcatcatgaaatcttgtgctgtcccctgataagaatcacccctctgtccagcatctccctgctcctgcctgttagtcacttagcagccatctaggttactagatcaactgctatgtattacagtacttgtgtgcaagtcatccttattttctctcattgccccaaggtgcaagagtagggatgctggcatttcagatgtgctaaagagataagtcaagtgcttcctttaagaagatgaaagttctcaacttaaaagaaaaaaaaatcttatgctgaggttgctaagatctacaataagaatgaatcttctgtccttaaaattgtgaacagtatattttttctttcattattaattattgttgttatcttttactgcacctaatttataatttaaactttattctaagtatgtatatatgtataggaagacacatcatgtatgtatatagggttcagtaccgtgattttaggcactgggtggtcttagaacatatcccctgtggataaggaagacttacctctaccacgtgcttcttttataaagactaatctcactaaccaaggtgtagaagtaagaattggaaaaatggctgaatttcagcaataaggataaatataattggataattgtaatagctacttttaatttttaactgttttaatagtacttactatgtccaggctgggtgcagtggctcacacctgtaatcccagcactttgggaggccgaggtgggtggatcacctaaggtcaggagttcgagaccagtctggccaacatggcgaaaccccgtctctactaaaaatacaaaaatttagtcccagctactcaggaggctgaggcaggagaatctcttgaacccaggaggcagagattgccgtgaaccaagatcatgccaccgtactccagcctgggtgacagagcgagactccgtctcaaaaaaaataaataaaaaataagtacttactatgtcctaaaagttttacataaactaatttattccttagagtgagttggttaattaggcattattatccatattttacaagggaggaaactggctaagagcggttctgtaacttccccaatactgcagagcttttaaaaagtggcacaaggatttaaacccattgctgtaggactcctaagtccatgctcttaaaaaactttctatcttaccccctaatctagatataaatcagggatcacatttcaaatgaaactgtgactccattgaaaagtatgccagcaggtagtcagcctctaagatggtccttaatgatccccatctcctggcattcatgctcttctgtaatcacctcccttgagtgtgggttgaacttactagttcacttctaaccaacagaatacagcagaagtgatggaatgtcgtttgcaagattcagcggtttccctctccagcactgctcaggctctctcttggctcactatccctgggggaagcccgctgccatgttgcgaggcagtcttatggagagacccatgtgggagggatggaagcctgccaacaaccatgtgagagagcttggaagcagatcccccttccccggtggagccctcatgcctgatgagactgcagaccaggccaacagcttaattgcaaccttgagagagtttgagccagagactcccaaactagattcttgacccacagaaatgaggagctaagaaatgtttataggtggccaggcacggtggctcacgcctgtaatcccagcactttgggaggccgaagtgagtggatcacctgaggtcgggagttctagaccatcctggccaacatggagaaaccccgtctctactaaaaatacaaaaattagccaggcgtggtggcacatgcctataatcccagctactcgggaggctgaggcaggagaatctcttgatcacgggaggtggaggttgtggtgagccaagatcgtaccattgcactccagcctgggcaacaagggtgaaactcagactcaaaaaaaaaaaaaaaaaatgtttatagttgaaagctcctaacttttagggtaatttgttacccagcattattaatacagtcagtagacagtaattatttattattacagggtaaatctttttctttatacttggagctagaagtagggatctgtctaggagagattatacctgaaataaccacaaccagcccaaataacagaataccacgtcctttacctttccacccaaacatacataaatcaggtaatctacctatctcatcctcccatggctcttcttgttgtccttattctcctttgcttgaatgcattcttaggaatagaaatgctaaaacccaaacctgcaggtttcaaaaaaaaatttttagacatacagttttgaatctcatagcaaactctttccttcccaaggctcctcacattacattgtgtattcttattatagcacataacatgttttttcttatttgtaggtttaagtgtctgttttccaggcaccctcttccctaacccgttacaagaatcatgtctcgtgtgatcttatatccccagtactgagtgttcgtatggctgggacttaataaagtttaaatgaactcatgaataaatgtgttgcacaaccaatgagtgagtgagtgaacaagtgagtcaataagcaagagtttagggacatgggaaccaccacttaaaagcttgaggctgttgtgcaaatttggaccttcatataagccatttccttctatatagaatgctctttcttttgctcatcctcacctcctcaccaggcttttctctctttaacattcacctcaaagagctgtctgattgcctctctacaactctccccgccaacacacacccacacaccctaccagggaagtcttccttttctctgctgtgaagccttttctttaagtttccatatcctcctgggcataacttggtcacagcacccagcataccacactgtaatgattagttatttgcctgtcatttccacttagccgtaagttccttaaaggacagcatattcagctaacagcagaatgcctagcagtggtaggcactcaaaaacagtttaaaataatgggcaagagaatgaatgaatgagaaaaagaaaactgtatctagaaaattatctcagcacaatctatttatttcaggtaagctatcagtcaggtatacatagtgctccaactcctaaacagagtaaaaataattgtacatcaagattattacagatacatgaaaatcatatttagaaatagtacttcagatcaggcatggtggctcacagctgtaaaccaaaaatttggggaggctaaagtgggaagattgcttgagctcaggagagacccccataaaattttaaaatttaaggccaggtgcagtggctcatgccagctactcaagaggctgaggtgggaagatcgcttgagcctgggaggttgaggctgcagtgagctgtgatgacaccactgcactccagcccaggcaaaagagaaagaacctgtcacacacacaaaaaaaaaagaataaaaaattacaaaattagcgtgcctgtagtcctagctattcatgaggctgaggtgggaggatagcttgaacccaggagttcgaggatgcagtgagctatgattatgctactgaactccagcctgggccagcattcgagatcagcctggggaacataggagactctgtctcttaaaaaaaaaaaaaaaaaaacagaagaagaaagaaatagttttcaggccaggcacagtggctcacacctgtaatcccagcactttgggaggccaaggtgggtggatcacctgagatcaggagttcaagagcagcctggccaacatggtaaaaccccatctccactaaaaatacaaaaaaaaaaaaaaaaaattttgctgggcgtggtggtgggtgcctgtaatcccagctacgtgggaggctgaggcaggagaatcacttgaacgcgggaggcggagattgcagtaagccgagattgagccactgcactccagcctgggcaacaagagcgaaactctgtttcaaaaaaaaaagaaaagaaaagaaaagaaaaagaaataatgtttcaatctatggacaggccctagacagagctgcctttaacacatctttttccctttccctcacatccttgatcccatctcagtcaaaaaggaaaaaacaaaaagttttcttacttctcagcctaagattcctgatactgtccccagatgccatacatgtattggcctcccagaaatcacccagtgattttctccccatgaaaagtttatatgtctcatgccctcagagtttttaactgcaaataagctaaaaaaaaaaaaaaaaaaaaaaaaaaaaaaaaaaaaaaaaaaaacgaaaaaaaaacctggtttggtggggaaatgggtgctcatgggttggcatttccattttggtaggcatctttttctaaggccatagctttactcaaagcccagtggaaaaagacatttaaaaaaaaataaaaacctttcaggaaccctcaagtcactccattggggtgaactcccctgtgacactagagaggtggtgaagcttggtggttagggcagttttctgagtcagaaatctcagcttttccactctctagtcttcagatcatgagtaacctcactggtgcccaagtgttccatctgtaaaatgaaataataagactacctcaaggaacctggtgggaagattaaatgggttaatacaggtaaagtacacagaaagtgcctgggaagtagtcaataattgtttgctattactattaccatttttacttttattagaattggctcaaaaagaacccaaagagggcaatgctcaaagggaagaaagggatgagaggagagtacacttaactgatttggttgtttagcttgaaggcaatgtccagctgcaggataaacagcatgaattggaaccaaggactcatctccatgtgggggaggggaatgtgaacagaaaacacgatgtcattggcttcaatttcccttggaattgcctcttcaatgtctcggatcttgtcacaatgattgggtccccaaggcacgaaccattttgtcttgtgatggttcttacgggcatccacacatttcaccgacatgtaggacactgccgttgtgggccctggagctgaaaagagaaagtttgtctgttttagaaaagccatctattgaaactactgtttctggttaatattctttccactgctgtgttccctccagcttttgtatcgccttctacaagtggggctcagcaatacttagggatcttccaaatctgggtgaggatctttcactgacctccagaggtgtcataacagtatctctgagaaccttcccattatgttttcaattgctgtgaaagaatacatttgtaaccagtctagttatacttccccacttcaaaacaatgtcacaaaaaatcaactgtgctacagttcccacctgattgaggtcttggagagctctggtgcttcatagagaacagtatctaaagtcagaagaccttagtcttcaaacctggattcgaagcctggttaaaaacctactgtcagtgaatcttgggtaagtcagttaaatctgtaatagcttcaggaccctcatctgagaaacggaagagtttctaagattccttttggctctaaaattgtacaacattgcttttgcttaagataaagaactaggggacaccagttagcttggtacctagcagagaatgggaactcaaacactgactgatacttcaaaagtgtactaaaatataaacgatgcacttcaagacagcaaagcaactttgaaatgtgtaactttaaaaacactattttgtgattatataatggttatatgattataatattaataacttggaaaatacagaaattttaagttcaaaacaacatttacccaaaatcccactagagggaagtaaccactgttggaaaatgtcaaaatgccatctgtcttttctatgactgtgtaattagataaaaagtttacacatgaattaaattgtgtaactttaaaatatacgcaaatattaacacatatttataaaatagttatatcatgcatagttttgtagtcttttctttttattcacttagaaaagcagagtattgtgtgataacaccagctctggaggcgacctgtctggtgtcaaatcctggctctctcatttttagttgtgtcaccacaaatccacactaggaaagttttgggcaaattactaagcctatctctgtatcggttttatcatctcttagatggcaataataatagtactgatctttccaagtcactgcatattttaaacaagttaacatatgaaagcactcagagtagtgcttgggcacacacaaagtataaaatattagccattatatcatattttctttataattaaaatctttcagttagtagttgcaaaatagtcaatcacacaatacaccaaaatcaacttctccttcatcagtttgtaaaggctatctataagaataatcctttgcctaatatgttttgttggaaatttctcctaaactttccatctgctatctaaatttgtttatgcacatttaaatagagaagttccagatcttatatggaatccctcttttatgtttttccccccatgcttttgtgtttagagaaactgaccttcttcatctcaaaattcaatagtcatctatattgacttctatttattttttgcaatttcattttttctaatatttaaacagttgatccatctgaaaattgctataagagatgcagtgaggttctagttttatttcttaaatatttaaattatagttgattgaacagaccctcccttttgttgatttatcatatcactgttaatctttatgtatgtaagcatgtttctgaacatctgttcttttccatgcattaaactgtcaattcacgggtcagcacaacattgctttgaattttataaatttattatttttatcaatatctgctagagtaactctcttccccaatccatttcaaatttacatctttttgctaggatattgaagattaaattaaatttataaataataaatatataataataaattaatgtggacagaattagcatccttccccagcgtttagttttcccatccaagaacagtacttgtttctccattgtctacaatctgtttttaaatttcttggaaaactttcattgttttctttatgtgggtcctactagtatattttaaaatagatacatctataaacctttgaaagttagtagttaaaagaaagtgtcatcaattatggtttatgtgtgtggtttaaatatgtgtatttctgtgcatctgatacttggtatattatgtttgcagaaattctctcttatttaatagagatcagatagcaatggagaaacatgaaaagcaaaaagaaagttatataacgggaaaaatgtgtattattaatattctgccctacttctaatgttcgaatccacattatttttctattctattaaacatctattttaatgatacatttttagtaaaatgttatgtttgtaagaagttaggacaatgcctattaatacttaccagaaaactcaacactactaagctctagctgaacatccttcatgtagaaggctgaacactgcaatacaagttgccactaacccctgctacagacgtttttctttaaaactcaaaactgtatcacgaagacctcacatctaatccatctaaaatcagacatctgacttattcttagaaatatgagtcaatcaaactttggttatcctgactcagctaaatagcccactgacattagaaaagccaaatggcacatttaactgaaccctttttaatgtggttggagaaataaacagtgagacaaaagtcatgaattctattttcggctaacatactcaaactgactatttgctgcagaaaatagttactacattttaaaacttctattcttccaaaatgaacctaacctttttttctttattttttaccttcttgaaaaacaagtctctcacttctcaggccaaaacgaaaaataactagctgagttcctcagctaagctccaaaaccacattccaaacttaataacagagaagctgaacactttatggtcacaaagtccgcatttttaatgaatgcagtgaacgcctgcctttttaggggcctgcattattttcatcctctcattagtctagtgtttcttctataaagaaaaaaaatcccagaaatactaatattttcataaatatcatggcagtgaacttggagaagcctcaagtgcatctcaagctatactgtgagaatcacaatttttttcacttgaataaattagtccttgagtctcaaaaatgctttccataacttcaaaacctgaagataattcaacattttccgtttttctaatagtgttcaaaagagaaaacacaagtattgcttgagaaagtaaacagacatcctgatattcaaacatggacagttaatgttcccccaataatatatttacagctcagtgcaatgtcctactccagctaaaagtgaattcccaagtgtttctttatatagacagcattatcacgtaaaccaaaagcaaagcttacagctggtagctggtcacctaccatagaatgtgttttcattagctatagtcaaaattttagctacatgggtcacaaattgtgtctagaatcaaaaaaagtttgatctgtctgtaaatttttttaaagtgtgtgggattaagagaaaagagctaaatggaggaagtttaaatcatcttcaacctttgaacaagccacaataacaggtatttgtaatgaaggccttacttagtcacttgcgtggttctagggattaatagagtttgtgtattcaagagggggctggatagattcaggtcaacaaactgagtcatgtttgctcaggtgaaagctaaaaataaccactccccagtattcctaggagagtaatgcaatattacccagctgcctcagcacacattataaatgtctcctccacccacccatagtataaggtttaactgaaaacaagtaggccaaaaactacttctacaccagaccaattcaatgacagaataatttggccaaaactaaatatgcctagtcactgtaaactggttaactcatggttggttaagatagccttgggaatatgcacagaagttataaaaccatgagctattcattgaaaatgcagtccattatgaattcagttctttttactttatcaaacatgaccattttattttgtctgtatttcaatacagtatttttggcctccacttttccactacagcacatgaattgtgaaatgtgattctatataacatttaatgttaaagtgatatgaaatcaataagacttctaacaaattcaaggtgtgaagaaatgtacaaacacaacctgaagtctctatgaaaattcagtggtccctcagttacacacattactatggctcacagtatattgtccaaatttgtcttgagtatctaccatgcactagacactgccggttctggagtaaacctgataggcaccaaccatatggaacgtacaaataacggaggaagcagacaataaataaacaatttcaggaaaaaataattttgatgaatgttatatgtaacctgacattccctgagaaagggcaacagtcagatatttgggaggtgggagaaatgaatacaccagaatgacagaaaaatccagtcatcgttacaacataaccttgaataaaaatgtaagtgaacaatgactaaacctgtagtacttcttttggaagaatattcattgactccagtcagcttcctgttatttcacttcaaatggctatccagtttacaaattactatctagccaaccgctagcatttatcatgcttaaaattgagtcaacattaaatcattagcccctattccttccagaacctgtaatttaagagttagagagagacaagacttggttgcctcttagaaaagttaaaataaaactaaaacaacaggctgacatgacacattgtctccatttaagccaacatagactatttatttctttgctttattatgagtaatgaacatttctttagcaatcacctaggagcattactattatgcaggtaccgtactaactaaagacagagacgaatggcctcccagacccccatttgctcacaggctagtgtgggaggctgagaagttcacaaagaattacaccctgattggaaatttctttgacagaggtttgcacaggatgctccagttgtaaaaagagctgagggtagctttcggcagggcttagccttggaagagagcaggtaatagccaagggagaatgggggatggccaaggagggaaggtgctgaggtagagatagaacatgtgctgggtcatagaatatctaaaacaatcatattttctgcagatatctgtgcttgaatattaaaaattaaaaagagatcatttaacggtgaaaactgtagtactactcttatctctgtgtccacccttgccttttctaatcagtggtataattctactagagtgccttggcctctgctcccaatcatccctgctgtactctatagagcaccataaagaaggaataataaacagagccacacataacaaagaacttttatttggcaggaatgtttccttttatgacacctatctctgccctgtaagtagccacaaggccagaccagagatctgctggaaggaggcggagtgagagggtagtcaggtgggaatgaagaagctccccgtcctattcccacaaatggccccaaagagcctttgaagtctcagtcatcaggtaataatagccttcctctaaattagaggaagaatgtctgccttgcaacaaagatgatatttaaagaataatctgctttggggtacaaggggaaggaatgcagagaatagaccagttgaaaaggtaattcctgtttataagaattaataatcagaacagcaccattttaaaaagtaatgacttaaagtaaaaatggtcaaagatttcagaaatgttttagagaattttatgtttacaatagaatttatctaacaaaaatgataggaacaatacacattgatttaaaaacatacaaaaagttggtagcagatactttctcctactgacttgagacattgatttaacacctgaaaactaatctcagttaaaaagctgccagcaccatctctccacctgtaaaaatgtgaatatttatttatattttataatttcattttatttattctctatcttgttccataaaacattttggggtactagaactggttattagcctttattttttaaaaataattgggactgatttcaacggatagaattaatgttggggcgggggtgggcagagactacaaattacttggtctatgtctatatcttcaaaagtttggggagcttatattctccagctattgctttttttttttttttccagctattgcttttgaaacaacagctgggaaatataagctcctcaaacttttgaagcaatagctgaagaatgaatataagctcccaaaacttttacctgatctatgaagttgaatggctcaatatccattttactttgaaatgtagagaaaacctccattgcactatgaatggtatttataagaactaaaaggcatatgcccaagttggttctaagctctgcctatctaaatatctctgcttgccttatgagaacttatataaaacatattgagcacttaaacccttgggcaattgcagagtgtgctttggattttttgagtatcaaggtggggagggtcgaaaagagggagaaagggaacacaggtgtcagaaaagactagatgaattcctgttatgtaactactttttcaaatgcccccaaagtacttatttaacctaagaaaatctttagctaagtttagaaattagctttaaatatgctcaattgattttccttagacattccacatgcctttcgccagctcaaaagccttaattctggttaaaaggaaacatgtgaaatatactgcacaacttcagtggccagatcatattaactggctgagctgtgaggtcttatgagccaaacctgcttaccattcactgaaagtcagttcctaaaaagatttcttaatatctgccataccacttatctaagttttgggtggctaattagaatgagctcttcaaaaagttcagctaaagaaagtgcaaatatttgcattaaattgacttagtacttaaatgattcagtgtgttaattcttttactgaaattgctctgaagttatagtagacacttatgctttctccaccacctactttgaagagaagattctcctatatttcaaccatacccattaaatcttactagcttactaaatgaagtattatttcacaattcaatctcaattactggagagctgaaagtgtgtctacagagactagaccagaagtgatttttacaattatcaaagctatgcccttgtgcatgaaatggggtacgctaagtgaaatgaaattcattcttgccagccactttcagtcagttagttatgctaacatctgttctaggaaagctaattttttttaatacagcagaacattcctttacactgaaccactaccaccaaaacacaaacatacatactacatagcagagttgaatgcaaaataatttgtaccgtacacacaaaagtcaagcacttatttaaaaatagttctttacaatataaacttatgaaattatggacattttgacagcaattttccaaaaattgtagcaaacacttgtaaatacattccgactcaaaaatattgaaaatatcatatgtttacattttaggcagatgaggattttaaatgcttcgcctacaacctcaattgttgtggagccaaagatgcaacagctttgaagaatagaagaattactctatatttgtcaggatctacgtggcaaacaagcgccacttggcttacattacttgcctggcttggatcccatggaatggaggagcattggaaccaagaggaaaaaaattaaagtgctttgggacagcgagccaaactcttacatagtatttgaaatggtgtggcaaacatgaaattattttaggctcaagattggtgctagttttttaccctctttttgaaaaaatagtaaaatgcacataaagggccctgccagaggtttagctcataaaatctgccaatcattggatgtgctaattggtgtagcaatccagtggtggcctggattaggactcaaaaactgacccttaccacccttggtgtcctgcagcaaagacagcctaaatcgaaaagactgatggaagtatatcaaattacgaatttctctatccctgaaaaatgcctgcaatttctgtttctccatcactccagaaatactcaaaacagcaaaaattaaatacatatgaagtgaacacaaaagacctccacagaaaaatcagtggctcatctgttgacgctattgctcattgctcggctggccagtcatctgggctaagttttgactttgggccagtgcttcaaaatcagcaacctttcagccaaaagactgtggaatgcagccaagaccacctgtggaaagtgaattatagcatctttaatttactaccttgggctatgatgtcagaaacccagcatggagggcgcaccagttcttgtgtgggaaatctctcagagcccccatggaggcccccaaagtggctctggcaaagctgtaggggtggaggtaacaaaaaaggggacacctggctctccttcttaaatcagctcaccatgggcacacatttatattggaattttagggtcagaaaataccaaaattaaatcttctagaagaaacacagtcagtggctttgctctaaagtgcctattacactctacaagtttccaacatttgttatttaaaataatcagacatttattattcataaattacatatattcttttatcaatattattgttaataataaacatgaacaactagtaagtgaattgcaaagaactttcacatacatagattatcgaatccacctagttaacaagtaacataattagcaccattgcatattcagaagatcagtggtttttgtctcatcagtaaatagagttaggactggaacccaggtctgatttcatatctaatgctcctttccaatacaactatctgtttatttattaacggttactatttattagcactctcagattacctgagatagttgcagagctgagggatgaatgaagacgactgtggccataagtagcttgctgaagctccacaggcaaggcactaccagcactgggctgggtgtcactcaaagggagccagcaagatagcttttctgggagacttacagtcagggacagagtacctctaagacttccataaagaaatgatggagtaataggctcatgaaaatgcactaaactcccttgaatctgataccctcccagtttttaccgggtcttggttatgacttcatattgcaggtaggcagtgtttaggatgttagcctagagaagatctgactcaggaacacagcgctgccatggaagtctatgacagcacttgcaggcatagtgagagacaggaattcaagttagagaaaatctgactccagagcaacctatggaagaattacttataattcaggtaggcaaacaatggcacagtttgactcaggaaagggtgggttcctcaaccatggaaacatttgggaagtaaatggatagataagagcaagagcctgaactaaatataagttcctctcagtcacaccaaaataagtctcctatccatgcatatggtatgtcagggaatggagaaattaaggtccaacaaagagctgcatatagtttattgatttgttttctattttctgaccagttccagataaacagataaaagcaattaaagtacagggcattctgaatggtcaaaaatttagtattgtacattgtaagttaaggctaagggcaagtaagacctgttaatgtctttatctggaatttcacaaatgccaagaataatcatatttccttccttgattgattattcaaagaaaacacaggcccttataatttgcaaatttcctagaattgagggtagaggtacattttaagggtaacttgcagttttaacattcacattcttaggaattattattattattaatttttttttttagacggagtctcgctctgtcgtccaggctggagtgcagtggcgcggtctcggctcactgcaagctccgcctcccgggttcacgccattgtcctgcctcagcctccagagtagctgggaccacaggcgcccggctaattttttgtatttttagtagagacggggcttcaccgtattagccaggatggtctccatctcctgacctggtgatccgcccgcctgggcctcccaaagtgctgggattacaggcttgagccaccgcgcccggccggaaatatttttttaaaaaacattgaaatcacaaaattaaatagtctatgcaattatttagtattttaaatttcatcagttttaggttctagctcaagggccgtctctccttcattcaatttgttaaatgcctatagtgtgccagctggaggcctcctctgattttccttcagttgacaaaagatccttacttcctttggtgccagtatcacctggtctatgtctttattatagcattctactttatttgcaggcatcacttctgaaccctacaaaattataagctcctaaggggaaggactacatcttattctgccttgtgccactaagcacagaaacttaaacatgcaagtcctccagacctgaactgaactatttattatatggcttttgtgtcataataaacatattaatgtaagttatgctcaatgtaactaacaaaattttatcaaatgcctactaagcatcattttttaaatgccatagtggattaatccttgtcccgcctgtatcaaagtacacttagactggcactcagtgacagtttgggaagaagccagagctgccttccgtgaggtcagtctcccaaggtcacacatgtgctcatcagagactcacttcctacaaatacttatgacggttcttccagatccgtgtcaagcaatatattaaatgaaatactgaattttgaagatcaaaatgaacttttcctaaactataacccaatccacacaagtaatttacacatcaaaagaaattagatagtaggcaaacaaaacaatggtaatttttttaaaaaaaactgctcccaaagggtttgtggccaacattaatattgcaggaacatgtttagataactgctgttcagcatagttcctggaaacaggttctcaaagccaggacttacagttatttaccttcttccagcactgccctgagggttttaaggcctaaatgaatagaaagcaaatgggggacaaaatgaaataaaatgttcacatctcagcctttagtgtatataactaatgtttgaagattttatgacaaaatgtgtcttcttaagaacacatgtagggaagattttggccatttctttaacaccctttaaacagtacctaccagagaaaaagcaaacactcccttctaaaagcatcaatattctacttctgagatcaaaactacaaaacaggctcagacagaaacctgggcaaaggaaccttctgctgcacgtatgtactatttcccagagatgtaaatgatttttttctctctgccccagtgaatcacatatgaaagttctcaaagaattagtaaagaaaaatggtgaaaatcttcttggtgttgaaggaacagtggagtgtagctggtatcagaagttctgaagtgactcagagattcagaagggtgacaggcaggggcagtttttactagaggaaagagcgatgtaggatgaacaatttactgtccctgttgattcacataggatgtaagtacaagagaagtcaaggatgtccccaaatttcttgcataggcagcagatgagtgatgtcattcactaagacaggaatcaaagaaaaatgaatgacatgtcatatcacacgtagaatttgtagaagctggagatgtatagcttgtttaaaaggggggtttagtatggagggttgaagataaaaggtcaaatatgtgaatgactaaatgtggaggaggaattagatttaccctgagtggttccaatcttgcaagttctcaggaaggaaatctgagatcaataaaatcaaactggcccacagttcaccacaccagttgaagaaaatgagctgccggcacctgtgtgagtggaggtgctcctcagttaacacttggtgagtgcaaagaatgcagagggcatttgagcaccgggtagggatggaaaggtgacttttagggtctttgttatcattattattctatgggcattcttcatatataatatttagagcttcgattctgggccacaagttgatctgctattcctgaactactacaaatttgagcataagaatcttggcagaataaattatcccaggactcatgattgctgggttctagcaatggatatgcattaatcaggcaaattattcaatcaatcttgggccttagttttctcaactgtaaaaggcagtatttaaactgttaagcacttttaactcagcaattgtaggattctaaaaagaatgtatgtacttctacgttatgatgaaagtcactcttttaagtttaaagaaaaagttcctacaaattagggtcaatttatattccaagagttctggctgtccctatcaggcccctcctccccctccttgtccttatattttcacatctgttagaagaacagatcttaatggtcctattctcgttctgttactgtttgggatctgaatgtattctgagtgttttctgtcttccaacagctggagagatcaaagaactgttcctaaaagcaaggacaagctacagccaactgcatatgtaaactttcatactgatgtatttagcacagtgaattatacccccataatttataatatgagaaggtaggtctaatccaataataataaagacctttaggagaaaacaacaaaaaacaccattccagcttccagccagtggtctgaatactcacagcctaatacaacacaaagacattccaatacaatgaaataatttggatcatgtccagcctctattttttaggatgatagaaataagctcaagagagctaagtctatttattattcagaagaaatgaaagtcatagcatacacttctaagccaagagatcattgacaaaatttgctaatgaaatcaattcataactttctttcagattttcatttaaacggctgggttcctaatatatttcaaaatttacactgattaccctctacaaaaagtatgtcataagagaaaacaatgattacagagtagcaagggacttactttcacaggaacggtgctttatgttgctgaaggcaattacaaaaagagagtaagaaaaattaaaagcaagagctagagctcagaaaaacttgggttcaaatcccaactctgttactcactagcaatttagtggggcagcttacctagccttgtagaatgccagtttcccttttgtaaaagtgtactaaaaggtactcgcctcctaaatttattttgaggataaaatgattaatataaaaaccctattacagtaccatgaaaatagtgaagccttaatgaatgttagctgataataatagtgctgtcaacacatgagaagaattagaatctggtgggagatgaagacctactccatgttctctgttctgtcttcttgccctgaggggtgtgttcatcaatatttaaggaactagaaggtgtgcatcttggatgttaaaaacaggggctcccctcacctatcagtgaacagccccaataccagagatgattctatacaaattttaactggaacatctaagataaccctgagaaatatcccaggcatatcttaagcagcctgttatttgagggaacacagaattaacccttggttttatccttagaaaaatgggatgataacatcttttttcacaattatcttcacaaattattataaaatagttatggcagagcaaaaactattgacatgggtatttgctaccctttcccctcctctcttcagataaagagaatgctggttttgcctcttctgtcacaaccccctcacctgccccccgatgaggattcaactattgctagatggattctttgagttttcatgatgcacaatcaaaagacaggggataggtagaagatatgggcttgagctcggcagggagaggggggcggtttaccagcgggagtgttggggagattttggaagagacgttagaaacatcaaagtagatgggaaagaaaatagggattgctagaagtactgctacagattatatatcccctttaccatgctttgacagttaaagaacagaagttgttaggtcactttaaattcacctttggttgactgcctgtttctttgacagaatccctacttggagactggaccaaagaggctatgtcttccatagaggcaacatgagaaagtaagagaggtgcaaacacatcatgcaaacgttaggcagaatttattgtgttcatacatgacatggggaacattgaaaggattgatgtcttagaaaggcgtgttaggagtgtgggtctagaatgcataaggttagagatatgcctgcactgggccatcatcttattttaatatttggtccaaattctgggcttctcacaatcagagagctatacctaccaatttcctcttattattcttggctgcccggtccccatccctctactcagagatttctcaagctttgcactaatggcattttgggttgaataactgttgtgggggtttggcttgtgcactggaggatatttagcaacatccttggcttctacccactagctgccagtagcatcttcatccccactgctggcaagttcagggggggtgtgggtgggggaagtcttctccaaacattgccaaatattccctggggagcaaaactgcttctggtggagaacctctgctttaccccaatcatccaggcttacaagaaaaattcatactccatcaagccattctacaacacttcattttcagagtttccaactacagagattccaagttctcagcaattcataaccattacagtttgcctcatgttacactgactgcatcaggctgtcatttagaaattataataatggctaccacttgttggatattttttatgtgctaggcattgtgctagggacttaacagggtgattttcattcttatacagaagtaagtgtggccgggcacgttggctcgtgcctgtaatcccagcactttgggaggccgaggtgggcggaacacctgatgtcgggagtttgagaccagcctgaccaacatggagaaaacccgtctctactaaaaatacaaaaaattagctgggtgtggtggcgcatgcctgtaatcccagctactcaggaggctgaggcaggagaaatcacttgaacctgggaagcggaggttgcggtgagccaagattgcacaattgcgctccagcctgggcaacaaaaatgaaactccgtttcaaaaaaaaaaaagaagtggtagatattattatctccattcagagatgagtaaaatgaggccctgaaaaattaaaataactcatccaaggtcacagccaataagtggctgaactggggtttgaacctaatctgtcccaggtccatagtctctccttgtctcaggccacactgtttctcctgatgagaaaaactaatgcagggatacacaagaaatacatttacccaaagttacatgagttcaaatggcaattccactgtatggactattgtagaggttgttgatctcagcactatgtggactcagcagtatggatgtctttgttctagggacatcaacaagctgatttttgaattatgaattttctgcagaaaataggaaaatggtgctctcctttaagtagaaacaacaaacagtagctggttgccatggtagcagaggtaaacttaaccttgactgggaaggcaatcaccagaaagggacagcaagtatggtcaggagtctaaaccagaccaggggtattttaactggagaagagaaagtcaaaggagagaaatgatagtcatctttagttatttgaaaggctactgtgtaactgaagtgaagcatacattcaagattattctaaatggaaaatccagcattcatgagtggaaattacaatgcagtcatggaagccagttttccactgaatgataagaaagaacatttaaccatcgtaatgttccaactggattgaaaaactaaacaagctgtctagagagcaataggtcgctaaaatagaaagatcctaacaggaaggtcatctctcttgggagacccagtgtgggtgagactgggctaaacaaattctcaggccccctccccaagcaaaatctctgtttctccagagaattagtaaattggggttccctgttgaaaacagacaaatggaaggtccactgggcggaaagccccagccgctcatcactacaagaggagaggtaaactacaatctcacctgggaagaaaatgttgtttaggtgacacaaaccaaggggaggagaaaccttgtggaggatttttcccctctgttctgaatagatgatcaaggggtaaggcagtaagggcaaaaccaaaaacaaaacaaacagaaaaaaacccaccaagaatcaagcagctttctgctgtcttccaaccctcagacactctgatgcctctttcttggaatgtaccgccacctcccactgctttggcctaaagactgcatttaattttaaaaagaaaataggcaaccatccagctaggggacagttagagtaacagttgattagtccttttctaaacactgtcttttgtttcattgctctttatttgctgtacaccaacaattcattaaaaacatctcaccactagatttagtgaatggagaggacaggtctaaacccaaacattcctcttggaaaaccgactacattgtaaatttgcagacctgtccaggaaagtaaaactgttacaaagtcaacctctactgaggcacacagcctcctttgtaaaagaaaaaaaaaaaaaagaggtgctaaaaaaatgacaggtttttcttaaaaaacaacaggtttttcttaaaaaacaacaaaatcttattcatctttccatattcagcatgaagaacacctaagagaattttccctatcgcctcatctccagggcactcaaagcatttacaatctcattattttatacaacacccattaagtgggcaccaaagattattacccttctttgatttctaagaaagcaactacagaaagtttaaacaagttgcccaaggtcgttcagtaaattgagatgcttggattttccattcagtgattgttctagggacatagtgcaaagtgactgaatcctctaaactcaccaaaacccctaagtcttacagatctcttccccatttctcaccactcatgagattttcatcatctaatcacaaatctgccaccatgtggatcttggacatgggtatcctaccaggccagtgccatgtctgcaagaagcctggtgctacacctgacagctttcaaatcaccatcaaatgattcctttatctagtgaagttgattctgcctggctgcatctgggaaatttttaacccctcgattagccattgcacagttggcttaacttggatgagacagaggacaaaatagtggtggtttaaaaaaatacctcccccattctgattacaaaggaggcatgattaacgaagtaccctttgtatccgagctccattctaagagaaagagaaagagctttccttcccccttttttgatcgctgagtcttttcctacttgtctcatcacccacacaatctgttcacagcccaaacagacaatccagccagtctgtggagagttcctaaaacatttatgttgtgaaagcagacaggatgaacaggacctcatctcgacaaaggatgatgggacattcagcaaaagagttcacgaagggaaatacagatggagtcccagagctgaatgaatttgcccacaatgtctaacacaatgccagcccttatgggtacttgtaaaccttctggtcaattcacagccacctccaggttttatcccccaaattccattacttttagaacaaagggttttaaaagaaaatacaattaacaagttaaggaggtccaaatcagtgctttaaggatccttcaatttctctagacctttaaacataaaaatagcaagttagatgaagattttagttccaacactaccagatcgggagttgacataatgcacataaaatacttaatacattgcctggtacatactaagtactcaaataatattacctaatattttcatcttacactgctctattttattaatgatgtttttatatatgtcattgcctgtctactcagctaaatagttccaccttatctgtttttggtataatccaaaagataaatgccttcatataattatcttatttaagctttcagatctatagtaggttacagatgagacagtaaaagcaagactaggtctcatagctggcaagtggtagattcccatactgagatctcaactcactaatttaacatccagtgctttatttcaataacaccacagatgaacagattatcatctctcgtgcctctttgtattcttcagaatttagctaagcgctaagatataccttaatgatcatctaaaataaatttctaatgataggtaacctaacatgtctgaagatttattttagtgcctttaataaggaagaaaagaaatgggtggaaaagcccaaccatacttggctttgaggaaagacatgcctctgtttttatttgccaagggaaagcattaccaggtccatttagaaagacaagaggaagtaaagccgggcgtggtggctcatgtctgtaatcccagcactttgggaggccgaggcaggtggatcacctgaggtcagaagttcaagaccagcctggtcaacatggtgaaaccccgtctctactaaatatacaaaaattagccaggcatggtggtaggcgcctgtaatcccagctactcaggaggctgaggcaggagaatcacttgaacccgggacgcagaggttgcagtgagctgagattgcgccattgctctccagactgggcaacaagagcgaaacttcattccaaaaaaaaaaaaaaaaaaaaggaaagacgaggaagcatgagggattcaatgatataccaaagagataaatggggctagagccagaactcttgatactctgctcatggctttctgtattaagttcattattaatttggcaccttgagtgagatgaatcttgccttggattatgcacatcaagttgtatttcagatggctgtcccatactttaaaggcccataccaaacccccatgtatcaaaaaaaaaaattatctgatctaaaaaatgcctagatcccttagcccttaacaacaaactgtcttattttatggatcttgtcttcccaaatttaagttgctggagggcaaaatccatgtgtttactccttctgtagcccatggctaacctagttcagaacttgtagcaacgtgtgctgctcattgcttcctcggcctcacagccttctagatgtcccaaagaaacctcgagtcatcataacatctactgaatttcccaaccatccccagcactactgctcggcttgggcagtcattaaagcttctcttctgccttcaggatcttcatttcagctgctgggacatcctgttgccatccatttcacacagacatccagcccagcaggaacccgtgttgcaatgagctttgcttcaaagccagcagcctggccaagttccaggaattgtcactaatgatcttcaccagcaacttggtgctcaacagtgatctctgaacacacacacacacacacacacacacaccccatttccaatactgctctagttagaggagctgcctaacagaggttggttccataacttattttattctttaattgttacagaggacttatttcatcaaaataagctaactgtccaaatacactctgcaatgcagcagtggcctccaccaacttactccttttttttttttgagatggagtctcgcactgtcacccaggctggagtgcagtgttgtgatcttggctcactgcaacctctgcctcccagtttcaagtgattctcctgcctcagcctcccaagtagctgggactacaggcaggtgaaaccacattcggctaatttttgtattttttaatagagatggggtttcaccatgttagccaggctagtctcaaactcctgacctcaggcctcccaaagtgctgggaccacaggtgtgagccaccacatctggttccaccaacttatttttaaactgaagaaggcataacaagtgtatcagtttcttttggttgtaagagacaggaaagcctgctcaaagatacttaagcaaaaactaaattagtaagatgatactgaaaaatatctagagataaagcagtcttctagtggttgttttgagaaatcagattatgtcaacagatctcacttctctacagtcattgaattccaccctgtattttattagcttcattctcaggcttcattggaaagactccaacaattccaggcttatattctgtgagttgaaattcagtaagaaaaagagaggacatctcttcctggtagcctccacacaagtctcagaattcactctaattagactaacttgaggcataaatccaccgtggctagtgcttggcttggtcacatgtccatcactggaatcagaagtgaagattctcttaaggcacatggactgagagtggggaaaaaaatgctccacaaaggagattcaggcagatcctgctgccaaaacaaataggcgaaacactaggcagccaaaaaacaccaatcatcctctccaataaatcttccttcttttcctaatctccaagaagttgtattactgggatgatccaactttgaaaatagtatattaaaagaaaggaacaaccacgcaagtcatataaaaatatatgtagccagtaggcacatgaaaagaggtttaccattactatcaatcaacgaaatgtaaattaaaagaataagatattatcagcacattgggaaacattttttaaacaaaagtaatcaccagtactggctaacatgcaaagagatagacattcccagatttggctaatgggtgatatgatgattatcactgaccatcaaaatccttaaaaatgtgcatttcattttacctaagataaattcacaaaagtgaatttactaaggaaataataaaggatgtacataagaatttaaatacaaagaagatttctccagtattgtttataatagccttaaactggaattattctaaatgtccaacaatagattgagcaatttaattttatccatactatgggttatcatactgacactaaaaataacctttcaatgcatgtttattagcatggcttaaataagtagaaaggcactatacaaaagaattaataaagtgggcaacaatagcatcattcactaactaaacccagtaaattagtttcaccctcatctcctaggcactccctggttccttctttaagatttaccctggggttctaaagacccagattccacccggggaaagagaaaaactctggacaccctcagcaggctaaaatgtgttgaataaatatgtaaagagagaatcaacaactgttcatgggaatggcttgctacacagaggagggtgaagaagatggaccacaactgtcatttacttgtcctggaagagagctcaaaaagaaatgtttggccaatacacagtgatttctatcacaagtagttcatattttttaaaactactcttttttcttgttcttcaacttgtcataatgtagcaattaatattcaaatcccgagttattccttccacaaacatagctactgccttgccaaataaaccataccacaaacagttactccccatctcagttttcataagtttaaaatgtaaatatccctgatggactggcctatcttagagtgttgttgggaagatcaaataagatgatttctactaaagtaccttcaagaaggataaaagcactatacaaatgtgaggtatcaggtgtatcagtgcattacgcagatttcacaaacacacaacagagcatgggagagttcatggcaagcctctggctcctccattaccctcatgtccttttccctgcagtcatttcagaaaaccagatgtttgtttgcaaagtttctctgcagcaaaagggcaggccctctctacattcaaattggctgaagctgtgtttctagctgttgaaacttagacaataatgggggagatgccaaaattaatccaaaaagcagacaggcacactttacagactggagccctgagatggaaaaaggcagcagcatgaacaagtagagggttaatggttttcatattatttaattcaagccgcaacaatgacagattctaaagatataaacttctgagagtgagcattctttcagaattagtatacaggggtcctattagcaatattttatatactccaaatatcttcccaaaggaaatcactgctgaaaaagacaaagttctttgttggtagggctgtgcgtttataccatggacttaaatacttttcttctacagtctcctcattttaaaaaatggcaaaaaatttcaataaaacatggatggagcaataagaagtacactgaagttcttaaatgcccttctttttaaatccccaccccaattacgtccctcccttgaggatatttacagtcctctatgacacatgctctgtaccttcttggttcaaggaaaacacacctacagcatttcaaattaactactgacccttactctcacactataaacaaacccttttcacaatctcaattgcattgtgtccacattgattaaagcttgaagcctggtgacctcatgtggtgttaacttctcccatgcaccaacagcattccgcctttctactcaattaccccctttggtgccagaggatcgctacccaatgaacacatacaatggacttctgcttcattacactaaccaacagcaggatagaaataagcagaagaggaataaacaagctaatttatcatgaggacagagcaagctttcaccagtctcgccatggaaaacttcagtggttaacgggaacatcaatagtctgggggtgatgtttatgatcttacagattatggacaaagccataacagaaccccaaactgactgaagaattctgcagattggcaggtgtgaacacacgcacacaaaacccatgccttaaaactccggggtcctacataaaacctactcagtaattattttgggaagcataaccctgggctttggataacgtgggctgacactctggtaatttgctccaactgttcagcttaactgtggggcccctcttatttatctttgacaaggtggtcaggaggaacccagcccctttgtgagaggggtctggttcccccaccgccccctgcttcattaggcatggcaaggacacagcggttgattaaattaacaactttggagggcttcagtcccagttcccagacattagcaccatcatccagaacaaattaaaagtctcacagcaattaagcagattttgaaaatgaatttcccatggttcaatggctcaaccacaatcttgagttaagtatcagagaagagtattgaaggaagagaagaggaactgactgctgaaattccaaagtaaacatacaactggtagaagcagcatacacaataaacttctgagcctctgctaagtaggcttatacatttcttttatagaaaattggaaatattcagtcacataaggggaaagaataaaacattaacatagaatggttgtatcaaaatggtggatttttttttcttttttctttgtttttaattactttaacatcattttattcttgttcaaaaatataaatagatattgagaggggacaaaaatacctacttccagtcacaggcttttaaattcaaacaagaaatcgtacatccaagtctggaactggaatcatctatatttctctgaaccagtacaactaggttcacagcaggcaaagaccttttatgccagcctccaaagaaccctgggtgggtgatttacctctaagaactcatttctggatcaaaagaataagattaatgataaaatcatacctatcacattctaggtgtgtactctttgccaggcactgccgttttgaggccttgtcatacttgcttccttccctttcagtttacatatgctcctttaatccctgttcccgcctcgcacctctgcctggctctacttgcaagtcacaggcctccgttcctctttgcctgcaggcagacatttggcacagcttgtgtgcaggaacctggaggaatcctgaaggaatgtgcgaatgaattcattcccactcaccagatctataagctgaagacagtggaatgcagaggtagttacttgaatgaactatattttcctgtcaagggcatttataaaagctgacatcataaatacattattggtctctaagtacaactgtaaataaatctacaaaattcttagaaggataactttcaaagatttgtttttcatctttaaaagtttatagaaaattaagcaaactatgtggctcttctaaaagaagccccttcaaaatagccctcacggaacagaagaaacacatttacttcttaaagacagtaaatctcaaaatttgcattacagttcaacagttccatttggatattcaaaatttggaaatatatatacttctgtgtgttcccttcttcccactaaactttaatcaactagtatagacaaccagccacagtcaattatctggctttatggccaagtagggaccaaaatatataacccagacataataacaatcagcataacagtaggcataggtaatgaaactctccgctagtggtcagaaagctcagttcaaaccttatttctcactatgtcttccttggaccttagtttccacaatataatggaaaaacgtccctttccaactccaaaattgtaccattttagaaatgtaagcatgtatattatgaaggtaacacaatcttttatgttcaagtgaataataaaaaccctcctcccatttaaataataatagcctggaatataatgttataaaacttagggaggacctcaaagccttaaagtagaagcattttagttacctccacaataggtccaaaatgcaaggcattcatctattcacctcttcaacagatattattgggtacctacattgcattgatctgtagtaacagccataaaggtgagtatattagaccatcattattctcatacagcttacagtttgacagaggttatattttaatcattattttttgtttaaaatttcttataaactataattctagctaatgtttcagaagtaattaatattttatttttaaaaatcatttttcctcaaagtttgactttaagaagtctttgtcattcacgttattatctagaagcaaaaaaatttcccagtggatgatgactccaattttataatgtaaaacagaagtacaactgggattcacttcgcagcaagcaaagagggaataaatctcttccacataatgagtgatatccatttaaaaaagtcatgctacctgggcttatctatgctctaaagagccatgaatactggcccagaattttaaaagacaaacatttagattcaaattaaatgttggttaaaaagaggaaaaacaacccaagttaattactctaatttaccgaatatatgaatgacctgcttattggactattggctagcatagatcttgcctaataggaaggctatcaagcagggtggctgggtttctaattttatccaatcaattaagaggcagaaataacctgcccattgaccttacgagacacaagttgactccagaataaacaaacaaacagacttgaaaagttaattatgggcaacctctccttcagagaaatggctcacatatattaattgatctaacacctatgtgcaggctcccaagaagatggaactcgttctctcatttaaatcccacaacccccgtgactcagagatttttggttcaggaaactgaggctcacagaatttaaatggttagtctaggttacaaagcaagtttgataacaaagagataaatcagatcactgccatttatcaaccataaaaccacattccatcagttattatagaaatccatcactttgaatggagagatcaagtttctcaaggattaagcttctcatttaacatgaactatcaaatggaaaacctcgagccaacacttatttttatagcgtgactatttctcaagaatcctgtaagaagcccacatcaagaggcaactttcaaaattactaaaatttcaaaaatttcaaaattacaaaagtaacagttctgtcaagtgggaagagttaatgcctttcctttacagagctgctttatgtaactagccgaagttttaacatagaaatattactgtttcatatatacattaatcttgactttgttaaaatcccaaacatactgctcatcgatctcctaaactttctctttttcaagaagtaggtgggggagggaaggaaggtattggaggaattcttctgatatctgtaaaaacagaaacaaatgctaattaaaagatgaccttagtgccctttcagtttaaaaatcttgagcatttacaaattatcttttttttctctttcatcaactattacccagaaataccacattctcatagagcaaagctctgtcctgtttgggcatgttcaaagaatagtgccagggatttaatactggcatgctcatggacctgcaaattctgaaattcagggggaggcatgaataaaaagatagctgaggtcccacagttgcctgtcacagccaagccccaccccacccacatcctcatatgatcctcaagaagcaaaacctttctgagatattctataagtgacagcaaggcccaatgtgcagtcttttcaaagcctcagtaaaaatcttatctatgacttcacttagcccagacacacaggagctaaaaggtaaaagcctggttcacacaagccagaactagctcaacagaaccgaaaaaagaaaggaatgtcttttctatatcttttccatgtctgaggcattctgctctggggcaaattacaacctaaataagaacagataaaatatatgggaactgagtaaaagaaatagaacctcaaaaagggctgctctgcctggaaagaaggctggaattcataaaacatggaacgtaacttttttagtgatcacctgaaggcaagcttgttaaacagagacttaaaagtcaagatttatttcagctaaattagatggtgcagaaaaacatagtgcttcgtgactctgctcagtttcaacaaaatgaaaagacagaggaggaagaatttacagtataatacttgcaccactcaaatcacaaaaatacacttgttagtcacaaaggaggggcccataacattgtaagccttattttggcaatgtgaattttctgcttgcaattaccttcaaagtgaagaaatggcagagacgaagaatgaggaattttgttgctgcttttgtatgtaaattcgaccaaaatatatagtgctatgtgactttaccccaagctcactagaacttcggaattatgcctgccacaaacatcctccgaaagcacaagaattagtcatagatttttttagtcaaggaagcctcagactgataaagtcttaaaactagacgcaaggactgtgctttggattggataagtaatgactatactgcgtggttttggtgtgtgttttttagagttttaaatttacatttccccaagcaggaggaagggaatgtaccacaccctcagcaagcaaggaaggaatttagttgattttttttaaattctgtagtgttccttaaaatccacatagcatagcataacattctatataattctgttgttccataagggattggctaagtatattaaggatacaaagggaagggggagatgacaaagttattgctattttattttcaagtgacagaaaaatcaatcgagctataagaagcaccagttgggaatgttctgcacattaactctttaatagccttagacagaaatcagatgatcttcacactgaaactctgaaggacatatatctttggggcactgagtagcattagaaactgcgtccaagccatggctccacctctaattgcatgaactgaatggcttccctttcctgggactcgaattccttctaaattaaggtagaacaagatagtcttgaaggccctttcatccttacgatttaatactgacaagctcttcagcttctattcaggacaaacaccaccaaagtgtatggatacaatggattcaagtagccacactcatggacagtgacaaaatcccacagctttagggtggaatcaagtatcatattggcctagaatgtattgatgctgccaaggtgtggggtgggggtgggggtgggggtggggggcaggggtgaggtaccactgatgtgtgaaatgacttgcctaatatcccagagacccctgaatcccaggcattcttattctgaatagagacttttaatcaatttcttgtctcatcctatgtcctcatgttaccatacttctacaagtctgtgctgccagtgagggttggcaaatcatcccaactcagaaggacagacttacaaaatggcataatcaagcttcactaacactgtatataaagtaaaagtaatagattgagtaaaagcatgagagattctcttgggagtaaaatgtgcatgctttaggagaagatttggacttgtgttcttatttgttagttttctgcaataacattaatatttatcatttgggggaggttcataatgaaatacttggttatagcacaggaactaatgttagaaagcaggatgacctccttaaactttcaaacccaaaccaagtaaggttttgggtcattcccattccttctgcctcaacagatctacaaatctgtaggtgttgggcaaagtggtggtgactcaaagaaggaaaagaatggataataaacagtgtcgtgtgtaagtttccccagatctaagaacagagagggacaaagaaatgtaggagagatggatttgggattaatcaaatggtttcagtgcaaagtcctctggaaatcacatctctgataggcctggctcaatgagacactccaacaagtgtcaagtcctcaagatagtagattccagtgatattttatgcttgtagcaatccccatgaggaaggagggctctgtttcacatcgcagttgagagagggagtcaatgagattttatgacttttttgggatcattgaggccacaggttgtctgcagagtcctagccaagtttctctccactaaatgacgctgctttgagaccagaagctctctcttttggagggggtcagccaggaccaaggcagcagttaactggcctccaaccaactttcatgaggctggccttattaaactaggtctgaagaaaaactgagtcaaccatttacagacttattatcttctttctaaaggaaaatcataatgccttgccaaaacaaatgtaataacttggccttttctttcaattacctctgctttcttggaaatgtgtatctgtggataaaacctctgagttaacccagggaattaaccagatgtttaagaagaccctgtgattcctgtgggccagcaaagaaagaataccccttggccacattatgagaatggagtactaaggagaaagggggagcagaaaattaaacttgaaggcccaggatttaaataggcatagcagatagaaatgttagctcagttttgggggattgggtgacactggaagcaggttttggaaatccaggcacaagctgtgtccttgaaaagacagtctcatatatttccagagcccttcatttcattttcttcagtctatattctacccccatcttcctattccacatcctcattacactcccatttcttcaacagctaccttcaggacctacgatgtatgctaaatccagggaacattcagagggcccactatctcgacaaatttcctattacaactctaagccatcttttgctgtatgcaataatttcctttggggagtgttggcatgtaatttctgaggttcagccctccctagcatggcccagaaacactgccaatatttacaatggctggtgtaggcagttcttatgtctcaggagttggggatcccttgttaaggaagtaataggccaatgatcagtaaccatgcagtgatatgagtgcatggtttggggaaggggtggaagcaaaacgaaaaggtgggggggattgagctttcatcttctgctctatctgtgtagaatcagtttcaccacactcatccctttgtttcccatagaaatggaaaggacaatgggaggaaggtagcattaagcttaagaatatggcttaggattcaatcaaggactgtgggcttgagtcttagccctctcatttactatctctgcactcttatttactatctctgcaacctcaaaaaaggttcttaaatgagcctcagattcatgtgaaaattgaagaaagtaaagtatttacttctttgggttgatgtgatcattaagtgaatctttacatgtgaaacgctttccatagtcccccagtcttccaatatgattactgcttttgctcccctacaagatttagtcagggatagaatgtggggggtggggggaagaggtggtagtaagaggctatagaaatttagtatttttatattataaattatacatcattattttctttaatttagcaatccttttagattcatcattttatgagaagaaaacttagaaaacactaaagtttgagatcattaagtttgagaattggcatgtctcaagctcctcctctccttcccacatccccatacgggcactttctctagaactgtgcagagctggcacatttattaggccaccatcacaacccttcagagaaaaagtaagacctaaatgaaatagtcgtgatcatttcgtgtcttgatgctccctgtgtctcattacctctcagggtctctatcaaaatcaagggctgcaaatctttcaatagagaaatctattagcatattttccaaagaacaaaatgtacctattcctgctgtcagggctgctgtttgtaggagtctctggtttaaaaggccctcgttattatgcatgggtgtgcatacaaacaaaacttctccgcatgggaaaagaattttcagctttcagtaagaggctcttttctcaattcctccaccatcactaccaacctacaccctctaaaaacctctccaacctccactgattctttctttcctctcctttgaaaaagtccggacttactgtataactacatatatgttaaaatcaccaactagagaaaataaaattgagtaatattcttgcaagtagcagaatctcaaacatttgatggttaacttggctgctttagtcaattggatgattcatacaattatggggactggttagaacttgaatggaattggttggactggcacaggcaaacttctcaagacatgtcctcccctcagccttggcaaggcactttttgggtctgtacagctggactccatttcatttatcatcacatttaatattttcttccttttgatgttacctgattataaaaatgagaaatcagttttagtgctattctcatgtttccctgcattcagatttttattcaggcctaaaagtcaaggttttggggaaagtgggaggatcacctaaagttgataatctaggctctgatgtccgattgactggagttcaatcccagctttgaccacgagtagctaggtaatcttgtgcagttttactagatctttctgcacctcagttcccttacatgtaaaaggggtacaaaaataccaatttgccaaggttttgtacagatgaaattagacaggctttggcacatattgcacattcaatacatgttaaacattttatcattttattaatatatctatttcaagatgaaatattaatataattagttgatggtataattagtaggggttctaatttcatacattctcgaattcccaataaataagtgaaaattatcttgatgctagaaaactacatcctaggaaatcttttgttgtaaacttagatgacgaggggctcttttctacccacagctcccctagtttactcaagctccatgtctcctctttaccaaccccgtgtcggcatgtagccccatcctgagcacacagtacaccctaatagatattttgcaaatcaggcaagtagcacacaggagttttaaggacctttatataatttcaacaaattcaaaattctaaatctccatagaaacacctttatgaggaatataaggtaagaaatatttctgcagtttatatggatttaaacattttaaggtcaaatcattgtaaaatgtcatgtaggaagggaaggcctgaagtctcaatctgggtttcaggcagggaacctgaaaacctcacaaagccacacataacactattagctcaaggaaatgtttctcactgtaacaggaaaagggaaagttcgaatagaagtctagacaggttgtactgaaagaacaatcagatgaaagagcaattcaagccgggcatcttgtgcctgtaatcccagcactttgggaggccgaggcaggtggatctcctgaggccaggagtttgagaccagcccggccaacccggtgaaaccccgcctggccaacctggtgaaaccccgtctctactaaaaatacaacaattagctgggcgtggtagcaggtgcctgtaatcccagctatcgggaggctgaggcaggagaatcacttgaacccgggaggcggaggttgcagtgagccattgcacttcagcctggctgacagaacgagactccgtcacaaaaaaaaaaaaaaaaaaaagagcaattagagattgttagcatgagcatgattacactgcaagaaccaaatagttaagttttttttaagtcaaatattgtaatttcaattactcttttaaaaaagagtaattgaaaactctttttaagagtttacaaaagagtaaattaaaaacatgctcttttaaaaaagattaatttataaggttgcacagtactcctacaaaccacattagatacttctagtagttaacaaagaggaaaacaatgacattttacaaaataaaaagcagaattgaatacagaaaaatatgacttaacatcaaccaaaaaccaattgattaatcttgtcaagattcttgtcaagattctcaccagacacccaaatactgaaggattacaactattgcatcattaagatatattaaaagaaatgcaacaagcttaaaatctaataaattggagagtaaacacatatactctgcataactgtaatttaatttcttaaaattctgcaacttccaaataaacaacagcagcagaaacaaaagctcacataaatgggtcacagtaaagaccagttgcctccacttaaacaatactagcacaatcgtgtgggctacatccttgaaagaagtagataatccatgcacaatttgagaaaattgattacatatgtgtgtatgttatatcttatacagtatacattacatcctcaacattaaaaatttaaaaaggccactcacataagttaccttttggaagaaacaatgatcttttctaaagaaataataattggtgatttgttgatacttacagtttatgtttggaatagtctcatttatgggtatgctgaaaacaatgcaacaattttctattaatccagttctgatcttcatactcttagcagttttagaagagctgagaacagtgacctgctttttcaaccattatatttctgagacatgactaatttgaagctgagcaaattgcacataatgggattcaagttcatgatttttagtctgcactctcttttcagggtacatggtctccttccctccctgcttctaccaccacccccaaagctgccttttcaggagctaaattcacccaacatgaaatcaaaagagaattatttttaagttttctgcaggcttatttttaaggaggataaagttatatttttaaaaatatttatcttttccttcaggtactaccgcatttttaaataatttctaaatatttagaatgtatttagatgtatttagaatagtagatgtatcagatgtatggtttcatagtggctcaaagtttttaaaaaagcattatataaatcagtgaatttataaataccctaagttctactatgtaagatgttgctttcagagcctttttgcaaaatcccattaaaggtttagcttacagacactggtgccaaaaaaaaaaaaaaaaaaaaaaaaaaaagcaagcaaaaaaatgtgtttttttttgtttttttttttttttggtaagaaggatgttgaaataggagaatatttaagctggctaaaccaaagccaattcctggaggctagttgcttttatagtgaatgtttaaattttctccatcaaatctagaaggctacaacgaaacaacagcctaaatgtcatgtacaattctctaagtactgaaagagttacacaattttagaaccgaaagggaccttaaactccttcctctaccaatgaggagcctgaagcctgctagttaactcacttgcctggtcactctggggttcacggattgttattgtttggtggggtggttgtttttgtgctgtatatttgtgtgtgtggtgtatgcagtactcacacccttacaaacaagagctttgccatttatattctccccttcctaagttgctcttcctaagtttactttcatcagcaaaaagagtgatcaaaaagaaaaatatattctggccagttcaaaggggacatttctttttctcacttggcctactgcagatatattagagagacacttcacacccaggacaactgactttttaagtggcaataacaatgagcagcggaggagttctcttctcactcgagagagcagaggaggtttctgaactttaccttgacttccagcctacaaactgttccttcaactactgtctccgcttgcccactttgttgctattctttccttagtttcctttgttttccagcttagggaagtttggtgggaaaatttttcacttacattttgttgatatttatttcccatatttgggtcctacccaaattttagatttaagagcaaaaaaaaattactgtttaagtgaaagaggaaaggctaagtcactgttcaacatgggctagatctgatctgaattggagacacagcctttgcaattgaggaaggagaggtaagcagtaaacttatacagtttcctccaagaagtgttatacatagatatttttcaaggaaattggaataaagcagtttattaattgaggggaagctagttacagttagcacctgccgcggactttttgaggttgtcgtcattaaccaaattcttcgggaaaaacaatctttggcaccacttactccagacaaaccctgtttggaacagacaagtgttctgaccctatagtcgctccaatgtccaccagccactcacgagtgcccttagggcttctccttggtggtagcatcccagaaatcctactagtttcagaagtgccctaggaagcctacttcttggataatgggctctgtctgcaaagctaggagatcagcctagaaaaagaaacacaccaacaaacaccaggaaactatgtgtaatggtttgctgcttgtgcaaaaacctcaaagaggatgaaggtcagacagggataataggccaatttaattctgaaagcacaaggtgcaagaaattttaattatggtctgccactgaaatcacacaagatccaatggcatctaactgcaactgctcatcaagggagacaagaggtgtaattgtaaccgctgcataatcactgtgagggcacagggaaggctgccttcagctcccagcagagaaggtattaagagcctcgaaaaatccaatacggggaaacgagattgcatgtagccaaacagaagctcctaacacaaaagccaacccgtgtgtgtgtgtgcgcgcgtgtgtgtgtgtgtgtgtgtgtgtgttgagggtgagggttccagaaagaaaatgtgaagctgtttggcccacactggggataagagattgtttgaaaactctgaacccttttctgttttgtggataaatgcacacagagaaaagagcactgtctcctttaggtatttctctccttgatgaagcttcacccactctcctttgtttaagacaattggcttggatgttaccgtgatttacagtaccaaactccctttaatttgttcccatcaaacccaagtctggagacaaaacgccaagcacacgactggaggtgcccaagcctgtgcagctctggcagcgacgccgccggcgcccccgggcgttttccccgcaccccacatcgcgtgggcgcccgtaaaggcacgcgcggagaaagcccctccgtggactccccactccgcaaagtttaacaaagccgtgaagtaaggaaaccgaacctcccgtccgcgcccgctgcaaagttggcattgaagtttgtgccgggatgtcccaaatcttgagggggcggggggcgcgagtgtgcagagaggcgggaggatggatgcagatggggagacagtgaggggaagggagtttttccgagtggacggtccgtgaggcggttttcttcacccggaagcctgtttgactcagagaggtccgggaggtgcacgccaggggaggtctcccggggcgggcgctgtcgccgaggaggccggcgagctgtcacctgcggggggctgtggtgggagctgagggcgctctcctaagcgccaaaagaggacggggacattcacagtcaccggctctcggggctctaagtagtgggggaagggatattcacgagtgggcaggaggccaaaagcaacacctttcggatacgcttttcccctccgacctctccaacttcccgcggcgctggtcaaggactccctcccaccccaccccatcccacccaacctcccggccgacaattcggacctgtccacggcagagcgtggggtggagtgcggcgggaaagcagagggcgcgaaggtcgggaccccaaattgcaaaccctcagcccctagcaaagacgaccaaatgcatttacaaccgtgcaagtatctcagccttgtaacagagctccgggtttgcgccgggcacagttccccgactcttctgttgttcctaataaagtcgattacgttgccctcccggagctgattggaagggaaccgagaggaaaagggggggaacgcgggaaaaagcgggggggggggggggcgagcaatcaactttgtaacccagcgcttcctcgcgcgatccgtcgccatgcttaagattcccacccccgccgcccccctcttgcctttcaagtggatactgaaactaggccaaaactttttcccctccttttctcttagccactagactggattgtgccccacggagccccatggagctctgctttcttaagcacaatagccggactaattagatcatagaagcaaggcagtgatactgtaacaagtagcccaagaggcaaagagggaaggggcccgaaaagacagaaagggggaaaagtttgcagctctccgcacttaccaatcaagcctcccaccagaaaggcgatgatttggaacacgagcagaatcccaccaacaatgcacagcttcttggtgctcatgttttctataattgccccagccatttttgcgccccccctttttcttttctccttgaaataaatgttttagggtgagctttttgctccctcctctcacacactccctccttcctcgcctcctttctgggcgctgcaaaacttcagaggtgctggagcgcggcgaggatgggaccgggacggaaggcgcccgcacggattcccccggcgcagccggctcgggttcccccaatgcccggagctgtgattgtggccgctccgccgcctgtggacg

SEQ ID NO: 844 - DNA, 107245 bp, Homo sapiens
gtatgagttttagcaggaggggatatgcatgtacacatatgcatatacatacaggtttatttaaatgattggatctacacttttggaggctatttgaagtatcttatcaaaataaaacgcattttaagcaagaagttaaaaaagcttttcagacccgaaggccatttaatacagtaaatcttacttgggtagtttagcaaacattttttaaaacccacatccaacagattggttagtattagatacacagatttggtttcaaagctgaaatacccctggtggaataaatcttctcatgaaattcagttatattatgccacaaaacagggacacttatctattgacaacttaaatattaactcagtgggctacctggtgatataaataggaaaaaaacagtggtcatggattaggagtgagaagactatgacaccagcctaccttggactgggaccgcaaaggatgttaaaatctatcctagaatttaaaacaggaaaaatgtcaaatattccactccccattcggcccaaaccatcccccaaggaatacacccccaccccacccccacatgaggtttactaaccagctgctacagatgttactatgtcactaattaacaatgatcacagaaaatgtgtcataccagagtttttgttatcatacacaatgcattagtggctgcaggaatcttcctccaaaagctaccgtcagaaggcaaactgacaaatgtccatgccgctggtccaagaaaccacagctaagagccatgaggcattcatttgtacattgagctctctctggcatgctccccactctagttagaggggctggggtatggagagaccgtcccagccgggcgctgcagcctcctactcctgggcctccttgcgggtcaacttgtagatctcagtgggtccgtccacatgggtgatagtggtggtgagctggagttcttccccactatggacacccagatcgcctgaaacagggttttcggtgttagatgcattcaaggaggaaggagaagcaagctggggttcatctcatggacaactgccctgatgctagccctctttgacattctgagcacacagagacacctagggcacacaacattcagaacaaggactaactccaaacctgttcacttggactttgcagaactttttaaaataccatttttggctcctagatgacagtcattaagatacgtgagtcagctcactgctgatattattcatagtaatcattaacatttaatgagcatttactttgtgcctgacgctattctaatcactttgtaagtgatcttctttaatcctcgcagaagccctctgaagtaggcagtatgaacgtgccagccttacagatgaggaagctgggaggtaggcaaggtaattgtcctgggtggaggagcaggcccacaagagagctggcaaaggaacatctgatgccaagaccaatgtgatgggctaaaccagcataacacccctcccaacggatgggtcagtcaggcaccaacacatttgctatgaataatttacaaaataggagccaggtgcagtggctcaggcctgcaatctcagctactcgagaagcaggggtaggaggactgcttgtggccaggagtttaagatcagccttggcaacagagcgagaccctgactctaaaaaaaaaatttgttttaattacctgcgtgcagtaactcacacttgtaacctcagctactcaggaggctgaggcaggaggatcactggagcacaggaattctaggctgcagtgagctatgattgcaccactcactccagcctgggtgacagagtaagactttgactctaaaaaaataaaaaaataaactacaaagcatctatgtcacgtgaaagcaaataagacctgcttatatctatccatagattggggaaggagccatgtctaacacatctaggaacaatgaggggctttattctccaggaaaaaagaagtgccagaaacgtgctgtgcatttccttctgccctcaggattgtcctaagtgttctgaactcattatcagtggacagtgttctgctaaaatggaataatttgaacttttctaaattagtaggagaaaaaaattttctctaagttaaacctcgaaaactctgctacctgccataagacaagtgaatgtataaacaacaaagggaaaatggaaaacgcaaccacgctcagtctgactgtgtgtgggggtgcacgtgtgcacacatgtttgtggagaggggtgctggggaatagaaagttaaacttgtgtcagtgatttttatattgtgcacatatcatatgataagttttctggaactgaagtttttctaatttaaagcatagaattaagtaactaaatgctgttttccattgaaatgccataccataacttagaagcagccttggccctacccttaggactagtaatcttatcactaatttaagaactgctaggcatcaatgaatctggtggccttagaaccccagatgtcactcccacccactggcccagcaggctgcttggctggttcccttcacgtgtgccacgcagtattagtttctcatcgtagacccatttctctgtggctgcacagcaaaatcagtcctattattaaatgccaccctgtaagctctctacccaggagattccctggcctcagaagcagactcattggctgctgcagaggactgctgaagacatttggggctgttttggcaagggtctaatccacaggactatgggtagagaaggcattaaaggggcatcagtccagcctccagcacatccacattcatctgccctcaagccagagcatagatgccaagtaaggctggtgagaggctttagctgggctactttgggccaagctgaaccaccacttgtacagtgagcaactactcccaggccaataacttgtattctcactgctgcaacatctagtccacacctcagtcaagcacaagcagtctaagcttcacatttctcagtcaaagctatttctggatttgcatatctgggctagccatcagaacttcaaagccagtttcatgatctgcatgtctgtgtgagtcatcaaaatttcaaagagtcctgaccaccccagtggacccattagcactcataaccgtttacctaaggaatccctttccctgaggacttcttagaaatagatgctagagagtaattctactcaggctttgaaccaaagatgttaattctttaaacttaaaatatgactccaattagcagatcttagaatatgcatatgatcctacagatcacttgaaaaaacagccaaaattgccttggcttctttatttaaatggatacctatgtcataatgcttaacacgtgcctgacacagttctaaatactgtacaaatattaatgcacttaattctcatagcagtcctcagaggcactattatcatcactcccattctgccgatgaagaaactgaggcacagagaggctaagtaacttgcccaaggcccaagctgctaaatagtgtgtgggattcaaataaataggtgccaggatgcaggctctcaacttttgggttctgctgcctcttcttaaatattcaagtttccagcagccagtgagactgccagtgaggtatgaagtccacacacacagcattacagctaaaaatatccgcatacagccgggtgcggtggctcacatctgtaatcccggcactttgggaggctgacggcggcggatcacttgaggtcaggagtttgaaccagcctggtcaacatggcaaaaccctgtctctactaaaattaaaaaaattaaccgggtgtggtggcgcatgcctgtaagtcccagctactcagtaggctcaggcagaagaatggtttgaacccggaaggcggaggttgcattaagtcaagatcgtgcccttgcactccagcctgggtgagagagtgtctcaaaaactaaacaaaacaaaaaactacacataaaataatttgaataaattgtttagcatatttactttgcttttgtatctgataaatttatagcatataaatcagtgcactgacaggagagctgttataaatttatgagtattggccatatgcactgttaggggtttagcatgccctgtatttccttgtacgatgtgaagctactgtggcataattaatttctctactgtgctggatgaggacccagataatgggactccatgcaccaaaatctatgtttcacatgtgattttattgtaccttgaaggccaactgttcccccttggggaatgggtgtgtgaacgtggcagtaacatagcacgagtggagatccctccacttgcctcctaattccatcacctcctacttctgccaaggtcttgctccatctgttagtttccccctctcttggctcctgctgttcagtgcacaaacatgctcaaaagtctcttcccatctcagacaagaaaaaacccttctgaaaatgtgatatgtgtcttggggtgaaaaagagtgagaaagaaaaaagaaaagaatgctttagtttgcagtaaatttctctccctggttatgatgtcaaattcatcacagctcattaacaattagatgacggtctatttcttcctaaccttgtgaaatgagaccaatctctggcacagatttcatcccaaaggactacggcaatgcatccatatgtgtggagtcacatccacaggtgtgtaagcggctgcttggttgtaactgcctggaatgcctaatgaggatgaagaaagccatatgcactggagacagcttcttaggaccggcagcattttaatgacaattgtttgtgtatctgtgcccacttcaataaaaatgacaacagctactctcattctgaggatgtattacagattccgggagagatcggaggtaccactagaggtcttctaatattaataaggcctacgtacttccatcctcaccactaccaatgcaaattaacaccccactgcccaagtgtgaaagccagggagctcccataccatgagttcatatttgttctcaaggtcatacacaatgtgtgccggagccaagattccaaaccatctgtgtctacctccaaagcttatgttctttccagaacattcatgacctatccttttttgtagaattttccctaggcccacaccaacctctctcctattcaccttcaaagctaagttcaaatgataactttttgtaacgaagtctctggttcacagcagaatgagaaaaacagaaaagtgtagtattttaaagccaaattattttcatgcaaagaactgcttaagaatatgtctgccttacatttttggtgttaatatgattgttatgttaaagaacaaaatagtgtcgctggtgcagtggcttacatctgtaatcccagcactttgggagacagaggcaggaggaccacttgagcccaggagctggagaccagcctgggcaacatagaaagatcttaaccaaaagaaaaaataataataaaatggtgaatggtaggtttcttcttctttttttttttttttttttttttagatggagtcttgctctgtcacccaggctggagtggagtggagcgatctcagcactgcaacctccgcctccagggttcaaagagattctcctgcctcagtttcctgagcagctgggactacaggcgcatgccaccatgcccagctaattttgtgtgtgtgtgtgtgtgtgtgtgtttttaagtagagacagggtttcaccgcattagccaggatggtctcgatctcctgaccttgtgatccacctgccttggactcccaaagtgctgggattacaggcgtgagccaccgcacctggccttttttttttttccaaagaaagtaaatacccaggacagtatgtggtatatagtaagtgctcaaaacacccatgaaagatttgcctggtgcaggcaagggcagttcctctgtactctgcatggctgggtctagcctagcatatcggcactggtgttcttccccactggcatttaggaaaacaccctcagttagaaaacaagtgtgccttgggatagctcagctttgaggatcccttctgggagatggggcagagtggctttggtggacagggttaagagccctgggtccagttgtctctcggtgcctgtcaaccccagaggtcatttattccaggcttggagcgagccattgcccatggacctccaaagcacctcctgacacttactgccaggcagtaactgcaagtgggagaagaacacaatagaacttattagtttgggggtaaaatcttggtgttacaggctgaattgtatctcccccaaactctcaaattcatatattgaagttctaacccctagaacctcagaatgtgactgtgtttagagatagggccttcttaaagaagtaattaagttaacaatgaggtcaattggggatgggccctactccaacagactggtgtcctttgaaagaaaaggagattagaatatagatatacacaaagggaagaccacgtgaagacacagggagaaagtatccatctacaagccagacagagaggtctcggaagaaacccacgttggtgataccttaatatcagactgtgagaaaacaagcttctgttgtttaggacaccctgtctgtagtattcgtatagcaactctagcaaacatttaggaagccgaaggttcttcccaagaaggtaactgagatgtccctatcatggtggggtgacaagaattctaagactcagaaaaaatgattttaattgactgggccaggaaaggtcaggtcactggcacagcaatagccctgggagaggcagggggcagaagacacctgattacaaacagctgagcaaggggtgccaggctggtgacggtccatcagttggttcccaccttcactggggaatgggaaaacgcttttaagacctgctttagggtctgggtccagcccgtgtgacaagaccaatcccatcagtgctcacagacatcaagaagctcagctggccatgggcagatcatctaatgtacaatcagggagatggcgtcaataaaagggggcaaccaatgtcagggcctcaggacttaatccaacgctttaccgaggcaacaaagccaaagccatctttcctatgaaacaaggggcaggagacctcagaaacctccaggagtaaaactgacatcacactgtagctagctgccaagacgcggaaccagtgttgccgcttttgctccccgcagagtgggtgcattagacagaaaatgcttagcgtgaacagaaataggagggaatggtggcagtgagggcatcttgtgttccctctgccacagtcatctagttgggaattctgtgtctcacttctttttttaaaacattctgacaagaattttataatcaaaagaacacaaaaatcaaagctattatcaagaattgtctgacttcataagcagctccaacttcttattcccacctgaattgtggttgagtgggtttgcacagtttttcatgtgtgcagggctttgctgctggagccccgggaggtggtatttttgctctgagaagaggattcactttagcctgctgcaattcatatctgcctgggaagacatccagaatgattcacaaattggttatggcaacaggtaaaaagaacaactgtcatgaaaaggcagcagcagcaacagcaacagcagcagcagcagcagcagggcagaaaatataagtgttccttgaaggaaaggtaactaaaatatctttgctaaatttaaaaatctatatgtgcacgtgtgtgtgtgtacactcagacacatatgcataaaatgattacacatataattctatgtacataaaaataaaatgattaatgtgaatgagtttgcacattcactgccgctatggtccaccagccaataggaaggaacccaggggaagtccacgaaagcctgtggctataaagaatgtggcgccacactcccgcagcacctatctgctggtgagaacactccagtgtggagttgtcctgccacctttcaagaggtagatgaggaaatcttgtcccccagaccaggctaaagaccccttgagagcaaggactatgtctctgtcactccttcgagcttcacttcactccatctcattcaagatggcacaaggctaagtactaaggaactaaggtatgaggtatgagctaagtactgaggtgctccgtggttcatttgtaaagggtcactttctgatccatactatgaaagagaaacagaaatatatgagaaaatgctctttggaaagtgaccttgtcttgaacctgtggcccactttgttcttctctgtccattctatgaccaaaagagagaagaaaaagtctatcgtgaaatgctcaatgattccatttccttcctacccacttctacttcctcctgacacttggcatgtccctccaactcacataccaaacaacctccatcaaagattctttcccttttcttattgcctttggcatcagaaactgcttgtctgtgctccgtccaggatccatctaacaaaggctgaagccccacacacctgggattcactctctgtagcaagatatctgaattcctagctctgaagcttcaaagcaaaggagagaaagaaatagggagggaaaggccaaagccaacttaaagacttcccatgagaatggaaaaggagcatgggaatgctggaggtggagagagaatgccatccagagactcagagaatgtaaagacacatgtatccttccttgcaagagttcttctttgaggtttccacataatattccaaactaggtctttccaaggaacttcgaaatcttggcaaatgctccgtaattcctaggatacatcgtgtgatctggtggcagatgaagagatgaaaagtgaaacaaaatagagaagaaaaataagcagaatgcccaacatggaagagaccccttccaaatgcacaaggtcacagcaccatgcaggaaagggaagggcccacaagctgccaggggttcccgggggtgctgggaaatcacagatcatgttaccaaaggagaactgctaaatcttatgacttttgtgtttaggatcagcatatggtccccaaatagtttgcccactaaattgcctgaagaatgttttttcacagagggtctacttggcatttcacaggcaggacatttctttatgacatgagccttgttttgcctattgaacaacatttagtagcacccctagaatctggacactaaatgccaaaggcatgtcccagttatagtcacaaaccaaaacaactgtgaacatttaaaaacacccacttagcagaggattcaggggatatgacctcttgttgagaattatttgcaagttttccatgaaattacagatcaagctgtctttgatgaaaaactctgttgaggaagagtgaagtgcttttctcaattgcaacatttcaagcctaggagactggctactgtgtagggtgggaagtcctgatgggagctgcctaatatatggctcaaatctcaagaatctgtccaacatggtggtctgtagtcatcctgcctctgcagggttggccacagctctgggctcccacttgctgaacagtgttaaagttggacacgttctcaccagtgtttggaaatcccttacctatgacagatatcactctctgggctgccacttagtggcaagaagtgttcttctgccccttccctgctaataggaagaaagacaaccatggactttcttttcttttcttttcttttcttttgagacagggcctcctctatctatcacccaggttagagtacagtggtacaatcatggcttactgcagcctcaaactccttgggctcaagggatccttctgcctcagcctcctgaatatctgggactacaggtgcacaccaccatgcctggctttttttttttttttttttttttttgtagagatggggtttcactatgttgcctaggctggtctcaaacttctgggctcaagcaatcctccagccttggcctcccaaagtgctaggactataggtgtgagccattgcacccaggctaaccacagaaattcgtagttcaaaaggacttttaggagatcacttacatttgggagcagtggtgcacagagggttaagtgttttgccaacagtcacacagtaaaaacaaccaaaagaatttatgtacataaagtgctgtagcacacagtcagtacttgataattatttcccaccggtattatcattccatcatccaggaagtccagccattgctttaagtggtatttctctggaaggtagaaactctacctactcacatcaaggacaaggccacatggtttccttcagtgtcccccacaggatgaccatggaatgaaatcaagattcttgtccacaagcccagcagtgcttgctgctcgtgttgtggaagcccactgcttgacaggctgaatgctcccattttccacatgtacagtaaaaacaccgagtggtgtttttactagaaatggaaaggaagaaggctgcctagctcacaagccttctagcaaaacagtcagtcaaaccaaagttgggcagggggtaggtaagtaaatattctgtattctcacctcagaccagagatgggcttgaaactgattgtaacatgtctactccaaagaggtcaaggggtgagggaaactcatgtccagcatgctctcgcatggacatggcaaatacaggatgaagacagacagtggctgagaccactccacgtcccttgacccccagcacagatgccttcctctcctgctccacttcatctcatctctcaagtaactacccccctcccttctccccacaagatcactgaaggctaatctagaactcttacttctaagcattaattcactcaatattttaaaagtatcctaaagaactggtccttgccctgaaggagtcgatgatccagcaggagcataaaggcacagatgactcatcttccacctctacacaataaatgtcatgtggaaagtagactcatgatcccctaggcatattccttaggacaacagtttcaagagatacactgcctaaagaaagggtgccagggccaaatgatctaataattctggaaaatgctgttaccaccccccgctttgtaaagactgacagtacaaattaatgtactaaaggcattaacatgtattgcagtgaaaagccttattagtgctgatcaactcaatcattctcaagcatgtttgactacctaaatttatcaacatttcatggagacaatattccattgaatgtcatttgctggattctaattggggtgattgggaataggtgttaaagaagatgctgcattttgactgggcccaaaagatgagtagagtttcattagtcccagatggaggcagaatgtgcaatccactcatgcaacacacactcactgagtacttcctaaaggtgaggccaacccttggctctggggggctgctaccctggtttccactgcaaggcagagtgaaaggcactagagcactgatttgagaaagggcttcctatgtttggggaatagcaaatgcatggctagagtaaagcaggtgtaaaaagagacagaatgaggaataaggctgaaccaaacagaaaaagcatctattagatcagttgtttatcaggccacctgttacctgttaacagcactggcctagacagtgttaatcatttctgtctgctgtggctagtgaagaaaccctgagcaagatcttcccttctctaggcctcagtttctttatctataaaatgactggattctctaaggctacttgcagcatccatgtctcagtgttctgtgattataagatataaaaaggcagcagcacataccagcactaaaggacaggaagaactggggacaggagaatagctattggtttagacatacatcgaaaaatcaccttgaagaaaaatgagcagaagaaaaatgaagcctattccatcttcagctctcagggcccagactccctccacctgatatcttaggattctgcttctcaaatgggaagaataaacatggcatagtttccaacagtcaattgtgctcaaaaatgtaaagaagaaaatttgactcttgttctaaaatcaagacatattttagacttagcatgcaatattctcaatgtattttagagatttaaaaatgaggacttaaagaaagatctggcttgtgtgggctttttgtcttatgggtgagtcccctgggtgctcattcaccgtctcccagtgtgaggagtatacttggagggaaagtttcactgggcatctcagagctttagccatttaaatcttgtaaagacagaagcctatttatcctgacttaagctgttctaaagagacagaaactcaccattggactggtcttctccatagtttttatgggatggtgcatacaagaacatcagagcaaagacatacagattccacatcccatagatgcctgtgaaaaaggcactgttcacttggactgtgacgccgccccatttccaatggccttccgttacctgcggagaaaggatggtgatattcaattgaaacagagaagaaacagaagaaacataacaccaataaaggaaccaaccaacatgaaaaccaagtctcttctacatgtgggaaacatgaagggccatgtaagactccatcttttaatctgaatcatttcggtgtaaattaaggtcaactgaaggttctctagctttctgtcaggcacagtcagtggtccttaccttgcccacagattagtatcacctggggagtgtctcttcctaaaaacagcaattcattgctatccctaagttaaacaaactgtgtttgagcccatcacttattcacaattataattcctcctctgctgtctgtcttcccagctagatgtcaattccctgcaggcagagaccagttctctgctgccatgtctttaaggcctgatgcaccatagattaattcaaatccagtgtctaccactcactcggcttaatgtaagacaagatgaagactccagacttcagaacttcagtgtccgtaagtgtaacataaaagcttgcaggttatcgaagagaattaagtaaaaatatttctagaacctgcctggcaggtactcagtaaatattagttatttctataacatcccttgaagtaagccactcatgaaaataattatgaagctttcatatgcttcaaaattctgcaagagatgttttgaagctgcttttgtctgtgttaatgatttggtaattgtcttaagggctgcctaaagatatatggattacactaagaactgtcaacagagctgctgagctaagtgactaatttgtgccagctctgagacaaatgaaatgattttgaccacttctgcttactacgggacacttaaaatggaaatagaagaaagtattgggtaaatattcctttgacagctgaatgaggctgcgttgtataaactttctctaggaatcacttttaaattgtaagatggcaggctagattgaaatgttaagaactttaacaagcaggtggatttcattgcctgtttatgatacagtgggtctgtgttcattatcttctgtataatccataacccacttggggccctaggccaaattaaggtctaagtataggtatttttttctgaaagaccaggagtgtcagttaaccacattagccaattatagacttagcagttttagtttggccttggtgatacataattcttcactttttgtgactcataaacaaaccactattatgaactcttatttattttggaaaataatgcattttatataaaatgcccagaagtgttttctggcaaagatggatttcataaccattactaattttaggacaatgtaccagcattcaagctacttaggacttcttagaaatgtctccaaatgtcgctcttctttaagtgcagaatatactaactttataaaaactatattacttagagcatcttatgatgatttttattgcatataatggaaaggaaaagaaagcattaagatagtttccagaaatacaggtacctgctgtcataacacagagaactcttctgtatgtgattaaggaggggaggctaggctgtcacgcatcctagctgcaagagagaatatggcaatatggcagctcttctactctgttaaggcagtggacccttcagctcagggaagggccagtaagagaccctattcctgcgacagaagctggaaatactcaatattgacaattttagtgacattgattcttgctaggattgacatgactgacccatctaaggaaacaccaacctatgtgccttgcacacagtggtgctcgatagacatatgttgaatgaacagaggtaaagtacaggtatgtgtagggactccaggacaaatacatggaggtagaaagtggagatggaaagaaccactcttaaaagtacttgattgaaaagtaaagacaaagtattgcagtccacaagtcataataattgaatttaaaagtgagaggagatgccaatgtgtgacaagtgttattcatttaaaacattgctttccgttatacttatttaaaataagtggttaacacaaatattagcaaagctaagattcttttgtattcataacaaggataagcatatttattcaatgctaatgatgtgccagatacaatactaaatccttttacatgaaacacattatttagtcttattaatgacgctgtgaggtaggtaggtaatatttccattcaacacatgggtaaactgtggcacagaaagatggagtatcttgcccaagattgctcagccagaaagccatggctctgactccaaaagaaggtattcttaaccattatacaacacaagggtaggaatgctatcttaaacaggggttgatctctgaaggtagcacatgctctgaaggtagcacatgaggcaacgactatgtaaggtcaaatttccttttgaaattcacttcattgcccataatgtacattacaaatacaacatacatgcacacatttgtctattcaaatctgtatagtatgcactatatatcctggacatagtaacatatggtataaactggatatataaacaaaataaaaacttacagtagaaccactggaatgagatgcccatagtatgagaggcacacaccaagcctgacaggaaatatcagactcatgctcccgtctcgtacttgctctgggacacatgcacattgtttagagtggagttgcagaattacacaccctactgaatgtgcaatctgtaaatgtggtgtttcctgctgtgggcaaagagttgaactgcagaaataaacggtatagatagtgtaactctgctctttggtggctggcttgtttttccctctcctctcccaattattcatgcctaagacatcctcagctctgagcacattcccaccaatatgtaccacaatgagcagcctcaacagagcaggccttgtaaatccaaaatcttactaatgccaaggcggaggtaacagtctccccccttttaactttgagagaaaaatcaggtagccccagcccccctccgccaaaccctcccccctcctcaaaatccccaaatctcaccctctgcataagtcttatttctaaaagtccctgtttttcctgattttacatttgaacaatttacttttgtgtgaaaccacccaattatacccctggagccaagtgaaggtcaaatctctttacacccagtagtcttgacaaccaacattccacttaacaacaagatttccaaatcccagacacaggctctcttaccggaaacatttcctctgtaagtaacagaatgaagtgatcacacacacacaaaagagctggggacaggctctctgggagtttgctgcatgtggcttgacctgaatgtcaggcacctgggggtccccttaatgaaggtcggtgaccttctcccctgcactgcacttctgttccctactgccgccacctctaaatggaacgcctctttcttttccagagggaaggggctgaaataccagactgcgatgtaccatctcttggttgctatgactgaggccattaaaatggcaggcattaaaagactgcacctcagtacccagctacaaagcctcaaggtcactgcattccacagcttcccgtcgcctttcattcctggcctcagagcttcaatatcctggcgagatcccctcgcattatatttcatgaggcttaaatgcaagctctcccacagcaagcccgagagtataatgggggttttaatacattccttttacctaaggctgggatccatttcaaaaagttacccaataggtttcctttcaggtgagctcattgctctgacattccaaaatgacattaaaaaataaatcctctgatgactatattaatacagtacctgggacactgagagttatgccggaaaacgtcttagatgtctataaataaatcttagaaaaaaaacccagcaggaggaatgtgaggagctaatggaattcaaaaggcctcattgctacccccttagagttgaaatccactccgggccgactgtcgcagcagatataaaaagccagccacaggctgaagctgtattagaaaatactgaggcaatagaatattaatctttttctccaaagaaaagccacggactatgctccttggaagatggcttcctttgctataagaagtacactaattaaacatgtacaaggttaaatcctggcaacatgcagctgcttcagggatcagtccttcttgacttcaggtgggaggcattccccgcagaggcaagatatacatgaggcagtgtggggagaatgacgtcagcctcccaaactggcacaaggacctgtgtgtggccttaggatcaaaagcgtccttctttctgctttcctaaaaacatatcttgaaattgccttttatgcctcaacccatcttccttgagatgccgtttctccaaggaagtgctctgtgccctctcagccttgcaggtctggctgtgtcaagtgccactgtgcactactgagggactggaggaactgaaaagcattttggtcataggagggaatagccacgggagaagtcaggcctcagacactcttgtttgaatatggatgtttgagccttagctggtagaataaaacactctttcagagtttgaaatagttttactgcaaatggagtggaaagcgaagtttccaaggttttataaacaacctgatataaacacagcagtgttgtaggtcaaagcagatgtggtgaacagaacttacaaagacatatatgtgtatcagtttattttttccacgttcatttcaacctcagcagagctagcaacactaacactccccagtggcagagccaacaacagggctctagaggctccaaacttggggtcctcttgggtgtccttggatagaattcaaggggtccataaactagaatagaaaaaattatatattttcactagtctctagctgaaagataatgtttacttcaattatggatgtagaaaaatccctatagtgttagtactactgtgattttctcaatagaaatcatgatattttcacatcaattacagttgtagatataaatctgtaatatacctgtagcatctgtttcactgtaaatatatattacatataatatatagagatgattccccttgaaattcgaagtattttattttacttatttgaaaccattctaagaggagactcgtagccttcttcaggttgctaaaggggtccatatacaaaaatggttaggagtccctgtactagggaaacttcccagcagaatggagcaagtcgtgtcctaagacactatctacactactgaaatcctccattttggctaaatgacaaagcactggcaaaagagtcagaaggactgcgttctgatctctaacttattgcatgtcctttggcaagaaagacattcaagcttcttgctattcataagaacacagctactcatgcttacaatgtgccaggtgctctgctaactacatttggttgccacaatgatggttcagtcaacaacagaccacatgtatgacagtggtcctgtaagattataatatcatatttttactgtatttttctatgtttagatatgtttgaaatacacaaatacttaccattgtgttacaattgcctacagtagtcagtagaggaacatgctgtacaggtttgtagcctaggagcaataggttacaccatatggcctaggtatgtagtaagctataccatctaggtttgtgtaagtacactctatgatgttcccttaatgaggaactcacataatgatgcgtttctcagaatgcatccctctttgtaaatattacttcctgtagtcattacagcaaccttctgtggttctattgtaatatttattttgcagataagaaaattaaaccttagaactgttaagtaatccatccacagtcctatccagctaggaagcaacataaatgaaaactttctccaaagctattagatatcatagtctagcaagctaggataacaattcctgccctacttacctcgtaggatttttgtgatgctcaaatgaataatagatacattagatttaaacagtacttcccacccttcaaaacaagttatgaatattttaaaatgattgttattgagattttcaagtatagcaaaatgttgagttttggaaataaccagtgaaaagacaagatgctatcaaagagacttttgaattacatttcatatttaagtggcaatataattattacaaggaatagctgatggactgtataaggatctatgttaatgctagataaaaatggaatcaaatttatgcttgttagtgttgtgctacacggcttgataagtttttctcataagtaaataaaatatgtgcccttcaatctggctgtaggcttttaatttatttggaaacttttatctcctacaaggttttacggaaagagaaaatttagtccatttggccaggtgatatcaagacccagaaaaatatggcttgaccagctgtccagaattatggcctctctcctcctttcctcagtggctctattgaatttctgtgcagggtagagggatctctgcagagacattctcaccttgacatctcagggtccacttacctgactaacgatgaagaagatgacagtcatggcagcgcaggccaaggtgataagcatgaggaacttgaacctaaaaattagcccctattagaaaagaaagagtagtttaatactccatcagctaccaatccttttctcactatgtaaatctataaaaagcttaattttaaagaaatctgtaaaaccaaatccctaagaatgacagtaaaatagtttcccatagtaatatttcttctgcagaggtgagtgtggctgaaaatttcttgggccaagtatttcctatgttcttatcactcataaagcagcgatacgagagcctgggaaattatattcacaacacgtcgtgaggctgctaatttccctgctaagctggttatgcttctctgcaagggttcaaagttaccaaatccaagttttctgtggttgtaataaaattctgctccagtgaacaaaaagaaatgtgcatattaatcaacatgaagtggatttggttgaattttctcatgtcactccagctctggagacaggcaagccttagaaagtgcctgtggtttcctaagagcaggatttaagagaacctgtgtttcagagagggaggcctattattcaggggctcttctgtgcagatctactgcatataaaaactctgaggttctgtagtttctgcttctcttttcatacaggaattaggcttgtttctccaaggacagccacttaggcatgaacccaggggatccctgataaatcaaggatgtgttgcttgcattggggatttgaggatgttaagtgtttctcttgaatgaggaacataatctataaacagagattactgaactctgtctgagcatctgctggatattttaggggaatgtggcctgttaagagtctggaaatcagatcacgtgggctaaaccctgtttaattacaggacagggttgattctgggacagaactttgactaaagcctcatcccaacaaaatcccaattatgccatagtccaatctcccagctagtatgtaacctacattccatcaccaagctgaagaaccggctgaacaagtttattcattactgaaaatggaaacacatttgtaccacagaaaacaccaagatttaggccagctagatgcttctcagagtaagatttggcctctaattttgcccagagatcctacatgagaatctctcaatttgtatttcaaagtaaaggctttctatctccagggtgtgtgtgtttacacatcaagtggaaagatcaagcaagcaccagttccagaacgagccaagaaatctgcccacctcatagtgtagccgccggactttgctcatagctggcaggctggactgcttcccactgatgttccgaaacacctgaaataccatgaagcatagaaacaggaagtagaggcagaggcagattccagccacgatgatgaaggccatctggtcgtgtccagtaaaggaaacaacgggctagccaaggccaagttgagccgggtccaggcccttctccccaggtctgttggcaatacttgttttgtctccaaatatgtagaaaattttcaaggggataaaatattaaaacctgatattctaatgccaatgataggtttcttgacacattagtaccacagagggaggtgttcaatattgctttctaaaccaagtaagaaaagaaatggtgtcttgcttgttagaaatgaagaatctaggccctaccctagacctaatgaatcagaatctaccttttaaccaggtccccaggagatccgtatacacaataaatttgagaagcactaataaaccatatattcgtcactatggatcagatgaaaaaccacagtaaaatcaccagaagggttcaaatgtagatccccaggtccctccctagatatatggaatcagatattccagggctaggacatcaagtatgactatgtttgggaaccactgggctagtccttggagttttataagaatgcgattgagatactctggcataattgaagaggagatacgtgggggctcagtgcaggggacctgggcatgggcttgaaagtcttaaagtgaaaccagggatgaaggactatttgcaatcttctgtcaccacagaaaatcttgtccaacagaatggggattcaaggacacatggcacaggtgggagtctgggttgctgccagtatacttgagacccactagggagactgacctgccaattagagccagtctgagaaccaccaagtcttaggatagcgtgagctgccttggaaggcagatgacctgattccaacccctttctgctacaactttgcccaaattgcctttttttttttgagacagagttttgcttttgttgcccgggctgaagtgcgatggcacaatcttggctcaccacaacctcctcctcccaggttcaagcgattctcctgcctcagcctcccgagtagctgggattacagggataagccaccacacctggcccaaattgtctatttttaaaagcatttaataagtatgaacttggcgtgcatatttcattaaataatataatatctaatgcagtttctccttctttcctataatgaacatcatcctggaatgaagggaatatagttattttctgcaggacttgaaattttactcactccatcctatctacaaaattaaaaaagttgaactagatttaacattagaaacattcttcttgttgtgcagctaacatttggtgggggcataacagaggaagggtagagcttctctctcatctttgaggaaatgatactactgatttagtttgctcacaatgttcttgtgacactgagaaaccaatataaacatcatggcaagacaaaggatattccctagcacgtggcaagatatgagccatcaaggaagaatacaacccaagcctttctctccactccagagcagagtctttttctcccaagatcatttcacatactattccggaagataaaatatttaaatccagcatcctaaaagggataagctaagactgtcacttctgcttcatgaagatgacttagagtttatgccaaccaaccagaagccttggcgacttctctggaactaatcaccttagccttatctccacttggtctcaggaataaatagcagcagtgtgatttgccagcacaccaaggtcacttaagaagtctcacacataggtggtttcagaaacaggctcttccacaggggcccagagatgaacctccatggctccagggaaaagctagtcatgcttcagtctgcaggaaacagtgtataacagataattcagacaggctgcagtaagcctagcaactcggatccctctgctgtgaggataggctgtgaccttctcattttgcctgctctcacccaggcttgaaagcaagcagtaattcttcttattattagccttaattgtgctgttatgattggcctgagaatcaaagccctggctgagtacatatggggagcatcagcagagccttagaaaatgatcttggggactgggtggccaggggaagaaataaaaccctgagcccatcaaggaaggatacggccagctctgttccaatgtctgtagtccagatactgtagaagggattcgtgagttgtacccctctacaaagaaaatgagatggaaaggcaagacacaattaatacaaaggcaacgggaactttccttttcacatattcttagcttttcagctgcaggggtgagggctgtatttaggctaaaaaacattacagaaatcctaaagagaaatgaagcttgtagaatacatcggcccaaatatttttcaactgtaaagagctgtgcctttgatttgatcccagaccttgtctgaggatgtgaccacgtccagtgcttccaaaccaaaggttcccgaccaccattctccttttcaaacactcctcctaaaatgacaggagtgggcgtggtgatgcacagtttggctcagtgtcccacaaacacttgctcacctctcacacatgtcaaatatgaagaggcagaaggagccaacggcaatgggtccgacttgcttccaataccctgcgatgtggttccgctcgtgctgatcctgaggaaaaccaaattgagaagggagatagaggggagaggaagaccaagcaattctatgggggagtcagcattcgaaggacacttgccgaccacctattgtgtatcaagcactatgctagattctaggtatgagaacaaagaagatgaaaatctcttcttcaggagctcatctctgtgggggagtctggcacatacgtagaacatgacaaagcccagccataagggctctgagagtaataagaacaggatgccatgggaacacaaagaaaggcctcggctcccaggcaggggacattttgtggtccacaaaataactcattctgaattaaatttctacgtgacttgtaacttgtgtttataaaagtgactgatcctcagaagacaaagtaaagacattaaagcatttaaatatgtaaagtgtgtctattatggtgaggaaaataggcatattttctccccatccttattaaaaccaggaatgagtccccttgataaacaaagacaccaagagaaagaaaaggaaggaatgtagaatgagaaaaaagggaaagcaaagatgatcttagcctccaggtggggccccaggtgggtcagtccacaccagctccctgcggacaatccttggctggcttcctggtgctggaccaagttccatccactcccccgccctgctgctgaggcctcattctcagcgcatctctgctggaggacacctcatggagaaagaccccttaatgtagacagtttagcagtaggaagaagtctctctctctgctctcacactgctctcctggaagggcagcaggacttgagaggtctggttttcatgattgagccataatggaatttaaaaacagtccactctgctgtgaagcccatgtgcctgacgtgaagaccaagttccagctggcatatcatcttagccacaatgtgatgatgacaccattcttatttttaaccatggtaccttcaatccctcttgaaatatgatttggtgtctgtgcaaactgaggagaccgggaaggtctgtatttcagagtaataggggttactaggccacctggacacattgccagctggaaagagccaggcccacattctctgatggttaacctgtattcctggggacaggacaagcagggcagaagccagcagacaagaaactcaagctcaagggcaagaaataatactaatcattagaatgtgtgtgtttatcttaagttactcacattctgtcatttaattctcatgaaaaccccatgcagtaggtctttacatcccattttatagatgagggacccgagattcagagtgataatgtcatttgcctaaagccactcagctggtcagcaggtggtgaagcaggaatgtgaaccagagggtctgcctccagagttcccacttgtaactactagtttattctgtctcacccactgctgactagaggcaaaggggggcaggtgtcagcttggcagcctgcacagagcagctggtacagacgtctgtccctcccggcggctcttaccatcatgtgctcgccacagaagatgatccagaaggacagaagcatcgcatagaagatgccctgtcggatgtcaccaaacagcagcatccaggtccagtcaaacccgatggaaaaccattccactgggatattgataaaggtcatggaaatcccaagggcaaagatgactctgatggtgagaaaatatcaggacagccactttattcatctggaaggcagattttcaaacaattccccgaattcagttttgagacatgagatgttacttattgggtctgaagccatatgatcaatttcttctgcacagagatgcaaaacgtcctatgtagttggcactgctgcagaatgagggagtgctataccaacctttctatggaagtgaacctgacctccttaatgcctcacactttactttggtaccactgcagatggcagtcttcctataatgtttgtgtccccttgccttctcacccaggcctcagtgagtacaattgtcctctttcacctattcaggttatcattcatctgatcattaagaacactcattattattgtgatatcctcagcaactatgaattatataagcatatttgtttcaataatacatgactccaaacacatttgaaatgtaaattctcttgactgcttgtttagcttttattttactcttcccctgtcacactaagaactgccaattctctactaaaatataattcttaagtcactgatttattcatacttttttccatccccttgaaacacatatgttaattaagcacagatcatgtaccaggtattgtgttagcactatggaatcctaaatgaacaggacctgttttttcactcacgggagatacagttagtagaggagccagataaagagacaactgaatagattaggatcaggaacatcatagagttttaaagcatagagggctgctaccaggacttctgactttgacacagacaggaatggagctgacttgtgagtcaaagtgagggaagtggaaagggtgtttggaggagagggcagagcctggatggaggcatagaggcctggaagaacctgctgcatttggggatctgcatgtggcacatcaggaaatgacaggacatgagaccagagaaacaaagagggctgtgctcatgaagaaacttgcataccccactggagaactgaaatttatcttgaagagactttttattggaatccaataaaaagtttaaacaatggagtgacatgattcattcaaaaaatatttattaaactcctactatgtgtcagtcactattctaagatgctgggaatataactgtgaacaagaaaagcaaggattgtgctcttgtgatgcttgcatagagatggaatgagagagggagtacaagaaaaagataataaatgaagaatgagcatcatgaaaaaaaaagctaggcaagagagtggagagcaatggggatgtgattttacgtaaggtggacagacgaagagatcagcaggtgtgaaggccctggggtgtgggtttgagcacaataaagggggctggtgggtggtggagaggacaagtgacaagatcagaggtggaaggcacccaatcatcaaggggcttataggtcagggcaaaggagatgaaaagccagtggagagctttgagcagaggggtgacaggatctgattaacacttgaaagggggcactcctggctatcctgtgaataggctgcagggaggcacgtgatggaagcaaggaaaggggttgcgaggctgttcccactgatccaggtgagaagcgatggttggttagttagattagggtggcagcagtggaattggtgagatttcctggtgaggttgatgagaagtgtgaaaaacagagacatacaggatgactcactgctacatttccagtctgaacaactgaaaggatggagttgccttttactgaaatggggatcctgggagggaataggttggaaatgggacacaatcaagtgttgttcttggtacatgtgacattttcaatgcaaatgaagacattaagtaaagagctggaatatttgggtccagagttgggagaggctgaggctaaagatacagattaagagtcatcagagaatagatgatttttcagaccacaaaggtaggtgaaatcaacccccctagggaaagcacagctaataaagagaagaggtccaaagcaggtgccccagtcccaaagtctaagagtctggaaagatggaaggagacaggaatggaatctaaatgctggtcagcaaagaagaatgaccaacagaagggtagaggagactctgggaagaaaaactgatcaattatgtcagatgctgggatgaataaaaaaaaagtgaggaacaaaaaatgacctttggatttggactatgaaggttgttggtgatcccgtgaaaagcagttttagtagagtggtggagatgaatccagactggaaaggactcaagagagaacagaggagaagacatatgcacaaggtttttgagaagcattgctgtaaagaggagcagaaaaagggtatgtggcttcagggggaagtgggaaatgggagaattttgtctaagaatgggagatggcaggacatgtttgtatattaatagaatccagcagaaagggagaagtcaatgatgtggagagaaagtaggtacatctacaggagcactgtctttctgtaagtgagaggagctgggcttaggggagtttcttcactacaacacagacaagtatctgattctgaccacggaatatcccgaagagcaaagacaggttaaagaaccagaaaggtcagctgggtgtggtggctcacacctgtaatcccagcactttgggaagctgaagcgggcaaatcacttgagctcaggatttcgagatcagcctgggcaacatagggaaaccctgtctctacaaaaaatacaaaaaactagctgggaagcatacacctgtggttctagctaccgggaggctgaggtgggatgaccactggagcctggaaagtcaaggctgcagcaagctgagatcccagcactgcactccagcctggacaacagagtgagaccttgtctccaaaaaataaattaattaattaaaaagagccagaaaggtgagagaggtagaaccccgaggatttacttaataacaacttgcataggaaaactgcaggagaaaaaggagtccaggatgactcctggtcaaatcactggcctaagtcacacactggctgcttgaactggacaccagcaaaagcaagagcttggcagatcatgagaagccagtattcctgaagagcgctccaaaaccagctcttacttttccagaagcactgggggtcgggacatcatggtgatcctcctccaataccacaccataatgatgaagatgctgggcgtaaggaaggtcttcatggcaaaccacaccttggtgaagcctccattttggtggatcccctaggcagagaccagtgataattttgaaggtgaatattatcttagcatttccttctactagcaaatgcttttgtgggagaggtaagtggagacctcgtctgcgaatgttcacgatcaagagctttcacattcatagcaggtactgccctcatacacccttggactctcctcagagataatagaaatacatattaaaagagccctgtgctatggacctgagaccagagaaataaagagggcatcccattcacaataacggctttcatgttctggggtctgaaagaagaacatggggctttggggcagggtcactatttccaagagacttcgaattatcttaccttggactcatcccactgatattaaaatgctaatacctaaagatacactttagaggtacggattaatagggcaggtatggattaatagggcatacagggtgtatgatatctacccagctaccacccccacagtgtaccccccaaaaaagccacatttgaggtagaaccagaaatttcaggtaaaaagcagagatatcctctatctcttaacacctctcttggccgtttaatcctcattctaccctcacatcttactaatctggtctactaaggctacaagagctttttccctatgctaagattacgattaagtacatgatcaattttttttgtaagcttttcattagaaagttgcagatatcctagatggtcaatatgttgagattggtaagtgttaaggtaaatctattctataaaatgctaatcaatattggaaagtatatttatattacattcaccaatttatattacatataccattaaataaagaaagcaaggaaaacagtcagttcaatatgatcctactttttgtaagggaattactacgtataaaaaaaagcctggaaggagatatatcaaaacctgaacagtgattatttctctaaatagtaggacattacaggtaattattatgcttttctgtgtctctacacaattcttgtgggactttgttgagattgaaaagaaatggcctccttgcagcaagttctaacttttccccaattaaacaaatatgatggaaagaacctaaaccacccctattccttttaacatttgtgcttgcaaggtgaaacacataaaaaagaaaatttacttttatctcagtgttattcattatgcaatcatgactatttcatgatcttatcatcattgtaatgatcttaagtgatcttaagcccatttaaaatcttaagtgggcacaataattgcattgtttcccatttctgtaatctctcacacaaattagttcactttatgatctcagccatcatgagtatgttattattcccatttctcagatgagacaggtgaggcatagaggtgccaagagtgagatggagttcccctccaatacacatgtcaagatcaattacattcacttaccaccaaccggatatcctttatctccccaattcccacattgattttcttcttctcattcacaggcagccggatgtttaaaaggtaaaacttatgggccacagacccaatttccatgaaaggaaggacatcacattcatagtaacggccctcatgctctggagtctggaaaaagagcagagggtttgaggcagggtcactatttccaatagactggctctgaattctgttaccctggatccataacatcaattgtaagcagctaatgcttaaaggtacactttagacgtacagagtaacaatgcatactggaggcatggcgtctacccagctatcccaacctaaaacaaacatcaacaacaacaacaacaaaaaacagctgtattcaaggtagaaccagaaattttaggtagaaagcagagataccttccttctatctcctaacacctttctaggctgtttaatcttcattagaacctcgcatcttacgaatcttgtctgccagggctacaagagtttttatctgcagtgtgttgtcagggtcctctaaggctctgtggaacagtcagcttcttaaacgttcaggtggaagctcttgctgaatcattacactctttaatgacggctaattattctcctgattttggcctgagggagaagctagaagaagctgaaaatatcttctttttattcacttgccaggaaaaaaaaagacacaaggagccgttggtatttagggaaggtcgaaacagaagaaagaaagataataagattagtggccagagatacccactaagaattttctgcctccggtgcttcctaacagtccaagatggcagaagggaatagaagttttaatgaaataagaatttagcccagtgtctaggaaagcctcttggacttcgtgccaaacaatttaagagatactgcccagagcacggtggtgggaaattggacagtagggagacaccttttttttgaaaactaaattctgctccacctcaccaggactcccggctgtgtacctgctgaggggtgggggccaggggtaaagatgagcataaagaggcatgagcttcagcaggccgggacttttccctgatatagaagatgagagtctaccatcaatgttgggtttctatgtcagcttcaatgtttccttggcacctcctgatcaagtgataggggagatctaatttgtcgttcctaagcctgaatttgcaagacctccataatttgtcataaatcttcagagcaaagatccactgaagaagtgagaagaaagaagataacaaagagtccatagtctaagagtatgtaggaaggggctaggaaggggctctgccccttctgagatcttggctggtggggagggttccttactgaacagtcagagcttagaatgcagtaaacagacctttgtacagagacagagacacacacggcaaggtagaggtggggaggtgcttctacctcctcttgcccaccacggcacacataaccaatcagtcgtcaacagtttttatccctaaggtgtgagcagctcttgtcagacacaccagttgattagagttggcatgtgagatttttaaaaattcttctgtagaaagaatgctgctttttcaaacctcagctgcaggtcagatgattcttcctatatagatcatctttctctcccctccactcctttctctcttatactttcaaatcagggaggatgggggctctgcaggtactactaaaagttcactgcaggctctaattctccctcagattaagctgcagtgaggaggctgattatcctctgtggtaacagcaagagggtattttctgatttgtttccagttagggccttattttattgatggaaattgagaacttgagggcggaagggaacaaaacctacttagtctaattccatctggtgtgtgtctcgcccagggtcccaaaagtagtagcagaattgggagaaggacatgggccctgcccaaaggcaggcattgtgctgtgataaagactcctgaactccaggccaggaggctgattctagtcctgaccatgttccttgctgggtaccttgggtcaccctgcctcatttggcctcagtttcctcctaagtgagaaagttaagtaagatgatctccagggtcacttctaatcccccacgatgggtctctgggtgccccacacttccctgtcactactgagtgagtaacatggacacccttgacacaaatttacctaagttcaaattaaaagagacacattggcatctgggacactggctcaaccttcctgtctcagagacaagttcgttgtatcctgttagagacttttcttcatgcactaaagtcctgcctctgccagtatttagggcatttaagaagattcctctctctccttcctttgccccacccccagttctcccccaactccagcatgagactagctcattaggacaaattacagcaggtggcaacttgacttttttttttttaacttcacaatccaccagggactcaaaagctttaaagcaatttctcatttaatcttgagactcaagactaaatttcactgcaatcaaaaagcagagacttgatgattcatttccttcgcacttttcaagatttaatatctttcttgcaagggatcaacacatcctaaagataattaagcattaagaagcagttgcaggcaaacacccttccccctcgctactcagtgccctccatgtgtataaatgagaaatgacttttcccttttctatggataaaattctgtatccgaaagccatctagcttagatgttcaaccagtatttcaaagatgcagtcaacttgcagagatagctagaaaggtttttaattttcttggttgcatgcaaagatctgaaaatgttagctgttcctctctcctgcttcctctagtttgtctatcattcatttctacctacaaatggctttctctggaggacagccctatatttagcactcagcagagggtctagggcagtggctctcaaacttcatagagtttaataaactgaaggcctgttaaaacacagattccttgctcctacaccctgagacattgacttaataggttctgggtgtgccctgggaatctgcctttcctaaaacctctcaggtgatgctgccactgttggttctcagaacacattttctgtagctttgttctaggaaacctgcgggagggagactcccctagtgtttcaaaaaacactgcaatgggtacttaggtttacccatggagggccttagtttatatgttttctcctagtggcccatctggttaatatccgctttgactctcaaatatgtcccagacaagatgttaaattagaaggtcatcctgcctacgtcattgtatcatctagtccaggggtgtccaatcttttggcttctctgggccaaaccggaaggaggagaattgtcttgagccacacataaaatacactaataatagctgatgagctaaaaaaaaaaaaaatcacaaaaagaaattataatgttttaagaaagtaatgaatttacattgggccacattcaaagccgtcctgggctgcatgcggcccgcaggcagagttggacaagcttgatctagcccttaaacagactcccaaggtaggtactcttatctcatcttgcagaagaaaaactgaagctcagacagattatgtaagcttacctgaggtcacaccgtcagtgataaaaccacctaatctttctcctctttaggaaaaaaatggctaaagctggggcaaggtactcagaggcttcaacctcatgtttttactattttgcaggaaatcttaacagtaataggcaaaagcaaagttaggaaaggcccgtggcaggagagaagaggaaataaaatgctccgcagagcaggtattaccaaagctgtcctcatgcgaagaagggacacacctatgaaaagtaagcaaatctttccacatacctgagaaccaaataaaaactgtcagcttagacagcaaggggtcataccttgggagatgtgaaggtgcatttgagtttccgtggtactctttcatgggccatttcagtccactcagcaaacgcgtcatcacggtaagccagggaaacgtccatggagacttctgcattttctcctgcaagagaaaggatgcacgtttcagaaatgacttttggaaagatattttagaaacagctcaaaaaattcttataggctttgacttggaaaccaacgagacaaaagggaaatattaatttctatcaaactccaaacctgaagacttagaagtcataggatgaaagtctaagccaaatgctgggtcccctctcatgtccactctgccagagtcaagagcctccatttaaactcttccagagacaggggcctcactctctctgagggagcacaaatggtcagacctcatcctcccataacttgtaccatgggtcctaggtctgcctgtagaagccacgtggaaggtgatgtccttccttcttccataaaaagtgccttatgttcttgaaaaccataccacatctgcctgcattctctttcctctctgataaacatgaccaagtttttcaaccacctctcagacacgtccctctggggctcttctctggtcacactctgtctgaaaacatccttctcaaacttattcccgaaagttctcaaatataggatttgctacttttccaaaagtcaaaatcccttcatattgtggatgaagttaatgtaaaaggcaaagtgtttttccaaaattaaagacttatacacagataggaataatacataattgcacaaatgaatgttcacacatacttccatatgtgtggactggaccacgaatgagttaaactcaccacagaactcattaaggagatgagattaataaaacattgcacctattaattttgtctgttttatactatgatgagcaagttcaagagcagagaagtcttttttttttttttttttttttgagtataaaggtttaattctatttaaaaagaaagtccattaaatcaacttcaagttcttaactcatgggactattttggaacacttctttgtaaatatcattttgttaggttattggcaaaacagtttcaaggttcacttccctcccttgaaccaggtccaggtcattttgctttggggtaaattaaaatcagaattctaaaagttgagcaactttgtttttttttaattgacttagctctaacccaccattacaacttaaggacggcatgacttgataatgatggacttgtgtgaggttttgagttttcaattaaactttgtatcacatgaggtaattgtcagcattcttgagtctggttatggaataggcagatagaaccctgtagtaacaagagttggaaattggctaattgacaacgcacttgccttaaacatctcaagtagagaacttttacattagtgagatgtacttgaatttcagaactcaacaaattttaattactttttactgaaaactgcagtgaatgctaaatgtctacgtttacaataaacaaatacagtaacagtaactcacactgaaacaaaacatacttctgatagccattatttttctgcttgggacaattttaaagtttttcttttgtcacaaaaacaggaatgtatccaaacaaaggctcaaaagaggccatcttttcaaacaaaaaggcaatgattcacaaaagactgtgaatagaacatgtaactagttgatacaaatctaataggatttgttaaaatcagtcacatctaatacatctgaagtgctcttgtataaaatatcacgtgaagaaaagaagactttatcaatgtctaaaaaagtgggtttgttcatagacaatctgacaagttaccataaaaagtgtttcctgagacataaggaaatgcaacattattcttcttgaaccgttttagctcaactttccactcaataaaacagcagaggatctgaaactgagaaaatgtatttgagtacaaacagcttgtgaaagttaatactttttttttgcatcagagggtttttactgaacttacaaccaacttgcccactcagtatgcagttcagatgtgagagatgcttctctgtacaggagcctgtactgtcttcaatcctatgcgagcaagtgtctaccacaggcaaacagttttctccccattttgtagtaatgtaattttcctattagcaaaaggaggtcaccagcccctgtagacttaagggactcaagtcacaggatggggatatcctcttaatattttttattttgttgtttgaactcttgatgcaacattgtagagcagggtgttcaggacctgctgtgcccaagggactgataaaggaaaaagctctatttattctttgtgatttgatgcacagatgaaaaacttaacacacaataacagaagttggtcgttaataaatcacatcctagtctttcagcgcttccgtaagcagacgacatcttcagttttctagctcttgtagttttaacactgcagcatcaatgatgcataagtccagaatcagttacaaagaccatcatattctttttctcttagttcatcatttttcactatctcttggtcccaaatgtatctgaatgattaccttccggcattctctgctattgctcgttggagtgctctcgattgtccccgtgttttgtgggctggttgggagagggcgcctgggaaggatgtgccactgttgggaggttgtgagtcactgggatgcctccagggatgatcccttccacggctgcaggaagtcctcctggagccacgcccacgatgcctggcggatatctgtatgtggcaccattgagctcaggatgaattgcttgctggtctattactgaccaaggcgctgatgtgacagagaattccttgttcacacagtttcttaagctttctgggatgtgacctgtgatggctcggcggatctcagtggcagctgcctccctcatctccagtgacgcctgcttgctgtaccaggcagtgtgaggagtgcagataagattcggtgcatctttcaacggaccctgagcaaagctaaagggctccgactcacgcacatagagggctgcccctcgtatcctgccctccttgagagcttgtgctaaggctttctcgtccaccaggccaccacggggtgcgttcacaaggaatgctccctgcctcatctgctttatggtaaagtcattgatgaggtggtggttatgttcgttgagattgcagtgcaaggagacgcagtcgctctgatacagcaaatcctacagagtgtagaccctctgcacgcccagggatcgctcgatcccatcctgcaagtaggggtcataaaatatgacgctgaatccaaaggccttggctcgaactgcaaccgcctaccccctgcgatcaaagccgatgaggcccagcatttccccacggatgctggccgatcccgaggccaactcgcggttctgctccatgctctgaacccgtgtgccttaccgcagtgcttggtacagccatgtgttcctctggtacagattgaggatgtggcagatggtagagtccggtgtctcttccacggctgcagacgggatattgcacacagcaattccgagctcgctggcagccttgatgtccacgttatcgtagccactgcctatctgcacgatcactctcggggccttaaacttttctaggtcctccctggtgaggatgatggtgtggtacatcatggtacccatggcttcgttagaaccttctcgtggatttcctgcgtggactgcgcgtcacagaaggccacagtggccaggtctttcaggatgggcatctccacagtgcagtcgcggccgtccagcagcgccaccagggggcaggagtgcagggggccgttcatgatctgggggcggataccttcacaaattctgtccaattgctgtctcttgactttgtgcttatccacaagggccatactttatggaactttgcaactctcagatcaaaaggcaaagcagtcctctaagaacttaggggaactcgcaggagtctccgtgcatgacgccactatgaacccactataaatctgtacacactataaatctgtacactataaatctatagttcacacgatgggctgtccgtctttttaagggaatacagcttcattggttcaaaaccatttaaggtgatgaaaccctcgtcccggacggtcagcgtccacggcaaaaggcgcccactctggaggccgcggtggcggtggctcccgcccctcccaccccaccctgcggcggtggcggtggcggtggctgcagctgtgcagcctcccctcagcgcagcatggctcccttttcggtccctcgctcctccgggccgctcccgagccaccttaaaatgacgctcgcacacagggacacacaacacaaaaacttaatctctccagctccccaccactccccctccctccctccgctaccccgctctccccaccctacccctccagagaagtcttaatgaggaaaaaaaaaaaaaaagcacaaatcacatttccaaaatgactggagatcctgccaccactagggttatgaaaatgggcacaattttaggctctggctattcagccttgaagaagtctcagtatccaggcacctgagtttgctccatacccacctcctccagggctgcgacaaggattaaaagtcaagttagtgaaagcactgcatgctgcctcatatgcagtaggtgcttaataaatgtttactaaacctgaacacatacaaatcacaagggaaacagataggaataactgccctctgaaaagcagggcttttctacggtggcttaaagctgacatggcagcatggcagatccctggttctcagaagaaatctcggaaaaggaagagatgatccatggaagaaggaatttgaggccattctgatatagaggaaaccctcgatgaacatcagtacccactattctattattcctatttttatcctcagttaaacatagtgaattagccactgtgttttcctcctgaaattccacaaaataaagacaaagacagtaaaaagaaaagcaaaagatattaaatcacaaggggaaaaaactaactgtagacacatgagcagacaagagatttcatttttttttttttaagacagagttttgctcttgttacccaggctggagtgcaatggcatgatctcggctcactgcaacctctgcctcccgggttcaagcaattctcctgcctcagcctcctgagtagctgggattacaggcgtgcaccaccatgcctggctaattttgtatttttagcagagtcagggtttatccatggtggtcaggctggtcttgaactcctgacctcaggtgatccgcctgcctcagcttcccaaagtgttgggatcacaggcgtgaaccactgtgcctggcctcaaaatttttttaaaacataaaaaatacatgaagtagggtttcctggcagccacagcctacactcctatagaggggatattctagaaaagtgagccaacatatctgcaggaacctgaagccactcagaatttgaaagtaccaggggttgcagaaggcagaacaaagcatggcactgacaatggggtgactgggtcaaagtctgcacacaaaactgctggacctcagttctcccacatcttcccatctgtgcaagatccaaggagagactctggacttgaggacaccaggggaatatgtagacccagggctggaggtggagaagagcaagagtctgtagaagaaactgtgccactcccagcttggcagaaacaatgttcagagttggtatctccccttggtcagggaccaagctggctacaacttctccccacttagtagcctcagtggtcaacagaaagaatcagtcagagctcccatggagtcaaatcttaggcaataaagtacatcctacttataacgctgggagtaggaattgggactttaaactgtgttgaaaagggtgcttggagaaacacaagagtataaatatgaaaagctgtaaaaaatgtcatcagctcacacacaggttacaaattactcacaggttgttctccttggagccatagggttcagagcaacactagccttagacacaggcaagaggggcctttgaagtttgggccccacacttttaaagggtcccacacttttaaagggtcccactctgtcaactgttcccttctttataggacaagaagactcccaagtgaaggggatatatatacccagagcctacagaccccctcacttctagaccacgctccgagatgtcagactccagaacattctgcctagacagctctgaactcttatcttacttccaaggtctgtgtggcctctttccaggtctggcttcccaagaagaactagacaaccacctgtatactcttggatgttcggtgggggtgggagtgaaaaggctgctatttgttggaagatatgaacagagcttgagctcggaggttagggtgtccatgtagaagcacgcaaggcccctctctttatgggatggagccagcggtggggagaaaaggggtgtaggggcccacacttcctgaccagtcacattttggcacagaattccaagtcgtccatgagtcctcaattcgaacctggccatcctgttcattatgcaagtaactcatcatcagaggatgcaacgtacttggcttaacagtttgctggcctgatttatcacttctaaatatttagacacatgataggcatgccttcattcatactgtttccccaagccagacaaatgtttgtagtgggcctggttcagagcaggtgcctcacagagacaaggctagataggattgcttccttgcctggtcccagcttcaaaagttattctaatctgttgaggatcctcaaaggaaaaactattttaaaatatgcggtttaaaatgaaaattgtgcacagtattttaatgtacaattactccatgttaagctcctgtggtttctgtgctttaaattacctcatttaatgttcccaacaattccatgaagtggacagaatattttattttaattaatgagtaaagtgatgccctcagatcttaaggaacttgtataaagtcattgaaattgccttaaaataaaatcacttttttggtattgcttaaagaaaactggctaacttgtgatagaagaagcccctcaaagcagtcacacaatatgaatatgctaagtctttaataatagcaacagctctccttcatcagaggctaacatgcaccagccttcttcaggcctcacatccatcctgggaggaagacgttatataaattgcccaagaacatatggctagtaaacagcagagctcaagtctggatcacgtaagggccccactgcactctactacctttgctggtgaaaacaaacaaacacagtagaattcaaaagaagctaacagctgaatcaagcatacttggtcaaagagccactcaacacaaactaaatacctttccagctttctacaggagagaaacaggcaatgttcctgggaggctgcaagtatggctcataagaatgtctggaattatctaatctaagctttctaaagccatctattgttggctgttaaaattatagcatgttctgccgtctcttcacgttaccatctccttacttcccgtgcaatctgaagcagaggtgttattcctgtttatgaggtgaagacgccataactcagaaagccctaccctagaaataccagactcaggaccctagagcttcatagccaatagtctcatagcatcctgccatcttttatgatgtacataaaaaaatagaaatcacagggagaatggcctgttcaagtgacctttactagactgtgatatcactcctcacccccagacagatagcacacatgaggtagcacaggtcaatcttagcagacctggttccttacctgttaggataagacttaacgcctagaatttcatgattattacactagttactgcatgaaaaatgctcaagacagagcagaaagcatgaagggtaaggtattgttgttgacattttattagggaagtgaaactcttatccttaattcaaaataattaccaggtttcaggaacatggagcttcccactatgaatccctaatccaaacctagatcacaaaacccagaaacgggaaagcactggacagaggaatacagtaaaactgcgaagctggttacctgaattgttttctcttctgcctccagtggacttggaaataaagttcagcattaatgatgatgttgcatttaataaaacactggtttcatgactcctgggatactgtgtgggcaatacttcccctccaccctccagagataatgaaggcgaggaatccaatttgaactccctgggagaatggcaggaaggctaagctacatttggcactatattagaactttccctataaaacaaggacactggttatatcagtttcatgggggtacagttgtaaggtatcagcatagggcatttatagatttgaaatccatggttttccatacctatactataccagcagctttggtatagaagcccataggtcctatgggctagccaagcttcacatttctcaaatagctttggagacatattttagttgggtggagaattcattcagaggaggaagggaagtgtggaaaggcactgtcgttcgttacacttactatttccatcctgttatgggggcagtttcccctatgctccagggttccataggagcagacctagactgcaaagtgtggttacagacagaaagatccatgcctttccatgttgggaagcatcaactaattgtatccttaggaagtctgtctctataccagttatactgccctgccctgcttgagaaaagcaaagccaatcagtttttctgcaggcaagtggaaagtcagagaggagggcaagtaccttctataagccagaaatggtgggaggggggtgctagaaatcgctaggaaagaggtctagtgtccccaagaaatctagggcagctgcttaatgtaagaatggtccctggggtgggaatgtggggagaaggaaaagcaatgaaaaggccactagagccttaattgaggaagacatcagaatgcttgtcacctaagctctacaccttctatatttgaaacaggtatttcccagccaggatagtacaaagtgtataaattgggcaccaaatggatgtgattttgaattctccttttatgacttcccacctgaacaaccttgaataagtctcagtttccacctttgcagtatggaaacagtgggaactactccctaagtctgttaaccaataccagttccttctccatctagtcccagggtggctgggttatattgttgacctattaactggaataaaaggggaaaaaggagaggacaagatatattagaggaaatcaggaatgattttatggttgtcaaaagcttttaggttcctagagacactttgactttcctgggcctttgccctgggaaaaaaattaaagaggtttcaatgctcgtgtgcattcccacattacataggggagctgccagtcaccagagtttgtttgggtaacctcagaaagaggccacagagacaaatctcctcccagcctctggcagacatataatctggagttatttatgccagcattccttccccaataaaaaactctctgacctggcttgaatttttcttgacgctttcaattaaggaaataacaaaaccaaccctgtcttatacatggttaggtctggcaaaaatggactcagctaattacaaatttggccctggcggttttcttaagatgccctacaggcctgggtgtgagtggttataaaaatgaatgagtacaattattttgcaaaccagcctaacagtttagttcacattgcttctcgtctttcctcatcaaatcaagcatttgaattgcagagaattatcttccacatgtaagaaaacatatttctaagcattgcaaaactggttccttgctgtattctgatgcattatcatctggttgaagtcacatatctgtctatggaacatgacaaggacaagggagaacggtgctcacattaggttctcttcaaagtgacatgcagttagaaaacatccacttacccctattgtagccaaggctactagtacttaaatgctataccactgaaaaagtaagtggagacatcaatttttttaaataaatgaatctgaagtaccaccgaatatagaaaaaaaccatatctattgttcaccaggttggagagtagctctttcctcatctaactcaacacgttcaccctgaaggatttcatctgctcctgggatgcaagtcaccctctccagtccagatttccctcttgatatttgaatttgcatgctcacttttcaccagtctctcctctttcatggtttagaaatgcaaaccaccaaatttggtcaactctactaggtgtctttcagatttagcctcctctcctcactgatatgccgcttgttcaggccaccattatctccagcctccatgactaaaacacctgccctgttcctgtctaattttcacacttcctgctacagaaatgatttctaaaacactttcaatgcctttatattgtcttcagtgtgatattaagactccttaaatggcataattggctaaggtgttatgtagcagcctaggttctagttctatgaacgttcactaccccttctacctaggttggccacttcaaatacagcccctctcctctccagccttggaagatgagtaagagctcagctttggagacagacaggctgggaccacagcccaccttagctacttggtgcctatgcaatgttgggagtcactaaatgtctctatctgtaagatgaggataatggtaatggtaatgcccttctcctatcactgtgaggagtaaatgagataatgggtgccaagcactcagcacaggcctggcatatagtaagcactcagtcaatgctggctactatttcttttttttttttttttttttttgagatggagtttcgctcttcttgcccaggctggagtgcaatggcacgatctccgctcactgcaaccttcgcctcctgggttcaagcgattctcctgcctcagcctcctgagtaactgggattacatgcatgggccaccatgcctggctaatttttttgtatttttagtagagacggggtttctccatgttggtcaggctggtcttgaactcccaacctcaggtgatccacccgcctcggactcccaaagtgttgggattacaggtgtgagccaccgcgctcggccgctggctgctatttcaaggctagtactcaaggttatctacacctgctgtactcagggtccccataatcacaccaaattttatgaagagatgcctcctttgagagggtaaattacaaaaggcttctttatctgggctgcagacagtgcttggcatccccgctcgtgccagactcctactcatcttctggaattccccccagatttactcttgccttcttttactcacccaaactcaatatggcaccccccccttgctcccacagtaccttgttcacccagcaatatgacacttatgacacttattctccatgttgcttctcctgactacttatccccatctctctccctacccatctcctatttaggctgggttcctaaaagccagggactgactcagtcttgttcacagttatatcactcatgtctttgcacaatagatattcattgaatatttaccaaattaatgattatcatccttctttctccaaataactcttacaaacctaaatttcctgtcactctaccatcaaacaagtggtttgctctatattttggtgacattcatactttctttctccatcacctgcctttttacttctactccccccaaacccctgcacacacacccctgaaatccctgtgctagatggaccatccaactctatttttgtttccaccaaatatttttgagcacctactggtgtcctcgcacaagattggatgtaaagcctaaaaccataaaaaccctagaagacaacctaggcaataccattcaggacataggcatgggcaaagacttcatgactaaaacaccaaaagcaatggcaacaaaagccaaaattgacaaatgggatctaattaaactaaacagcttctgcacagcaaaagaaactatcatcagagtaaataggcaactacagaatgggagaaaatttttgcagtctatccatctggcaaagggctaatatccagaatctacaaggaatttaaatttacaagaaaaaaaaacaaaaaaccccatcaaaaagtgggtgaaggatatgaacagccacttcgcaaaagaagattctaatgcagccaacaaacgtgaaaaaaagctcatcatcactggtcatcagagaaatgcaaatcaaaaccacaatgagataccatctcatgccagttagaatggcgatcattgaaaagtcaggagacaacagatgctggagaggatgtggagaaataggaacacttttacactgttggtaagagtgtaaattagttcaaccattgtggaagacagtgtggcgattcctcaaggatctagaaccagaaataccatttgaactagtaatcccattactgggtatatacccaaaggattataaatcattctactataaagacacatgcacacgtatgtttattgtggcactattcacaatagcaaagacttggaaccaactcaaatgcccagcaatgatagactggataaagaaaatgtgccacatatacaccatggaatactatgcagccataacaaaggatgagttcatgtcctttgtagggacatggatgaagctggaaaccatcattctcagcaaactaacacaggaacagaaaaccaaacaccacatgttctcactcataagtgggagttgaacaatgagaacacatggacacagggaggggaacatcacacctgggcctgttgaggggtggggggatgggggagggatagtattaggagaaatacctaatgtagatgacgggttgatgggtacagcaaaccaccatggcacatgtatacctatgtaacaaacctgcacattctgcacatgtatcccagaacttaaagtataattaaaaaaaaaaaatactcagagaagttccaaatgctgtatataaataaatacaaatcttatatagaaataggatttggaactatatacatgtatataaacataaaaatgtatgtttatatatgtctataaagagtgaaacaattaaacttcttctataaaaaaaagagtagggataaaaaggcatataaggcaaagtcattgccctcaaattgtttacagtaaagtggtgaaggcaggtatataaataagtataattccatgtagtttgtactgcattagaagtatatatgaagtatacagtcagcacaaaaagatcaagagttctgagtagaaggtcaagaattgtagcacagaagacacaatcttctggctcaccctactgagaagaggtgatatttaccaatgaattgcagaataggagttcactaggcagcgagataggaaaaggcattacaggcagaggaagccccatgtataaaaagtcacataagcacaaaatagcagggaaagcaactaattcaatatggcagggaatgtgagagggactggagggaacagggaaggctagagaacaggaagggtctaatgacaaagggaagaagcttgccctgagtgctgcagcattttgcttagaggatgttaaagcaaaggaggagattctggcagctgtgcggaagacggactgggatggggggccaggtagacaaagagacatcctaaggaaactgaggcccactgctaacacagttctcagtgtgcttaagacgatttaaccttgtggaaaatactgccaggaggatattttctaaggaatttgtttaccaaagaatctgaacccaatgatgaaccaatctttcgctaacaaagctagagaactcagaaccatctaagttagcaagtgttaaaacactggaaagcaaatgtggcaacagcactttcctatttgaccataatcaacatcaatgtggaaagaaaacaaacctgaaagcaagtgaggaaaacacacagtgggtttctttgctttctctccaggacactgtcagtacacagagcatttagaatagctgatttgatcgttgtgaaaatctacctgcgtgcccctctctctctctctctctctctgaatgcaattagagaagacagcttcattcacactgtgtctaaaaatagatgatggcagagttcacagactgacagctgcattgtcatacagtaaccaggaaaggaaagggatggctaatttaacttaacaacttccaaaacaaacagtgcagagggagtccaggataaagaaaaaacacacaggtcagttcttcaaagagctggcagagggatggggtcgctccatggcagtttattagtcctcccaaaatcctgacgaaaccagctaagtattttgcccagatctacccagagtccttcagacaagagctctggcagatgaaccgctacagagattcaggcaatattaggcagcagggccaggactttccctgctgacttcttcatacatcccctggacacaagtaagctaagaagagtcatgacgtttttctaggcaagataaataaatgagttttttccccctttgccatatctaaattatactctgcctagcctggggcatttaaaaaaaagttatccaggaaataaacatgcatcattaaggggcagaaaccaggtgtctaaaagaagcaaaccatttctttccctcccttcagtcctaaaatgttttctgttttcctcctcagtctgccttgcccagggaagggattacggttgggcttcaaaagaaacaagggaataatgcctgtggacgggtagcagattctctctgcagctctcccgcagctccatgttggctctcagcgctgctgccagccagctaaatgtcagatcacggcaccccaacattccctcactgcatacctccatcgccctggtgactaagctgtttcaacagctgtgttattgctggagtcaggccagtgttattcacacgaagtatttgtttcatacggcttatgtggggaattattgcactcagctttggggttctatttaaagataaggtccttcccttgatcaatcagccaggacattcctcgagttgggctccaggagacagtgggacaatattctactgccacccggggttccagataatggacagattcataatactataaagaaggtggatgaagcatatgtgtgtgtgagagaatgggaagcataatggaaaaccatgacccttggtggagctgcggaagaactctgctgctcctccctcaataaaagccacccacaacacaagagtgttaagctggactccctttctgctcttcttctccagccatcaccctcagcctttcccttaaaatcattgctctttcctttcgggtcacgctagcactgttgcgttggtctctacatgcatcactccacacacctgccccgaatgccatctcctccctcagcccttggcttctcctatctcatcaaatggtttatgaccattgatgttcctatcatgtaggaagcaagttgggcctgttggcctggtgacctcctccactactccacatcctcttctgagtgtgagtaagataagggctgtgttactaactgctgagttaatcaacccaaactcccttatatggagggacaactgggaaaaggaaaaggcattacatccatgagctttatgtcctgtaggtgggactaatttctatttctagctcattctaggctgaatctccatcaaagaggcctactggcctgttctccctccaaagttgttctcaccaagagcaatcgggcaccattttctgatgctgaaaagatctcagaaatatgttttcttataaatgaagtatttttaaaagaaataaaacaatgattcctaagagctcacattttttactgcctactatgtgtagacattttcacccatgcagatgccagccagatggaaaccatcacaggcaatttcaaagtgaggaaactgaggcccatggccatgctaccaatgtgagagggaggcaaaatgagaacccaggtttgcctgactcagcagctcaagtactttccccttatgtctctcagtcatggggtaggaaagttaggacacccgcttcttgctctaaaaaggccactatttagccaaacaatttgagtaagtcactttacataatgtattatttcatgaaatactacagttggatcataggcttactaagatcctttctagttctaatatttcatgaatgtagaaatctaaaacacctccagctgttgactgccttctatacttaaggcactgaggccaaaacaaagagctataaaaccatgcctgtcctcagggcacttataatggagtttgagtgacaaaggataacaagttgagtttgactaatggaagagttaaacaattaacaaatacaaaaataccagagaaccagactacagggcagtgcttgagaaataacaccgcataccagcatgactatacaaggagaaaagtagatttcaacaatggtaacacccctaacccggaaaatacatttgtgctgccagcagaaagaaaagaagagacagaaaacgcttgcaggaaaagccagctactagaagggatcccgtctgtttcacaggaaagctttgtttctgacaagtttcgtaaaggaaaaagtaggctagaacaagcttttttatttccaacccaccttttcttcgttcccatgaatgaggaggggatacaaatgagagcaggcagccagggacaaaaataatatggctggtggttcctgacctcttggattcctgccaacagagaagcctgagaggcaacatttaattgtggaaaaaccagcctggctctcctcttatctttttcctctgtgacttaaacccacaattactggcaacccctagattccgagtcacccagctggtggtggcagcaatggctgtgtctgtagctgaaaagcaaaagggagtcagattttacctgcctccgaagccagccctgggagcacagccctaacccagcttgatgacttctcccattaaaaggttcacagatgccctcccgttgggaaaaccaccaagtgagaagtccagatgggaaaaaaagaaacacgattttcagctgctgtataattcaaaggacaagctacgagtctcaaatcctgaattccacattttatttcagcactagagatgtgatgttcaattccttttcttaagaaacaaactccaaatttcttagctggtcatcaaggcaactcacctaccaggccctctgtctttcagcagctcatcttttttctctaatatggacacttttctacagcccaacaaatgggcttaccgtcctttgcacatatgttatttcagagcatttcatgatagaaaaatatggtcttagtcctcactttctcacctagaaatcactttgaagaagtcacttaacttccataatttcatacttgtttaaatttaaaactttttctccagtaacagcctcacagaggacagtagagatttaaccttgaacatctagcattgagcctgcagaggagatgcataatcaacgtttccttctctatacctaatgcctttgctgagttaccttcatccaaaagaatgttcccattgctaactcttgtcctgatcttttcttaccactcttccactccaagaggttgtctcccatacacctctgctcccatcttaatattcttccatttcaaaatattttaatttacatgctgctatgtttatagtcaaatataattaaatcatgcctgtgggcacattctcctaaggatgctaagaattttccacatcttctattttaggactttatccaattgcttcagtgctgatcagcatgcattttggtactcatggggcataccctcatcgggattcataaacctctgaattccatgggtgagcttcagggcttccattgaaatatgaatactaaatgtgcaaatggggtctatgcatatttgtctcccaaggttaaagtccttgacctgaagttaataaccactgtccggaagtaatgaaaggcctgtggctaacatccatggacggggtcctttttctgaacactcagccctgccacctatgtttctgggcttctatgctctctctggaacacaattcctcctttctattcaagtccgagaataataactactcactcttatttatttatttagagacagaatctcaaccaggcaggagggcagtggcgcaaccttctgggcccaagcagtcctcctacctcagcctcccaagcagctgggactacaggggcacaccaccacatcctgataatttttgtattttttgtagagacagggtttcaccatgttgctcaggctggtctcgaactcctgggatcaagagatctgccctcctgggcctcccaaagtgctgggattacaggtgtgagccactgcgcccagccaactattcacttatattgagcatttactatatgtatccagcacttactatgtaaaagcctcacatacactattctagtttaatccttacaacaaccctataaaggtagtactactattctattttataagtgaggaaaatgaagtacaaggaagtttcaaaaacttccttgccaagggtctcataatttataagcagcaggccaaacattcataatttatgattcagcccaaacactctggcttgaaagtacttaacccagtgctggagttgtctctccaagctctttcactttccagaaaaaaataagactgcccttggactgtttctttgccttcacattgtaagtgatcacagattccaacgcctttaaaactccacctttgactcaatcaaaacatttccttttccgtgagttaatcatttccccttctatgtttatggactcctttgggtacttaatgcactgaacacactggtgtaattttttaattctctctccatgaattagactgtgagctcctaattattttgagtacacatggaatatttactgtgcctggaattgtgctaaggatataacaatgaacaacacagtgtccctgcctttaaataattcactcttaggccaggagtggtggcttacgcctgtaatcccagcactttgggactttgggaagccgaggtgggcagatcacaaggtcaggagtttgagaccagcctgactaacattgtgaaaccccgtctatactaaaaatacaaaattagctgggcatggtggcacacgcctgtaatcccagctactcaggaggctgagacgggagaatcacttgaacccaggagggggaggttgcggtgagccaagatcacgccactgcactccagcctaagcaacagatcgagactacatttcaaaaaaaaaaaaaagaaaagaaaagagaaaactaaacaaaagagggttatgatggtttctgaaattgtattatgaagaataaggacttatctttatttcttaaatcctgagcaaaatgctagcatgtagtacaagtcccaataatgcctatcgaatgaatgaatgaaattgggaaagggttttcagatactgaactgctaaactgaaagatctaccatcccatcatgaaactctttgaggttatttatacactgactcacctaaaaactgcttcctgtgttggtgtctatgatacattttttaatgtcagactaaaaatacacttccagtacaccaaccctgtctgcctacctaaggagtagaaatgaacacaaggtcgcatgtaacaaaagaaaagaaaattcactcatttcaacactaagctcaccctctaacaagagcatctgtcttgactgagcactatcttctagaatggttttcacttgagggtctctgaagtcatctatttacaaaaccaaaggataccaatgagattttttataaagtcagagaatcttaagtgagtcatggactctcaacttcagagagttagagtagatgggaccttaggggtcgtctagtataatttcccactcagaacaggaagcactccatagccctgtcaatagactcatggtgggatcaaggcactggagtcctaacatcatgtacactcatagcctctcgacttcccagctgggagactggcaaatcatgtaaactctgtcatcctcagtgtcctcactctgccagatataattgttccgatgatcagatgaaataaacgttgtcttaattagcgaacatttgtttgcaagtaacaggacttcacccccactaacttaaccagaaatcagctggagggatacaggagtgctttaggaaaatcaagggcagaaaatgctgagaagctggagggtctgaaaccaggaatagaaagctgtcaggaggaaagtcaactcttatagtctattgtaattacactaatagtcttcatctccatttcctctttgcatctggtcttcccactctgccagtcaacaatcacggcttctctgtgcacgtgtagaatgatgactgcccaggtggctctcatggcttttcagtttaagtgctaataaaggtagatctcgaattactgaaacacaatttcttataagagagaatttgattgcttcccctttggccaagggaccactgctagtctgatcagttatggcttggggactgatcatatggccagttgcccattcagtagaggtggtggaacatgctgagggagggggaagttaaggccaagttcaggccaagcaaatgactgacaacaaagacaagcaacagcatctctagtgcgatggtactttgcaaagaaagcactgccccatgccagctatcactgtggccatccttatgatcctcaccaaccatcttctgcttgaccactaccagtaacaggctgctcactactggtagaggcaaccttttcatcagcaaacaacttcagctattagaactcttttccatgtgacagcaacttaagatactaaactgaaatatttgtaatcttctcccaagccttaactttaatgaaggcataatcttgcttgttaggtcaagcctgggcttttctttctagtcaaaatatgaataatgggcaaagcaagatgttgaggaaaagctgagtgttgggagggaaactgaggcagggcttgcataatgtctttgggaatgtgtctagacttgctggttccttacttctagccctcataggctcctaggctcctattcccattatctcaagtagcagaacatgttccatataaatgctaaaccatcacagctgtagatcatgtgcctgctcttttgacctccacattttcaccacctgtttctttgttggattaccaataaatagcatgggctcccagagctcagggccttcacagcctctgtacactagtgatggccccctggtgtcccaactttctctctcaaactgtctttttctcaatcctttgactctgctggactttgtcacccccacaacctggtgttgggtctgatcaccccaacacaagagagatagattcactatgcaattattttagcaaacaacctggaccagaacaaagccagaacctcttcttcctataaagaattactactatctctctactaacaccattactaatgactcactaaagcaaaagaggatctggaactgtttctagcatcagtgtgtagacaataggtagggttggggaaaatggttttttccaatgtagagtccctagcacttttgcaagcagaattctgccttgctctcatttaacttccttttgcttagaaaaatataatccagaaaataatcttaacttcatttttttaagttaaccaagataaagttgtgaattccccataaaagaacctcataatagctatgttatgaccagctggcatttaaatactgaaagacccaaagttagaagaggaggtgaaaacaaaaaaataccttctatacattgggggcaccattaagggatgtgctgcttctggcttctctgctcttcacattagtcaatgatgtcaccaggtttttattttagtaatcaggatatacttgtatggatgcaaagagaatatcctcatttatattctaaactcagagcaggaaatgagacacgtgggtgatctgcagctgtggcactataaacagggccagcctaccacctagtctagattctagactgcacttcattccctgaaatactgattgggagattttaaaaaattgaaaatatatcattttagaaagaccagtgcatcttctgtgcaaggatcttagagtccgctgtttggtagaaggctgactcacctgtatggggtggtgcacgtgttgttaggtaccatctacctatctacaccactgatgtacaacgaggagatcctgccctggctccagccagctgtgccaccgtgggcgagtaccacagagttcaagctttctccagctgctaaattaaaggattagtgctttaacttgggtcaaccacccatttgcaaacctgacaagaaccacaaacactcttacttcaaaaatgcatataagcaaataccactgaaattttatgtagagtatcaaggggttctcttagcccttacactccagtctaaactgcttggttgatgattgttagaccagcagccctctagtattcctttcagcactccaagctaaaataaaacagctgatgtttagtaacaatttctgcaaattattcaacaccatagaagagtgttttgttaagactagagactaatctaacacaatctactcaacaatgttaaattgaccagtaaccaatagatgactagaagaaagtgtatgtaactagatataccaaactatagatactaattttaaaatcttggaaaggttttggaggagccctactgtttctgaattggaatttttcatttgcaaatacttaacaaaacccaccaagccagatagagctctatagcgatgcctatggaggagccttataatgatgttgtccaagtaatgtgcttaacaataatcacactcaaagccaaaggttcccatgctcctgccaatataacatgctcacaacggtcaattccaaaggaagagctgtcaagaagtgcctgaagatttcctcaaagggagagataattcatgagcaaacaaacatcatgtccctaatcttctctatcctggggtaaacaaaatatagttttctcccatgatttcagttgctttctataccaagtcagtaagtaaaactgattcatactggtaacttccaggttccagccttggtttgaaggggcacacaattcaataagagtaaagaagactggccatgtaagcccatcttgaatactgacaacttccgtaccatttacctaacactacaaaccctactccatttaagtctctgagatctttttgatgtattttgagcttttcaacttgccttttttggtgggagaggagggaggaggagaacaaagggagaatttgaagtttttatttctgcttgcattgactcaaattgtggtaaagaaacttaaaaggtaactttaaaattctagtgacactagccaacaatgaaaactatctaattagaatgttagaggttttttttgtttgagacagagttgctctgttgcccaggctggagtgcagtggtgcgatctcggcttgctgcaacctccacctcccaggttcaagtgattctcctgcctcagcctcccaagtagctgggattacaggcacacgccaccatgctgggctaatttttgtatagacagggtttcaccatattggtcaggctggtcttgaactcctgacctcaggtgatccacccacctcagcctcccaatgtgctgggattacaggtgtgaaccactgtgcccagccaaaatgttagatagttttaacacaggctataacatagtcataaattaaagaagacatggtcgtaaatgaaagaagacctctttttggtgggagtagtagtaggggtgggagagtagagttatacatttcttcttagcagttgcttcaacatattttattaataaggactatctgctgaagcacagaaatacaattatgtgaatatcatactaccaatggcctgttccatcatagcagggatagttcttatagtgtataaaatcctctgccccattcagctctctttatggagctttcctcagaagcatcagaaaacacagaattaaatatcacaattcttgttgaaggccaaaaattagttcccagaaggattctttgactttcatccttctacaaattcacccatcaccattgtagataatgtgaggggtgaatttgtagaaggatgaaattcagagaattgtttatgatcaatagattgttccctttattccagttgtcttcccttgatgtccacttaacattccataataaatggacaaatggaaaagcacaattactctgccaaaagtcagtcaacattctcccaggacactcagccatctaacttgaaaactgactggtaataatatcattctaattactttaactagaaatttgttatacagaaatgctttcagtgtggggaaagaaaaatcacttgccacttatagaaagaattctgcttcatgtgaccatttgcaataatgaaacaagtaagacaacactgggttccagtgtacagcacaaggatcaaggcgaaacataatgctttcattacgtaagaataggactgacattattctggctttcccctacccttcatcatttaccaatattttttcagtctcaggaatttttcaacccctgaaactcctagatttactactcaagacacagctatccatcttgaggctttctgccaatggctctagtgcttctatttcaacagcttatagatttgaaagctggaaagagagatatgtaaacaaattctctaactttgatctatgcacccaggtttctcaaaagaagcccttggagagtctggggtatactaagtgtatgacttgcagttgtaatcattagagtgacaacccatttccagtgggtaccgttttagccaacccaaacctttcttttcctaatgcatagagtgactttttaaaaaatggtatatttgggaaagtattttagaatggcatgttaacaaaacaaaaacactctagaatatattttcaaataacagaacttggccttaccaagaggtctaataccatcaggtaaataatcatttttatcagtgattcataatacatccagactctaaatgttaaggctgacttttttctgacactcttctctgcctattcatactccatttcctaactcctttagagtaaaaattgaaatcccatatccctaacaactagacagaagcatcatgtttacatcctgacaaattcattaattctgtacctctgaaatatttagcaaaaagccagcactgactcaatcatagatttccacagacaggtctgttcatatttgtaattggtattcactgaaaggtcaatgactcctgttcccaagtatctatgagtctctagattttcttaattggcctcttttcctcagctcttacagactattgttttaaaactaccaccatttagaagttgaactccgagtgaggggaaaaacaaacaaacaagcaaacaaaaaaaacactttttgattcccactccactcataatcaacataacacagactacttctgacccaggtgtgatggaaggagcggggcacagagtcgggggaggtttctccacacaccaagcaagcaatcaatcacttccacagcagacatcagctgggtgtccaaaaattcaattttgacaccacttacctggaaatagcatcaagtctcataggttgaaagctcagtcccataagactgctccccacttcagatgcccatcgaaaaaacaggttgtggcctgttataaatacgcgttcccatgaccctcctccttaggattgattgatttgctacagaggctcacagaactcagggaaacacttaacttatgcacgttataaaggatatgacaaaggatacacatgaacaaccagataaaagattgatagggtaaggcatgtggtatggcagggatccctgaccctctggcagcagacaggtaccagtcagtggcctgttaggaactgagccatatagtagggggtaagaggtgggtgagcaagtattatagcctgagttctgcctcctgtcagatcagctggcattatattctcataggagtgggaaccctattgtgaagtattcatgcaagggatctaggctgcatgctccttatgagaatctaatgcctgatgatctgaagcggaaccatttcatacccaaaccatcccccatcccctcatctgtggaaaaagtgtcttccatgaaaccggtccctggtgcccaaaaagttgaggatggctatgataaggcacagagcatccctgtcctctctagggtgccatgctccgggaacctctgcaagttcagctgtctggaagctcccagaacccagtccttttgagtttttatggaggcttcattacctaggcatgactgattacattattggccataagcgagtgactcaatctttaggcctcttccctcctggctgttggtgggtggggctgaaattagttccccacccttctaatcatgccttggtctttcaggtgaccattctgaagctatctgggagtccccagccatcagttgactcattagcatgcaaagaggcattcctatcactcaggagattccaagaattttagaagctgtgtatcaggaaatttattactataaagtaccttataatgccatcatttttctcccaaaggcactggcttgattaaattcagaaattaaaacaatggccagcttctatagtgtaagtcaatgcttttctagttttctgagggtttggaaactcaaatcctagctaaaacctgtatcacttttaaattgaaaaatttaaagggaataaacatttaaccccaagtgactagaagtcatttaaaatatgtagtacttagattattttatctactcaaagactcttcaaaagtagatgaaaacactaaccagatatatattataaacccaagctttaatttcagagcccaaacatgaaatctcttctcattgtttgaaatctgaaactcatttcaaagactgccacgaaaagttaaaaaaaaaaaaatggattggtcttgacttttccttacatatgaagtaatattgttacaggtgaatctctgataagcaggaagccatcatgtgtaataggatcttgtttgccacactcccaaactcttctctgaagtcctgttcattgctgtcagaaaggaatccaaagtaatgataaacaatataaaaagtagagagtctcatgcattcttaataccaaaatcagagagaaatctagacctgatgtgcctgttatactaaaacatgtgtgtatatgtatattgctgaatatatataacataatatatataatctgtataatcaatgccttgctcagtgtccataagcaaaggtagagaggataaatttaaggaaatgaatattcccacaaacacaacatgtaacttctcatataatagttagcagctggccaggcatggtagctcacgcctgtaatccccgcattttgggaggccgaggcgggcggatcacaaggtcaggagatcgagaccatcctggctaacacggtgaaacctcatctctactaaaaatacaaaaaaattagccgggcgtggtggcaggcgcctgtagtcccagctgctaggggaggctgaggcaggagaatggcatgaacccgggatcgtgccactgcactccagcctgggggacagagcaagactccatctccaaaaaaaaaaaaaaaaaaaaaattagcagccaaaatgtgttgctgctactcatgaaaagtattttttggtgtggttttcttgatagctctattaagaaagttattttatacatttatcaaatgaataattagtggtccatcttgttaactttttagtatgccccctattaagtgctagttctcatgttataagaaaattaaggattatttttaagtcagaaagcttgagtacagtatttttgtagatgaagataaaatattttaaagcatgaagatgtacatgagaaaaaaataagacattaatatttatatatagaaatgttttaaagctttgccaacatgggcatttttgttgtttaggattagtatttgctgggaagtaattcatctgtgaaattatttaacatgtagaattatttcttagtttctggtttgggagaaatgctcaagagttgagcttaaaatcattttattcacactgctaaagctgaaaaatgtaaacagggagctttcaatacatttcaaatgagtttggagaattctaaaatattcaatccatttataatgaatacaaaacatcattagaaactggcaaaaaaaaaagtagctaaaagtattcgagttatttcacattactgggaaagtttcttttaaaaagttcagttataaataacattcactaaacatatttatccttttttcaattttggtggtataattttagaaatttatcgttgacttttaaaatttcacctaaacttacctgaggctctgcattatgttactcaatgattctgatgccaagttttgaaatcaaattataggccagtcaccttcagtgatgtaaaaggtagaaccacaagataatccagcactttcctcacaacctgaaaacggaacctgtggcaagtacctgcccaagtgtcagactatgctctaaacaactgcctgtcatgtaacaggctgctcgaaagcagcaacatactactcctatagtcaattcttaacttcttaaccacaatttcatcagtgtaaaaaatataggagcagtggggaccagacttacatatactgaaatgttaaacaacagaactcttattttgaagtgtgggaggggaggaagcacctcaatcagttgctttatgttccttttagtggcagaagaatgatacaatccagtattttcatccacagctccctaaacacaaagctgtggatttcataaatgtaaatatactgcgtaatctgcccactgggagttcatagtttagtaaggactcagagaagacaatttcactgtgcagaacacaaggctgataaagtaaacatcacaaggccagtaatgaagaatgcgtaaggaaagacagattatatccaggaaggaatgaggacgggagataatatagaaaatacctaggaaggctccaggggaatgtaaaatttgggatgttgtgaagaatgagtaggtttatctgggaggagcccttcatttgtgagaagaggaatcacaagagaggaagaggcaggcaggatcaatatcagcgaagacgcaaagggagaaactctctggatgtgtttacagggcaggaaactactccttttgaggatgcagagaatggttactggccagcagtgaggaaggaggctagaaagaagccttgagccaggaagcgagaggactctgaacaccgagtcttatttgttagtcactgaagatgttttgagcaaggaaatgataaattaaagctaaaagagtctcctccttatcagaggtttcaccttcagtggtttcagttagcagaggtcaatcacagtgtaaaaatattagatgaaaaattccagaaataattcttaagttataaattgtgcactgttctgagtagcatcatgaaatcttgtgctgtcccctgataagaatcacccctctgtccagcatctccctgctcctgcctgttagtcacttagcagccatctaggttactagatcaactgctatgtattacagtacttgtgtgcaagtcatccttattttctctcattgccccaaggtgcaagagtagggatgctggcatttcagatgtgctaaagagataagtcaagtgcttcctttaagaagatgaaagttctcaacttaaaagaaaaaaaaatcttatgctgaggttgctaagatctacaataagaatgaatcttctgtccttaaaattgtgaacagtatattttttctttcattattaattattgttgttatcttttactgcacctaatttataatttaaactttattctaagtatgtatatatgtataggaagacacatcatgtatgtatatagggttcagtaccgtgattttaggcactgggtggtcttagaacatatcccctgtggataaggaagacttacctctaccacgtgcttcttttataaagactaatctcactaaccaaggtgtagaagtaagaattggaaaaatggctgaatttcagcaataaggataaatataattggataattgtaatagctacttttaatttttaactgttttaatagtacttactatgtccaggctgggtgcagtggctcacacctgtaatcccagcactttgggaggccgaggtgggtggatcacctaaggtcaggagttcgagaccagtctggccaacatggcgaaaccccgtctctactaaaaatacaaaaatttagtcccagctactcaggaggctgaggcaggagaatctcttgaacccaggaggcagagattgccgtgaaccaagatcatgccaccgtactccagcctgggtgacagagcgagactccgtctcaaaaaaaataaataaaaaataagtacttactatgtcctaaaagttttacataaactaatttattccttagagtgagttggttaattaggcattattatccatattttacaagggaggaaactggctaagagcggttctgtaacttccccaatactgcagagcttttaaaaagtggcacaaggatttaaacccattgctgtaggactcctaagtccatgctcttaaaaaactttctatcttaccccctaatctagatataaatcagggatcacatttcaaatgaaactgtgactccattgaaaagtatgccagcaggtagtcagcctctaagatggtccttaatgatccccatctcctggcattcatgctcttctgtaatcacctcccttgagtgtgggttgaacttactagttcacttctaaccaacagaatacagcagaagtgatggaatgtcgtttgcaagattcagcggtttccctctccagcactgctcaggctctctcttggctcactatccctgggggaagcccgctgccatgttgcgaggcagtcttatggagagacccatgtgggagggatggaagcctgccaacaaccatgtgagagagcttggaagcagatcccccttccccggtggagccctcatgcctgatgagactgcagaccaggccaacagcttaattgcaaccttgagagagtttgagccagagactcccaaactagattcttgacccacagaaatgaggagctaagaaatgtttataggtggccaggcacggtggctcacgcctgtaatcccagcactttgggaggccgaagtgagtggatcacctgaggtcgggagttctagaccatcctggccaacatggagaaaccccgtctctactaaaaatacaaaaattagccaggcgtggtggcacatgcctataatcccagctactcgggaggctgaggcaggagaatctcttgatcacgggaggtggaggttgtggtgagccaagatcgtaccattgcactccagcctgggcaacaagggtgaaactcagactcaaaaaaaaaaaaaaaaaatgtttatagttgaaagctcctaacttttagggtaatttgttacccagcattattaatacagtcagtagacagtaattatttattattacagggtaaatctttttctttatacttggagctagaagtagggatctgtctaggagagattatacctgaaataaccacaaccagcccaaataacagaataccacgtcctttacctttccacccaaacatacataaatcaggtaatctacctatctcatcctcccatggctcttcttgttgtccttattctcctttgcttgaatgcattcttaggaatagaaatgctaaaacccaaacctgcaggtttcaaaaaaaaatttttagacatacagttttgaatctcatagcaaactctttccttcccaaggctcctcacattacattgtgtattcttattatagcacataacatgttttttcttatttgtaggtttaagtgtctgttttccaggcaccctcttccctaacccgttacaagaatcatgtctcgtgtgatcttatatccccagtactgagtgttcgtatggctgggacttaataaagtttaaatgaactcatgaataaatgtgttgcacaaccaatgagtgagtgagtgaacaagtgagtcaataagcaagagtttagggacatgggaaccaccacttaaaagcttgaggctgttgtgcaaatttggaccttcatataagccatttccttctatatagaatgctctttcttttgctcatcctcacctcctcaccaggcttttctctctttaacattcacctcaaagagctgtctgattgcctctctacaactctccccgccaacacacacccacacaccctaccagggaagtcttccttttctctgctgtgaagccttttctttaagtttccatatcctcctgggcataacttggtcacagcacccagcataccacactgtaatgattagttatttgcctgtcatttccacttagccgtaagttccttaaaggacagcatattcagctaacagcagaatgcctagcagtggtaggcactcaaaaacagtttaaaataatgggcaagagaatgaatgaatgagaaaaagaaaactgtatctagaaaattatctcagcacaatctatttatttcaggtaagctatcagtcaggtatacatagtgctccaactcctaaacagagtaaaaataattgtacatcaagattattacagatacatgaaaatcatatttagaaatagtacttcagatcaggcatggtggctcacagctgtaaaccaaaaatttggggaggctaaagtgggaagattgcttgagctcaggagagacccccataaaattttaaaatttaaggccaggtgcagtggctcatgccagctactcaagaggctgaggtgggaagatcgcttgagcctgggaggttgaggctgcagtgagctgtgatgacaccactgcactccagcccaggcaaaagagaaagaacctgtcacacacacaaaaaaaaaagaataaaaaattacaaaattagcgtgcctgtagtcctagctattcatgaggctgaggtgggaggatagcttgaacccaggagttcgaggatgcagtgagctatgattatgctactgaactccagcctgggccagcattcgagatcagcctggggaacataggagactctgtctcttaaaaaaaaaaaaaaaaaaacagaagaagaaagaaatagttttcaggccaggcacagtggctcacacctgtaatcccagcactttgggaggccaaggtgggtggatcacctgagatcaggagttcaagagcagcctggccaacatggtaaaaccccatctccactaaaaatacaaaaaaaaaaaaaaaaaattttgctgggcgtggtggtgggtgcctgtaatcccagctacgtgggaggctgaggcaggagaatcacttgaacgcgggaggcggagattgcagtaagccgagattgagccactgcactccagcctgggcaacaagagcgaaactctgtttcaaaaaaaaaagaaaagaaaagaaaagaaaaagaaataatgtttcaatctatggacaggccctagacagagctgcctttaacacatctttttccctttccctcacatccttgatcccatctcagtcaaaaaggaaaaaacaaaaagttttcttacttctcagcctaagattcctgatactgtccccagatgccatacatgtattggcctcccagaaatcacccagtgattttctccccatgaaaagtttatatgtctcatgccctcagagtttttaactgcaaataagctaaaaaaaaaaaaaaaaaaaaaaaaaaaaaaaaaaaaaaaaaaaacgaaaaaaaaacctggtttggtggggaaatgggtgctcatgggttggcatttccattttggtaggcatctttttctaaggccatagctttactcaaagcccagtggaaaaagacatttaaaaaaaaataaaaacctttcaggaaccctcaagtcactccattggggtgaactcccctgtgacactagagaggtggtgaagcttggtggttagggcagttttctgagtcagaaatctcagcttttccactctctagtcttcagatcatgagtaacctcactggtgcccaagtgttccatctgtaaaatgaaataataagactacctcaaggaacctggtgggaagattaaatgggttaatacaggtaaagtacacagaaagtgcctgggaagtagtcaataattgtttgctattactattaccatttttacttttattagaattggctcaaaaagaacccaaagagggcaatgctcaaagggaagaaagggatgagaggagagtacacttaactgatttggttgtttagcttgaaggcaatgtccagctgcaggataaacagcatgaattggaaccaaggactcatctccatgtgggggaggggaatgtgaacagaaaacacgatgtcattggcttcaatttcccttggaattgcctcttcaatgtctcggatcttgtcacaatgattgggtccccaaggcacgaaccattttgtcttgtgatggttcttacgggcatccacacatttcaccgacatgtaggacactgccgttgtgggccctggagctgaaaagagaaagtttgtctgttttagaaaagccatctattgaaactactgtttctggttaatattctttccactgctgtgttccctccagcttttgtatcgccttctacaagtggggctcagcaatacttagggatcttccaaatctgggtgaggatctttcactgacctccagaggtgtcataacagtatctctgagaaccttcccattatgttttcaattgctgtgaaagaatacatttgtaaccagtctagttatacttccccacttcaaaacaatgtcacaaaaaatcaactgtgctacagttcccacctgattgaggtcttggagagctctggtgcttcatagagaacagtatctaaagtcagaagaccttagtcttcaaacctggattcgaagcctggttaaaaacctactgtcagtgaatcttgggtaagtcagttaaatctgtaatagcttcaggaccctcatctgagaaacggaagagtttctaagattccttttggctctaaaattgtacaacattgcttttgcttaagataaagaactaggggacaccagttagcttggtacctagcagagaatgggaactcaaacactgactgatacttcaaaagtgtactaaaatataaacgatgcacttcaagacagcaaagcaactttgaaatgtgtaactttaaaaacactattttgtgattatataatggttatatgattataatattaataacttggaaaatacagaaattttaagttcaaaacaacatttacccaaaatcccactagagggaagtaaccactgttggaaaatgtcaaaatgccatctgtcttttctatgactgtgtaattagataaaaagtttacacatgaattaaattgtgtaactttaaaatatacgcaaatattaacacatatttataaaatagttatatcatgcatagttttgtagtcttttctttttattcacttagaaaagcagagtattgtgtgataacaccagctctggaggcgacctgtctggtgtcaaatcctggctctctcatttttagttgtgtcaccacaaatccacactaggaaagttttgggcaaattactaagcctatctctgtatcggttttatcatctcttagatggcaataataatagtactgatctttccaagtcactgcatattttaaacaagttaacatatgaaagcactcagagtagtgcttgggcacacacaaagtataaaatattagccattatatcatattttctttataattaaaatctttcagttagtagttgcaaaatagtcaatcacacaatacaccaaaatcaacttctccttcatcagtttgtaaaggctatctataagaataatcctttgcctaatatgttttgttggaaatttctcctaaactttccatctgctatctaaatttgtttatgcacatttaaatagagaagttccagatcttatatggaatccctcttttatgtttttccccccatgcttttgtgtttagagaaactgaccttcttcatctcaaaattcaatagtcatctatattgacttctatttattttttgcaatttcattttttctaatatttaaacagttgatccatctgaaaattgctataagagatgcagtgaggttctagttttatttcttaaatatttaaattatagttgattgaacagaccctcccttttgttgatttatcatatcactgttaatctttatgtatgtaagcatgtttctgaacatctgttcttttccatgcattaaactgtcaattcacgggtcagcacaacattgctttgaattttataaatttattatttttatcaatatctgctagagtaactctcttccccaatccatttcaaatttacatctttttgctaggatattgaagattaaattaaatttataaataataaatatataataataaattaatgtggacagaattagcatccttccccagcgtttagttttcccatccaagaacagtacttgtttctccattgtctacaatctgtttttaaatttcttggaaaactttcattgttttctttatgtgggtcctactagtatattttaaaatagatacatctataaacctttgaaagttagtagttaaaagaaagtgtcatcaattatggtttatgtgtgtggtttaaatatgtgtatttctgtgcatctgatacttggtatattatgtttgcagaaattctctcttatttaatagagatcagatagcaatggagaaacatgaaaagcaaaaagaaagttatataacgggaaaaatgtgtattattaatattctgccctacttctaatgttcgaatccacattatttttctattctattaaacatctattttaatgatacatttttagtaaaatgttatgtttgtaagaagttaggacaatgcctattaatacttaccagaaaactcaacactactaagctctagctgaacatccttcatgtagaaggctgaacactgcaatacaagttgccactaacccctgctacagacgtttttctttaaaactcaaaactgtatcacgaagacctcacatctaatccatctaaaatcagacatctgacttattcttagaaatatgagtcaatcaaactttggttatcctgactcagctaaatagcccactgacattagaaaagccaaatggcacatttaactgaaccctttttaatgtggttggagaaataaacagtgagacaaaagtcatgaattctattttcggctaacatactcaaactgactatttgctgcagaaaatagttactacattttaaaacttctattcttccaaaatgaacctaacctttttttctttattttttaccttcttgaaaaacaagtctctcacttctcaggccaaaacgaaaaataactagctgagttcctcagctaagctccaaaaccacattccaaacttaataacagagaagctgaacactttatggtcacaaagtccgcatttttaatgaatgcagtgaacgcctgcctttttaggggcctgcattattttcatcctctcattagtctagtgtttcttctataaagaaaaaaaatcccagaaatactaatattttcataaatatcatggcagtgaacttggagaagcctcaagtgcatctcaagctatactgtgagaatcacaatttttttcacttgaataaattagtccttgagtctcaaaaatgctttccataacttcaaaacctgaagataattcaacattttccgtttttctaatagtgttcaaaagagaaaacacaagtattgcttgagaaagtaaacagacatcctgatattcaaacatggacagttaatgttcccccaataatatatttacagctcagtgcaatgtcctactccagctaaaagtgaattcccaagtgtttctttatatagacagcattatcacgtaaaccaaaagcaaagcttacagctggtagctggtcacctaccatagaatgtgttttcattagctatagtcaaaattttagctacatgggtcacaaattgtgtctagaatcaaaaaaagtttgatctgtctgtaaatttttttaaagtgtgtgggattaagagaaaagagctaaatggaggaagtttaaatcatcttcaacctttgaacaagccacaataacaggtatttgtaatgaaggccttacttagtcacttgcgtggttctagggattaatagagtttgtgtattcaagagggggctggatagattcaggtcaacaaactgagtcatgtttgctcaggtgaaagctaaaaataaccactccccagtattcctaggagagtaatgcaatattacccagctgcctcagcacacattataaatgtctcctccacccacccatagtataaggtttaactgaaaacaagtaggccaaaaactacttctacaccagaccaattcaatgacagaataatttggccaaaactaaatatgcctagtcactgtaaactggttaactcatggttggttaagatagccttgggaatatgcacagaagttataaaaccatgagctattcattgaaaatgcagtccattatgaattcagttctttttactttatcaaacatgaccattttattttgtctgtatttcaatacagtatttttggcctccacttttccactacagcacatgaattgtgaaatgtgattctatataacatttaatgttaaagtgatatgaaatcaataagacttctaacaaattcaaggtgtgaagaaatgtacaaacacaacctgaagtctctatgaaaattcagtggtccctcagttacacacattactatggctcacagtatattgtccaaatttgtcttgagtatctaccatgcactagacactgccggttctggagtaaacctgataggcaccaaccatatggaacgtacaaataacggaggaagcagacaataaataaacaatttcaggaaaaaataattttgatgaatgttatatgtaacctgacattccctgagaaagggcaacagtcagatatttgggaggtgggagaaatgaatacaccagaatgacagaaaaatccagtcatcgttacaacataaccttgaataaaaatgtaagtgaacaatgactaaacctgtagtacttcttttggaagaatattcattgactccagtcagcttcctgttatttcacttcaaatggctatccagtttacaaattactatctagccaaccgctagcatttatcatgcttaaaattgagtcaacattaaatcattagcccctattccttccagaacctgtaatttaagagttagagagagacaagacttggttgcctcttagaaaagttaaaataaaactaaaacaacaggctgacatgacacattgtctccatttaagccaacatagactatttatttctttgctttattatgagtaatgaacatttctttagcaatcacctaggagcattactattatgcaggtaccgtactaactaaagacagagacgaatggcctcccagacccccatttgctcacaggctagtgtgggaggctgagaagttcacaaagaattacaccctgattggaaatttctttgacagaggtttgcacaggatgctccagttgtaaaaagagctgagggtagctttcggcagggcttagccttggaagagagcaggtaatagccaagggagaatgggggatggccaaggagggaaggtgctgaggtagagatagaacatgtgctgggtcatagaatatctaaaacaatcatattttctgcagatatctgtgcttgaatattaaaaattaaaaagagatcatttaacggtgaaaactgtagtactactcttatctctgtgtccacccttgccttttctaatcagtggtataattctactagagtgccttggcctctgctcccaatcatccctgctgtactctatagagcaccataaagaaggaataataaacagagccacacataacaaagaacttttatttggcaggaatgtttccttttatgacacctatctctgccctgtaagtagccacaaggccagaccagagatctgctggaaggaggcggagtgagagggtagtcaggtgggaatgaagaagctccccgtcctattcccacaaatggccccaaagagcctttgaagtctcagtcatcaggtaataatagccttcctctaaattagaggaagaatgtctgccttgcaacaaagatgatatttaaagaataatctgctttggggtacaaggggaaggaatgcagagaatagaccagttgaaaaggtaattcctgtttataagaattaataatcagaacagcaccattttaaaaagtaatgacttaaagtaaaaatggtcaaagatttcagaaatgttttagagaattttatgtttacaatagaatttatctaacaaaaatgataggaacaatacacattgatttaaaaacatacaaaaagttggtagcagatactttctcctactgacttgagacattgatttaacacctgaaaactaatctcagttaaaaagctgccagcaccatctctccacctgtaaaaatgtgaatatttatttatattttataatttcattttatttattctctatcttgttccataaaacattttggggtactagaactggttattagcctttattttttaaaaataattgggactgatttcaacggatagaattaatgttggggcgggggtgggcagagactacaaattacttggtctatgtctatatcttcaaaagtttggggagcttatattctccagctattgctttttttttttttttccagctattgcttttgaaacaacagctgggaaatataagctcctcaaacttttgaagcaatagctgaagaatgaatataagctcccaaaacttttacctgatctatgaagttgaatggctcaatatccattttactttgaaatgtagagaaaacctccattgcactatgaatggtatttataagaactaaaaggcatatgcccaagttggttctaagctctgcctatctaaatatctctgcttgccttatgagaacttatataaaacatattgagcacttaaacccttgggcaattgcagagtgtgctttggattttttgagtatcaaggtggggagggtcgaaaagagggagaaagggaacacaggtgtcagaaaagactagatgaattcctgttatgtaactactttttcaaatgcccccaaagtacttatttaacctaagaaaatctttagctaagtttagaaattagctttaaatatgctcaattgattttccttagacattccacatgcctttcgccagctcaaaagccttaattctggttaaaaggaaacatgtgaaatatactgcacaacttcagtggccagatcatattaactggctgagctgtgaggtcttatgagccaaacctgcttaccattcactgaaagtcagttcctaaaaagatttcttaatatctgccataccacttatctaagttttgggtggctaattagaatgagctcttcaaaaagttcagctaaagaaagtgcaaatatttgcattaaattgacttagtacttaaatgattcagtgtgttaattcttttactgaaattgctctgaagttatagtagacacttatgctttctccaccacctactttgaagagaagattctcctatatttcaaccatacccattaaatcttactagcttactaaatgaagtattatttcacaattcaatctcaattactggagagctgaaagtgtgtctacagagactagaccagaagtgatttttacaattatcaaagctatgcccttgtgcatgaaatggggtacgctaagtgaaatgaaattcattcttgccagccactttcagtcagttagttatgctaacatctgttctaggaaagctaattttttttaatacagcagaacattcctttacactgaaccactaccaccaaaacacaaacatacatactacatagcagagttgaatgcaaaataatttgtaccgtacacacaaaagtcaagcacttatttaaaaatagttctttacaatataaacttatgaaattatggacattttgacagcaattttccaaaaattgtagcaaacacttgtaaatacattccgactcaaaaatattgaaaatatcatatgtttacattttaggcagatgaggattttaaatgcttcgcctacaacctcaattgttgtggagccaaagatgcaacagctttgaagaatagaagaattactctatatttgtcaggatctacgtggcaaacaagcgccacttggcttacattacttgcctggcttggatcccatggaatggaggagcattggaaccaagaggaaaaaaattaaagtgctttgggacagcgagccaaactcttacatagtatttgaaatggtgtggcaaacatgaaattattttaggctcaagattggtgctagttttttaccctctttttgaaaaaatagtaaaatgcacataaagggccctgccagaggtttagctcataaaatctgccaatcattggatgtgctaattggtgtagcaatccagtggtggcctggattaggactcaaaaactgacccttaccacccttggtgtcctgcagcaaagacagcctaaatcgaaaagactgatggaagtatatcaaattacgaatttctctatccctgaaaaatgcctgcaatttctgtttctccatcactccagaaatactcaaaacagcaaaaattaaatacatatgaagtgaacacaaaagacctccacagaaaaatcagtggctcatctgttgacgctattgctcattgctcggctggccagtcatctgggctaagttttgactttgggccagtgcttcaaaatcagcaacctttcagccaaaagactgtggaatgcagccaagaccacctgtggaaagtgaattatagcatctttaatttactaccttgggctatgatgtcagaaacccagcatggagggcgcaccagttcttgtgtgggaaatctctcagagcccccatggaggcccccaaagtggctctggcaaagctgtaggggtggaggtaacaaaaaaggggacacctggctctccttcttaaatcagctcaccatgggcacacatttatattggaattttagggtcagaaaataccaaaattaaatcttctagaagaaacacagtcagtggctttgctctaaagtgcctattacactctacaagtttccaacatttgttatttaaaataatcagacatttattattcataaattacatatattcttttatcaatattattgttaataataaacatgaacaactagtaagtgaattgcaaagaactttcacatacatagattatcgaatccacctagttaacaagtaacataattagcaccattgcatattcagaagatcagtggtttttgtctcatcagtaaatagagttaggactggaacccaggtctgatttcatatctaatgctcctttccaatacaactatctgtttatttattaacggttactatttattagcactctcagattacctgagatagttgcagagctgagggatgaatgaagacgactgtggccataagtagcttgctgaagctccacaggcaaggcactaccagcactgggctgggtgtcactcaaagggagccagcaagatagcttttctgggagacttacagtcagggacagagtacctctaagacttccataaagaaatgatggagtaataggctcatgaaaatgcactaaactcccttgaatctgataccctcccagtttttaccgggtcttggttatgacttcatattgcaggtaggcagtgtttaggatgttagcctagagaagatctgactcaggaacacagcgctgccatggaagtctatgacagcacttgcaggcatagtgagagacaggaattcaagttagagaaaatctgactccagagcaacctatggaagaattacttataattcaggtaggcaaacaatggcacagtttgactcaggaaagggtgggttcctcaaccatggaaacatttgggaagtaaatggatagataagagcaagagcctgaactaaatataagttcctctcagtcacaccaaaataagtctcctatccatgcatatggtatgtcagggaatggagaaattaaggtccaacaaagagctgcatatagtttattgatttgttttctattttctgaccagttccagataaacagataaaagcaattaaagtacagggcattctgaatggtcaaaaatttagtattgtacattgtaagttaaggctaagggcaagtaagacctgttaatgtctttatctggaatttcacaaatgccaagaataatcatatttccttccttgattgattattcaaagaaaacacaggcccttataatttgcaaatttcctagaattgagggtagaggtacattttaagggtaacttgcagttttaacattcacattcttaggaattattattattattaatttttttttttagacggagtctcgctctgtcgtccaggctggagtgcagtggcgcggtctcggctcactgcaagctccgcctcccgggttcacgccattgtcctgcctcagcctccagagtagctgggaccacaggcgcccggctaattttttgtatttttagtagagacggggcttcaccgtattagccaggatggtctccatctcctgacctggtgatccgcccgcctgggcctcccaaagtgctgggattacaggcttgagccaccgcgcccggccggaaatatttttttaaaaaacattgaaatcacaaaattaaatagtctatgcaattatttagtattttaaatttcatcagttttaggttctagctcaagggccgtctctccttcattcaatttgttaaatgcctatagtgtgccagctggaggcctcctctgattttccttcagttgacaaaagatccttacttcctttggtgccagtatcacctggtctatgtctttattatagcattctactttatttgcaggcatcacttctgaaccctacaaaattataagctcctaaggggaaggactacatcttattctgccttgtgccactaagcacagaaacttaaacatgcaagtcctccagacctgaactgaactatttattatatggcttttgtgtcataataaacatattaatgtaagttatgctcaatgtaactaacaaaattttatcaaatgcctactaagcatcattttttaaatgccatagtggattaatccttgtcccgcctgtatcaaagtacacttagactggcactcagtgacagtttgggaagaagccagagctgccttccgtgaggtcagtctcccaaggtcacacatgtgctcatcagagactcacttcctacaaatacttatgacggttcttccagatccgtgtcaagcaatatattaaatgaaatactgaattttgaagatcaaaatgaacttttcctaaactataacccaatccacacaagtaatttacacatcaaaagaaattagatagtaggcaaacaaaacaatggtaatttttttaaaaaaaactgctcccaaagggtttgtggccaacattaatattgcaggaacatgtttagataactgctgttcagcatagttcctggaaacaggttctcaaagccaggacttacagttatttaccttcttccagcactgccctgagggttttaaggcctaaatgaatagaaagcaaatgggggacaaaatgaaataaaatgttcacatctcagcctttagtgtatataactaatgtttgaagattttatgacaaaatgtgtcttcttaagaacacatgtagggaagattttggccatttctttaacaccctttaaacagtacctaccagagaaaaagcaaacactcccttctaaaagcatcaatattctacttctgagatcaaaactacaaaacaggctcagacagaaacctgggcaaaggaaccttctgctgcacgtatgtactatttcccagagatgtaaatgatttttttctctctgccccagtgaatcacatatgaaagttctcaaagaattagtaaagaaaaatggtgaaaatcttcttggtgttgaaggaacagtggagtgtagctggtatcagaagttctgaagtgactcagagattcagaagggtgacaggcaggggcagtttttactagaggaaagagcgatgtaggatgaacaatttactgtccctgttgattcacataggatgtaagtacaagagaagtcaaggatgtccccaaatttcttgcataggcagcagatgagtgatgtcattcactaagacaggaatcaaagaaaaatgaatgacatgtcatatcacacgtagaatttgtagaagctggagatgtatagcttgtttaaaaggggggtttagtatggagggttgaagataaaaggtcaaatatgtgaatgactaaatgtggaggaggaattagatttaccctgagtggttccaatcttgcaagttctcaggaaggaaatctgagatcaataaaatcaaactggcccacagttcaccacaccagttgaagaaaatgagctgccggcacctgtgtgagtggaggtgctcctcagttaacacttggtgagtgcaaagaatgcagagggcatttgagcaccgggtagggatggaaaggtgacttttagggtctttgttatcattattattctatgggcattcttcatatataatatttagagcttcgattctgggccacaagttgatctgctattcctgaactactacaaatttgagcataagaatcttggcagaataaattatcccaggactcatgattgctgggttctagcaatggatatgcattaatcaggcaaattattcaatcaatcttgggccttagttttctcaactgtaaaaggcagtatttaaactgttaagcacttttaactcagcaattgtaggattctaaaaagaatgtatgtacttctacgttatgatgaaagtcactcttttaagtttaaagaaaaagttcctacaaattagggtcaatttatattccaagagttctggctgtccctatcaggcccctcctccccctccttgtccttatattttcacatctgttagaagaacagatcttaatggtcctattctcgttctgttactgtttgggatctgaatgtattctgagtgttttctgtcttccaacagctggagagatcaaagaactgttcctaaaagcaaggacaagctacagccaactgcatatgtaaactttcatactgatgtatttagcacagtgaattatacccccataatttataatatgagaaggtaggtctaatccaataataataaagacctttaggagaaaacaacaaaaaacaccattccagcttccagccagtggtctgaatactcacagcctaatacaacacaaagacattccaatacaatgaaataatttggatcatgtccagcctctattttttaggatgatagaaataagctcaagagagctaagtctatttattattcagaagaaatgaaagtcatagcatacacttctaagccaagagatcattgacaaaatttgctaatgaaatcaattcataactttctttcagattttcatttaaacggctgggttcctaatatatttcaaaatttacactgattaccctctacaaaaagtatgtcataagagaaaacaatgattacagagtagcaagggacttactttcacaggaacggtgctttatgttgctgaaggcaattacaaaaagagagtaagaaaaattaaaagcaagagctagagctcagaaaaacttgggttcaaatcccaactctgttactcactagcaatttagtggggcagcttacctagccttgtagaatgccagtttcccttttgtaaaagtgtactaaaaggtactcgcctcctaaatttattttgaggataaaatgattaatataaaaaccctattacagtaccatgaaaatagtgaagccttaatgaatgttagctgataataatagtgctgtcaacacatgagaagaattagaatctggtgggagatgaagacctactccatgttctctgttctgtcttcttgccctgaggggtgtgttcatcaatatttaaggaactagaaggtgtgcatcttggatgttaaaaacaggggctcccctcacctatcagtgaacagccccaataccagagatgattctatacaaattttaactggaacatctaagataaccctgagaaatatcccaggcatatcttaagcagcctgttatttgagggaacacagaattaacccttggttttatccttagaaaaatgggatgataacatcttttttcacaattatcttcacaaattattataaaatagttatggcagagcaaaaactattgacatgggtatttgctaccctttcccctcctctcttcagataaagagaatgctggttttgcctcttctgtcacaaccccctcacctgccccccgatgaggattcaactattgctagatggattctttgagttttcatgatgcacaatcaaaagacaggggataggtagaagatatgggcttgagctcggcagggagaggggggcggtttaccagcgggagtgttggggagattttggaagagacgttagaaacatcaaagtagatgggaaagaaaatagggattgctagaagtactgctacagattatatatcccctttaccatgctttgacagttaaagaacagaagttgttaggtcactttaaattcacctttggttgactgcctgtttctttgacagaatccctacttggagactggaccaaagaggctatgtcttccatagaggcaacatgagaaagtaagagaggtgcaaacacatcatgcaaacgttaggcagaatttattgtgttcatacatgacatggggaacattgaaaggattgatgtcttagaaaggcgtgttaggagtgtgggtctagaatgcataaggttagagatatgcctgcactgggccatcatcttattttaatatttggtccaaattctgggcttctcacaatcagagagctatacctaccaatttcctcttattattcttggctgcccggtccccatccctctactcagagatttctcaagctttgcactaatggcattttgggttgaataactgttgtgggggtttggcttgtgcactggaggatatttagcaacatccttggcttctacccactagctgccagtagcatcttcatccccactgctggcaagttcagggggggtgtgggtgggggaagtcttctccaaacattgccaaatattccctggggagcaaaactgcttctggtggagaacctctgctttaccccaatcatccaggcttacaagaaaaattcatactccatcaagccattctacaacacttcattttcagagtttccaactacagagattccaagttctcagcaattcataaccattacagtttgcctcatgttacactgactgcatcaggctgtcatttagaaattataataatggctaccacttgttggatattttttatgtgctaggcattgtgctagggacttaacagggtgattttcattcttatacagaagtaagtgtggccgggcacgttggctcgtgcctgtaatcccagcactttgggaggccgaggtgggcggaacacctgatgtcgggagtttgagaccagcctgaccaacatggagaaaacccgtctctactaaaaatacaaaaaattagctgggtgtggtggcgcatgcctgtaatcccagctactcaggaggctgaggcaggagaaatcacttgaacctgggaagcggaggttgcggtgagccaagattgcacaattgcgctccagcctgggcaacaaaaatgaaactccgtttcaaaaaaaaaaaagaagtggtagatattattatctccattcagagatgagtaaaatgaggccctgaaaaattaaaataactcatccaaggtcacagccaataagtggctgaactggggtttgaacctaatctgtcccaggtccatagtctctccttgtctcaggccacactgtttctcctgatgagaaaaactaatgcagggatacacaagaaatacatttacccaaagttacatgagttcaaatggcaattccactgtatggactattgtagaggttgttgatctcagcactatgtggactcagcagtatggatgtctttgttctagggacatcaacaagctgatttttgaattatgaattttctgcagaaaataggaaaatggtgctctcctttaagtagaaacaacaaacagtagctggttgccatggtagcagaggtaaacttaaccttgactgggaaggcaatcaccagaaagggacagcaagtatggtcaggagtctaaaccagaccaggggtattttaactggagaagagaaagtcaaaggagagaaatgatagtcatctttagttatttgaaaggctactgtgtaactgaagtgaagcatacattcaagattattctaaatggaaaatccagcattcatgagtggaaattacaatgcagtcatggaagccagttttccactgaatgataagaaagaacatttaaccatcgtaatgttccaactggattgaaaaactaaacaagctgtctagagagcaataggtcgctaaaatagaaagatcctaacaggaaggtcatctctcttgggagacccagtgtgggtgagactgggctaaacaaattctcaggccccctccccaagcaaaatctctgtttctccagagaattagtaaattggggttccctgttgaaaacagacaaatggaaggtccactgggcggaaagccccagccgctcatcactacaagaggagaggtaaactacaatctcacctgggaagaaaatgttgtttaggtgacacaaaccaaggggaggagaaaccttgtggaggatttttcccctctgttctgaatagatgatcaaggggtaaggcagtaagggcaaaaccaaaaacaaaacaaacagaaaaaaacccaccaagaatcaagcagctttctgctgtcttccaaccctcagacactctgatgcctctttcttggaatgtaccgccacctcccactgctttggcctaaagactgcatttaattttaaaaagaaaataggcaaccatccagctaggggacagttagagtaacagttgattagtccttttctaaacactgtcttttgtttcattgctctttatttgctgtacaccaacaattcattaaaaacatctcaccactagatttagtgaatggagaggacaggtctaaacccaaacattcctcttggaaaaccgactacattgtaaatttgcagacctgtccaggaaagtaaaactgttacaaagtcaacctctactgaggcacacagcctcctttgtaaaagaaaaaaaaaaaaaagaggtgctaaaaaaatgacaggtttttcttaaaaaacaacaggtttttcttaaaaaacaacaaaatcttattcatctttccatattcagcatgaagaacacctaagagaattttccctatcgcctcatctccagggcactcaaagcatttacaatctcattattttatacaacacccattaagtgggcaccaaagattattacccttctttgatttctaagaaagcaactacagaaagtttaaacaagttgcccaaggtcgttcagtaaattgagatgcttggattttccattcagtgattgttctagggacatagtgcaaagtgactgaatcctctaaactcaccaaaacccctaagtcttacagatctcttccccatttctcaccactcatgagattttcatcatctaatcacaaatctgccaccatgtggatcttggacatgggtatcctaccaggccagtgccatgtctgcaagaagcctggtgctacacctgacagctttcaaatcaccatcaaatgattcctttatctagtgaagttgattctgcctggctgcatctgggaaatttttaacccctcgattagccattgcacagttggcttaacttggatgagacagaggacaaaatagtggtggtttaaaaaaatacctcccccattctgattacaaaggaggcatgattaacgaagtaccctttgtatccgagctccattctaagagaaagagaaagagctttccttcccccttttttgatcgctgagtcttttcctacttgtctcatcacccacacaatctgttcacagcccaaacagacaatccagccagtctgtggagagttcctaaaacatttatgttgtgaaagcagacaggatgaacaggacctcatctcgacaaaggatgatgggacattcagcaaaagagttcacgaagggaaatacagatggagtcccagagctgaatgaatttgcccacaatgtctaacacaatgccagcccttatgggtacttgtaaaccttctggtcaattcacagccacctccaggttttatcccccaaattccattacttttagaacaaagggttttaaaagaaaatacaattaacaagttaaggaggtccaaatcagtgctttaaggatccttcaatttctctagacctttaaacataaaaatagcaagttagatgaagattttagttccaacactaccagatcgggagttgacataatgcacataaaatacttaatacattgcctggtacatactaagtactcaaataatattacctaatattttcatcttacactgctctattttattaatgatgtttttatatatgtcattgcctgtctactcagctaaatagttccaccttatctgtttttggtataatccaaaagataaatgccttcatataattatcttatttaagctttcagatctatagtaggttacagatgagacagtaaaagcaagactaggtctcatagctggcaagtggtagattcccatactgagatctcaactcactaatttaacatccagtgctttatttcaataacaccacagatgaacagattatcatctctcgtgcctctttgtattcttcagaatttagctaagcgctaagatataccttaatgatcatctaaaataaatttctaatgataggtaacctaacatgtctgaagatttattttagtgcctttaataaggaagaaaagaaatgggtggaaaagcccaaccatacttggctttgaggaaagacatgcctctgtttttatttgccaagggaaagcattaccaggtccatttagaaagacaagaggaagtaaagccgggcgtggtggctcatgtctgtaatcccagcactttgggaggccgaggcaggtggatcacctgaggtcagaagttcaagaccagcctggtcaacatggtgaaaccccgtctctactaaatatacaaaaattagccaggcatggtggtaggcgcctgtaatcccagctactcaggaggctgaggcaggagaatcacttgaacccgggacgcagaggttgcagtgagctgagattgcgccattgctctccagactgggcaacaagagcgaaacttcattccaaaaaaaaaaaaaaaaaaaaggaaagacgaggaagcatgagggattcaatgatataccaaagagataaatggggctagagccagaactcttgatactctgctcatggctttctgtattaagttcattattaatttggcaccttgagtgagatgaatcttgccttggattatgcacatcaagttgtatttcagatggctgtcccatactttaaaggcccataccaaacccccatgtatcaaaaaaaaaaattatctgatctaaaaaatgcctagatcccttagcccttaacaacaaactgtcttattttatggatcttgtcttcccaaatttaagttgctggagggcaaaatccatgtgtttactccttctgtagcccatggctaacctagttcagaacttgtagcaacgtgtgctgctcattgcttcctcggcctcacagccttctagatgtcccaaagaaacctcgagtcatcataacatctactgaatttcccaaccatccccagcactactgctcggcttgggcagtcattaaagcttctcttctgccttcaggatcttcatttcagctgctgggacatcctgttgccatccatttcacacagacatccagcccagcaggaacccgtgttgcaatgagctttgcttcaaagccagcagcctggccaagttccaggaattgtcactaatgatcttcaccagcaacttggtgctcaacagtgatctctgaacacacacacacacacacacacacacaccccatttccaatactgctctagttagaggagctgcctaacagaggttggttccataacttattttattctttaattgttacagaggacttatttcatcaaaataagctaactgtccaaatacactctgcaatgcagcagtggcctccaccaacttactccttttttttttttgagatggagtctcgcactgtcacccaggctggagtgcagtgttgtgatcttggctcactgcaacctctgcctcccagtttcaagtgattctcctgcctcagcctcccaagtagctgggactacaggcaggtgaaaccacattcggctaatttttgtattttttaatagagatggggtttcaccatgttagccaggctagtctcaaactcctgacctcaggcctcccaaagtgctgggaccacaggtgtgagccaccacatctggttccaccaacttatttttaaactgaagaaggcataacaagtgtatcagtttcttttggttgtaagagacaggaaagcctgctcaaagatacttaagcaaaaactaaattagtaagatgatactgaaaaatatctagagataaagcagtcttctagtggttgttttgagaaatcagattatgtcaacagatctcacttctctacagtcattgaattccaccctgtattttattagcttcattctcaggcttcattggaaagactccaacaattccaggcttatattctgtgagttgaaattcagtaagaaaaagagaggacatctcttcctggtagcctccacacaagtctcagaattcactctaattagactaacttgaggcataaatccaccgtggctagtgcttggcttggtcacatgtccatcactggaatcagaagtgaagattctcttaaggcacatggactgagagtggggaaaaaaatgctccacaaaggagattcaggcagatcctgctgccaaaacaaataggcgaaacactaggcagccaaaaaacaccaatcatcctctccaataaatcttccttcttttcctaatctccaagaagttgtattactgggatgatccaactttgaaaatagtatattaaaagaaaggaacaaccacgcaagtcatataaaaatatatgtagccagtaggcacatgaaaagaggtttaccattactatcaatcaacgaaatgtaaattaaaagaataagatattatcagcacattgggaaacattttttaaacaaaagtaatcaccagtactggctaacatgcaaagagatagacattcccagatttggctaatgggtgatatgatgattatcactgaccatcaaaatccttaaaaatgtgcatttcattttacctaagataaattcacaaaagtgaatttactaaggaaataataaaggatgtacataagaatttaaatacaaagaagatttctccagtattgtttataatagccttaaactggaattattctaaatgtccaacaatagattgagcaatttaattttatccatactatgggttatcatactgacactaaaaataacctttcaatgcatgtttattagcatggcttaaataagtagaaaggcactatacaaaagaattaataaagtgggcaacaatagcatcattcactaactaaacccagtaaattagtttcaccctcatctcctaggcactccctggttccttctttaagatttaccctggggttctaaagacccagattccacccggggaaagagaaaaactctggacaccctcagcaggctaaaatgtgttgaataaatatgtaaagagagaatcaacaactgttcatgggaatggcttgctacacagaggagggtgaagaagatggaccacaactgtcatttacttgtcctggaagagagctcaaaaagaaatgtttggccaatacacagtgatttctatcacaagtagttcatattttttaaaactactcttttttcttgttcttcaacttgtcataatgtagcaattaatattcaaatcccgagttattccttccacaaacatagctactgccttgccaaataaaccataccacaaacagttactccccatctcagttttcataagtttaaaatgtaaatatccctgatggactggcctatcttagagtgttgttgggaagatcaaataagatgatttctactaaagtaccttcaagaaggataaaagcactatacaaatgtgaggtatcaggtgtatcagtgcattacgcagatttcacaaacacacaacagagcatgggagagttcatggcaagcctctggctcctccattaccctcatgtccttttccctgcagtcatttcagaaaaccagatgtttgtttgcaaagtttctctgcagcaaaagggcaggccctctctacattcaaattggctgaagctgtgtttctagctgttgaaacttagacaataatgggggagatgccaaaattaatccaaaaagcagacaggcacactttacagactggagccctgagatggaaaaaggcagcagcatgaacaagtagagggttaatggttttcatattatttaattcaagccgcaacaatgacagattctaaagatataaacttctgagagtgagcattctttcagaattagtatacaggggtcctattagcaatattttatatactccaaatatcttcccaaaggaaatcactgctgaaaaagacaaagttctttgttggtagggctgtgcgtttataccatggacttaaatacttttcttctacagtctcctcattttaaaaaatggcaaaaaatttcaataaaacatggatggagcaataagaagtacactgaagttcttaaatgcccttctttttaaatccccaccccaattacgtccctcccttgaggatatttacagtcctctatgacacatgctctgtaccttcttggttcaaggaaaacacacctacagcatttcaaattaactactgacccttactctcacactataaacaaacccttttcacaatctcaattgcattgtgtccacattgattaaagcttgaagcctggtgacctcatgtggtgttaacttctcccatgcaccaacagcattccgcctttctactcaattaccccctttggtgccagaggatcgctacccaatgaacacatacaatggacttctgcttcattacactaaccaacagcaggatagaaataagcagaagaggaataaacaagctaatttatcatgaggacagagcaagctttcaccagtctcgccatggaaaacttcagtggttaacgggaacatcaatagtctgggggtgatgtttatgatcttacagattatggacaaagccataacagaaccccaaactgactgaagaattctgcagattggcaggtgtgaacacacgcacacaaaacccatgccttaaaactccggggtcctacataaaacctactcagtaattattttgggaagcataaccctgggctttggataacgtgggctgacactctggtaatttgctccaactgttcagcttaactgtggggcccctcttatttatctttgacaaggtggtcaggaggaacccagcccctttgtgagaggggtctggttcccccaccgccccctgcttcattaggcatggcaaggacacagcggttgattaaattaacaactttggagggcttcagtcccagttcccagacattagcaccatcatccagaacaaattaaaagtctcacagcaattaagcagattttgaaaatgaatttcccatggttcaatggctcaaccacaatcttgagttaagtatcagagaagagtattgaaggaagagaagaggaactgactgctgaaattccaaagtaaacatacaactggtagaagcagcatacacaataaacttctgagcctctgctaagtaggcttatacatttcttttatagaaaattggaaatattcagtcacataaggggaaagaataaaacattaacatagaatggttgtatcaaaatggtggatttttttttcttttttctttgtttttaattactttaacatcattttattcttgttcaaaaatataaatagatattgagaggggacaaaaatacctacttccagtcacaggcttttaaattcaaacaagaaatcgtacatccaagtctggaactggaatcatctatatttctctgaaccagtacaactaggttcacagcaggcaaagaccttttatgccagcctccaaagaaccctgggtgggtgatttacctctaagaactcatttctggatcaaaagaataagattaatgataaaatcatacctatcacattctaggtgtgtactctttgccaggcactgccgttttgaggccttgtcatacttgcttccttccctttcagtttacatatgctcctttaatccctgttcccgcctcgcacctctgcctggctctacttgcaagtcacaggcctccgttcctctttgcctgcaggcagacatttggcacagcttgtgtgcaggaacctggaggaatcctgaaggaatgtgcgaatgaattcattcccactcaccagatctataagctgaagacagtggaatgcagaggtagttacttgaatgaactatattttcctgtcaagggcatttataaaagctgacatcataaatacattattggtctctaagtacaactgtaaataaatctacaaaattcttagaaggataactttcaaagatttgtttttcatctttaaaagtttatagaaaattaagcaaactatgtggctcttctaaaagaagccccttcaaaatagccctcacggaacagaagaaacacatttacttcttaaagacagtaaatctcaaaatttgcattacagttcaacagttccatttggatattcaaaatttggaaatatatatacttctgtgtgttcccttcttcccactaaactttaatcaactagtatagacaaccagccacagtcaattatctggctttatggccaagtagggaccaaaatatataacccagacataataacaatcagcataacagtaggcataggtaatgaaactctccgctagtggtcagaaagctcagttcaaaccttatttctcactatgtcttccttggaccttagtttccacaatataatggaaaaacgtccctttccaactccaaaattgtaccattttagaaatgtaagcatgtatattatgaaggtaacacaatcttttatgttcaagtgaataataaaaaccctcctcccatttaaataataatagcctggaatataatgttataaaacttagggaggacctcaaagccttaaagtagaagcattttagttacctccacaataggtccaaaatgcaaggcattcatctattcacctcttcaacagatattattgggtacctacattgcattgatctgtagtaacagccataaaggtgagtatattagaccatcattattctcatacagcttacagtttgacagaggttatattttaatcattattttttgtttaaaatttcttataaactataattctagctaatgtttcagaagtaattaatattttatttttaaaaatcatttttcctcaaagtttgactttaagaagtctttgtcattcacgttattatctagaagcaaaaaaatttcccagtggatgatgactccaattttataatgtaaaacagaagtacaactgggattcacttcgcagcaagcaaagagggaataaatctcttccacataatgagtgatatccatttaaaaaagtcatgctacctgggcttatctatgctctaaagagccatgaatactggcccagaattttaaaagacaaacatttagattcaaattaaatgttggttaaaaagaggaaaaacaacccaagttaattactctaatttaccgaatatatgaatgacctgcttattggactattggctagcatagatcttgcctaataggaaggctatcaagcagggtggctgggtttctaattttatccaatcaattaagaggcagaaataacctgcccattgaccttacgagacacaagttgactccagaataaacaaacaaacagacttgaaaagttaattatgggcaacctctccttcagagaaatggctcacatatattaattgatctaacacctatgtgcaggctcccaagaagatggaactcgttctctcatttaaatcccacaacccccgtgactcagagatttttggttcaggaaactgaggctcacagaatttaaatggttagtctaggttacaaagcaagtttgataacaaagagataaatcagatcactgccatttatcaaccataaaaccacattccatcagttattatagaaatccatcactttgaatggagagatcaagtttctcaaggattaagcttctcatttaacatgaactatcaaatggaaaacctcgagccaacacttatttttatagcgtgactatttctcaagaatcctgtaagaagcccacatcaagaggcaactttcaaaattactaaaatttcaaaaatttcaaaattacaaaagtaacagttctgtcaagtgggaagagttaatgcctttcctttacagagctgctttatgtaactagccgaagttttaacatagaaatattactgtttcatatatacattaatcttgactttgttaaaatcccaaacatactgctcatcgatctcctaaactttctctttttcaagaagtaggtgggggagggaaggaaggtattggaggaattcttctgatatctgtaaaaacagaaacaaatgctaattaaaagatgaccttagtgccctttcagtttaaaaatcttgagcatttacaaattatcttttttttctctttcatcaactattacccagaaataccacattctcatagagcaaagctctgtcctgtttgggcatgttcaaagaatagtgccagggatttaatactggcatgctcatggacctgcaaattctgaaattcagggggaggcatgaataaaaagatagctgaggtcccacagttgcctgtcacagccaagccccaccccacccacatcctcatatgatcctcaagaagcaaaacctttctgagatattctataagtgacagcaaggcccaatgtgcagtcttttcaaagcctcagtaaaaatcttatctatgacttcacttagcccagacacacaggagctaaaaggtaaaagcctggttcacacaagccagaactagctcaacagaaccgaaaaaagaaaggaatgtcttttctatatcttttccatgtctgaggcattctgctctggggcaaattacaacctaaataagaacagataaaatatatgggaactgagtaaaagaaatagaacctcaaaaagggctgctctgcctggaaagaaggctggaattcataaaacatggaacgtaacttttttagtgatcacctgaaggcaagcttgttaaacagagacttaaaagtcaagatttatttcagctaaattagatggtgcagaaaaacatagtgcttcgtgactctgctcagtttcaacaaaatgaaaagacagaggaggaagaatttacagtataatacttgcaccactcaaatcacaaaaatacacttgttagtcacaaaggaggggcccataacattgtaagccttattttggcaatgtgaattttctgcttgcaattaccttcaaagtgaagaaatggcagagacgaagaatgaggaattttgttgctgcttttgtatgtaaattcgaccaaaatatatagtgctatgtgactttaccccaagctcactagaacttcggaattatgcctgccacaaacatcctccgaaagcacaagaattagtcatagatttttttagtcaaggaagcctcagactgataaagtcttaaaactagacgcaaggactgtgctttggattggataagtaatgactatactgcgtggttttggtgtgtgttttttagagttttaaatttacatttccccaagcaggaggaagggaatgtaccacaccctcagcaagcaaggaaggaatttagttgattttttttaaattctgtagtgttccttaaaatccacatagcatagcataacattctatataattctgttgttccataagggattggctaagtatattaaggatacaaagggaagggggagatgacaaagttattgctattttattttcaagtgacagaaaaatcaatcgagctataagaagcaccagttgggaatgttctgcacattaactctttaatagccttagacagaaatcagatgatcttcacactgaaactctgaaggacatatatctttggggcactgagtagcattagaaactgcgtccaagccatggctccacctctaattgcatgaactgaatggcttccctttcctgggactcgaattccttctaaattaaggtagaacaagatagtcttgaaggccctttcatccttacgatttaatactgacaagctcttcagcttctattcaggacaaacaccaccaaagtgtatggatacaatggattcaagtagccacactcatggacagtgacaaaatcccacagctttagggtggaatcaagtatcatattggcctagaatgtattgatgctgccaaggtgtggggtgggggtgggggtgggggtggggggcaggggtgaggtaccactgatgtgtgaaatgacttgcctaatatcccagagacccctgaatcccaggcattcttattctgaatagagacttttaatcaatttcttgtctcatcctatgtcctcatgttaccatacttctacaagtctgtgctgccagtgagggttggcaaatcatcccaactcagaaggacagacttacaaaatggcataatcaagcttcactaacactgtatataaagtaaaagtaatagattgagtaaaagcatgagagattctcttgggagtaaaatgtgcatgctttaggagaagatttggacttgtgttcttatttgttagttttctgcaataacattaatatttatcatttgggggaggttcataatgaaatacttggttatagcacaggaactaatgttagaaagcaggatgacctccttaaactttcaaacccaaaccaagtaaggttttgggtcattcccattccttctgcctcaacagatctacaaatctgtaggtgttgggcaaagtggtggtgactcaaagaaggaaaagaatggataataaacagtgtcgtgtgtaagtttccccagatctaagaacagagagggacaaagaaatgtaggagagatggatttgggattaatcaaatggtttcagtgcaaagtcctctggaaatcacatctctgataggcctggctcaatgagacactccaacaagtgtcaagtcctcaagatagtagattccagtgatattttatgcttgtagcaatccccatgaggaaggagggctctgtttcacatcgcagttgagagagggagtcaatgagattttatgacttttttgggatcattgaggccacaggttgtctgcagagtcctagccaagtttctctccactaaatgacgctgctttgagaccagaagctctctcttttggagggggtcagccaggaccaaggcagcagttaactggcctccaaccaactttcatgaggctggccttattaaactaggtctgaagaaaaactgagtcaaccatttacagacttattatcttctttctaaaggaaaatcataatgccttgccaaaacaaatgtaataacttggccttttctttcaattacctctgctttcttggaaatgtgtatctgtggataaaacctctgagttaacccagggaattaaccagatgtttaagaagaccctgtgattcctgtgggccagcaaagaaagaataccccttggccacattatgagaatggagtactaaggagaaagggggagcagaaaattaaacttgaaggcccaggatttaaataggcatagcagatagaaatgttagctcagttttgggggattgggtgacactggaagcaggttttggaaatccaggcacaagctgtgtccttgaaaagacagtctcatatatttccagagcccttcatttcattttcttcagtctatattctacccccatcttcctattccacatcctcattacactcccatttcttcaacagctaccttcaggacctacgatgtatgctaaatccagggaacattcagagggcccactatctcgacaaatttcctattacaactctaagccatcttttgctgtatgcaataatttcctttggggagtgttggcatgtaatttctgaggttcagccctccctagcatggcccagaaacactgccaatatttacaatggctggtgtaggcagttcttatgtctcaggagttggggatcccttgttaaggaagtaataggccaatgatcagtaaccatgcagtgatatgagtgcatggtttggggaaggggtggaagcaaaacgaaaaggtgggggggattgagctttcatcttctgctctatctgtgtagaatcagtttcaccacactcatccctttgtttcccatagaaatggaaaggacaatgggaggaaggtagcattaagcttaagaatatggcttaggattcaatcaaggactgtgggcttgagtcttagccctctcatttactatctctgcactcttatttactatctctgcaacctcaaaaaaggttcttaaatgagcctcagattcatgtgaaaattgaagaaagtaaagtatttacttctttgggttgatgtgatcattaagtgaatctttacatgtgaaacgctttccatagtcccccagtcttccaatatgattactgcttttgctcccctacaagatttagtcagggatagaatgtggggggtggggggaagaggtggtagtaagaggctatagaaatttagtatttttatattataaattatacatcattattttctttaatttagcaatccttttagattcatcattttatgagaagaaaacttagaaaacactaaagtttgagatcattaagtttgagaattggcatgtctcaagctcctcctctccttcccacatccccatacgggcactttctctagaactgtgcagagctggcacatttattaggccaccatcacaacccttcagagaaaaagtaagacctaaatgaaatagtcgtgatcatttcgtgtcttgatgctccctgtgtctcattacctctcagggtctctatcaaaatcaagggctgcaaatctttcaatagagaaatctattagcatattttccaaagaacaaaatgtacctattcctgctgtcagggctgctgtttgtaggagtctctggtttaaaaggccctcgttattatgcatgggtgtgcatacaaacaaaacttctccgcatgggaaaagaattttcagctttcagtaagaggctcttttctcaattcctccaccatcactaccaacctacaccctctaaaaacctctccaacctccactgattctttctttcctctcctttgaaaaagtccggacttactgtataactacatatatgttaaaatcaccaactagagaaaataaaattgagtaatattcttgcaagtagcagaatctcaaacatttgatggttaacttggctgctttagtcaattggatgattcatacaattatggggactggttagaacttgaatggaattggttggactggcacaggcaaacttctcaagacatgtcctcccctcagccttggcaaggcactttttgggtctgtacagctggactccatttcatttatcatcacatttaatattttcttccttttgatgttacctgattataaaaatgagaaatcagttttagtgctattctcatgtttccctgcattcagatttttattcaggcctaaaagtcaaggttttggggaaagtgggaggatcacctaaagttgataatctaggctctgatgtccgattgactggagttcaatcccagctttgaccacgagtagctaggtaatcttgtgcagttttactagatctttctgcacctcagttcccttacatgtaaaaggggtacaaaaataccaatttgccaaggttttgtacagatgaaattagacaggctttggcacatattgcacattcaatacatgttaaacattttatcattttattaatatatctatttcaagatgaaatattaatataattagttgatggtataattagtaggggttctaatttcatacattctcgaattcccaataaataagtgaaaattatcttgatgctagaaaactacatcctaggaaatcttttgttgtaaacttagatgacgaggggctcttttctacccacagctcccctagtttactcaagctccatgtctcctctttaccaaccccgtgtcggcatgtagccccatcctgagcacacagtacaccctaatagatattttgcaaatcaggcaagtagcacacaggagttttaaggacctttatataatttcaacaaattcaaaattctaaatctccatagaaacacctttatgaggaatataaggtaagaaatatttctgcagtttatatggatttaaacattttaaggtcaaatcattgtaaaatgtcatgtaggaagggaaggcctgaagtctcaatctgggtttcaggcagggaacctgaaaacctcacaaagccacacataacactattagctcaaggaaatgtttctcactgtaacaggaaaagggaaagttcgaatagaagtctagacaggttgtactgaaagaacaatcagatgaaagagcaattcaagccgggcatcttgtgcctgtaatcccagcactttgggaggccgaggcaggtggatctcctgaggccaggagtttgagaccagcccggccaacccggtgaaaccccgcctggccaacctggtgaaaccccgtctctactaaaaatacaacaattagctgggcgtggtagcaggtgcctgtaatcccagctatcgggaggctgaggcaggagaatcacttgaacccgggaggcggaggttgcagtgagccattgcacttcagcctggctgacagaacgagactccgtcacaaaaaaaaaaaaaaaaaaaagagcaattagagattgttagcatgagcatgattacactgcaagaaccaaatagttaagttttttttaagtcaaatattgtaatttcaattactcttttaaaaaagagtaattgaaaactctttttaagagtttacaaaagagtaaattaaaaacatgctcttttaaaaaagattaatttataaggttgcacagtactcctacaaaccacattagatacttctagtagttaacaaagaggaaaacaatgacattttacaaaataaaaagcagaattgaatacagaaaaatatgacttaacatcaaccaaaaaccaattgattaatcttgtcaagattcttgtcaagattctcaccagacacccaaatactgaaggattacaactattgcatcattaagatatattaaaagaaatgcaacaagcttaaaatctaataaattggagagtaaacacatatactctgcataactgtaatttaatttcttaaaattctgcaacttccaaataaacaacagcagcagaaacaaaagctcacataaatgggtcacagtaaagaccagttgcctccacttaaacaatactagcacaatcgtgtgggctacatccttgaaagaagtagataatccatgcacaatttgagaaaattgattacatatgtgtgtatgttatatcttatacagtatacattacatcctcaacattaaaaatttaaaaaggccactcacataagttaccttttggaagaaacaatgatcttttctaaagaaataataattggtgatttgttgatacttacagtttatgtttggaatagtctcatttatgggtatgctgaaaacaatgcaacaattttctattaatccagttctgatcttcatactcttagcagttttagaagagctgagaacagtgacctgctttttcaaccattatatttctgagacatgactaatttgaagctgagcaaattgcacataatgggattcaagttcatgatttttagtctgcactctcttttcagggtacatggtctccttccctccctgcttctaccaccacccccaaagctgccttttcaggagctaaattcacccaacatgaaatcaaaagagaattatttttaagttttctgcaggcttatttttaaggaggataaagttatatttttaaaaatatttatcttttccttcaggtactaccgcatttttaaataatttctaaatatttagaatgtatttagatgtatttagaatagtagatgtatcagatgtatggtttcatagtggctcaaagtttttaaaaaagcattatataaatcagtgaatttataaataccctaagttctactatgtaagatgttgctttcagagcctttttgcaaaatcccattaaaggtttagcttacagacactggtgccaaaaaaaaaaaaaaaaaaaaaaaaaaaagcaagcaaaaaaatgtgtttttttttgtttttttttttttttggtaagaaggatgttgaaataggagaatatttaagctggctaaaccaaagccaattcctggaggctagttgcttttatagtgaatgtttaaattttctccatcaaatctagaaggctacaacgaaacaacagcctaaatgtcatgtacaattctctaagtactgaaagagttacacaattttagaaccgaaagggaccttaaactccttcctctaccaatgaggagcctgaagcctgctagttaactcacttgcctggtcactctggggttcacggattgttattgtttggtggggtggttgtttttgtgctgtatatttgtgtgtgtggtgtatgcagtactcacacccttacaaacaagagctttgccatttatattctccccttcctaagttgctcttcctaagtttactttcatcagcaaaaagagtgatcaaaaagaaaaatatattctggccagttcaaaggggacatttctttttctcacttggcctactgcagatatattagagagacacttcacacccaggacaactgactttttaagtggcaataacaatgagcagcggaggagttctcttctcactcgagagagcagaggaggtttctgaactttaccttgacttccagcctacaaactgttccttcaactactgtctccgcttgcccactttgttgctattctttccttagtttcctttgttttccagcttagggaagtttggtgggaaaatttttcacttacattttgttgatatttatttcccatatttgggtcctacccaaattttagatttaagagcaaaaaaaaattactgtttaagtgaaagaggaaaggctaagtcactgttcaacatgggctagatctgatctgaattggagacacagcctttgcaattgaggaaggagaggtaagcagtaaacttatacagtttcctccaagaagtgttatacatagatatttttcaaggaaattggaataaagcagtttattaattgaggggaagctagttacagttagcacctgccgcggactttttgaggttgtcgtcattaaccaaattcttcgggaaaaacaatctttggcaccacttactccagacaaaccctgtttggaacagacaagtgttctgaccctatagtcgctccaatgtccaccagccactcacgagtgcccttagggcttctccttggtggtagcatcccagaaatcctactagtttcagaagtgccctaggaagcctacttcttggataatgggctctgtctgcaaagctaggagatcagcctagaaaaagaaacacaccaacaaacaccaggaaactatgtgtaatggtttgctgcttgtgcaaaaacctcaaagaggatgaaggtcagacagggataataggccaatttaattctgaaagcacaaggtgcaagaaattttaattatggtctgccactgaaatcacacaagatccaatggcatctaactgcaactgctcatcaagggagacaagaggtgtaattgtaaccgctgcataatcactgtgagggcacagggaaggctgccttcagctcccagcagagaaggtattaagagcctcgaaaaatccaatacggggaaacgagattgcatgtagccaaacagaagctcctaacacaaaagccaacccgtgtgtgtgtgtgcgcgcgtgtgtgtgtgtgtgtgtgtgtgtgttgagggtgagggttccagaaagaaaatgtgaagctgtttggcccacactggggataagagattgtttgaaaactctgaacccttttctgttttgtggataaatgcacacagagaaaagagcactgtctcctttaggtatttctctccttgatgaagcttcacccactctcctttgtttaagacaattggcttggatgttaccgtgatttacagtaccaaactccctttaatttgttcccatcaaacccaagtctggagacaaaacgccaagcacacgactggaggtgcccaagcctgtgcagctctggcagcgacgccgccggcgcccccgggcgttttccccgcaccccacatcgcgtgggcgcccgtaaaggcacgcgcggagaaagcccctccgtggactccccactccgcaaagtttaacaaagccgtgaagtaaggaaaccgaacctcccgtccgcgcccgctgcaaagttggcattgaagtttgtgccgggatgtcccaaatcttgagggggcggggggcgcgagtgtgcagagaggcgggaggatggatgcagatggggagacagtgaggggaagggagtttttccgagtggacggtccgtgaggcggttttcttcacccggaagcctgtttgactcagagaggtccgggaggtgcacgccaggggaggtctcccggggcgggcgctgtcgccgaggaggccggcgagctgtcacctgcggggggctgtggtgggagctgagggcgctctcctaagcgccaaaagaggacggggacattcacagtcaccggctctcggggctctaagtagtgggggaagggatattcacgagtgggcaggaggccaaaagcaacacctttcggatacgcttttcccctccgacctctccaacttcccgcggcgctggtcaaggactccctcccaccccaccccatcccacccaacctcccggccgacaattcggacctgtccacggcagagcgtggggtggagtgcggcgggaaagcagagggcgcgaaggtcgggaccccaaattgcaaaccctcagcccctagcaaagacgaccaaatgcatttacaaccgtgcaagtatctcagccttgtaacagagctccgggtttgcgccgggcacagttccccgactcttctgttgttcctaataaagtcgattacgttgccctcccggagctgattggaagggaaccgagaggaaaagggggggaacgcgggaaaaagcgggggggggggggggcgagcaatcaactttgtaacccagcgcttcctcgcgcgatccgtcgccatgcttaagattcccacccccgccgcccccctcttgcctttcaagtggatactgaaactaggccaaaactttttcccctccttttctcttagccactagactggattgtgccccacggagccccatggagctctgctttcttaagcacaatagccggactaattagatcatagaagcaaggcagtgatactgtaacaagtagcccaagaggcaaagagggaaggggcccgaaaagacagaaagggggaaaagtttgcagctctccgcacttaccaatcaagcctcccaccagaaaggcgatgatttggaacacgagcagaatcccaccaacaatgcacagcttcttggtgctcatgttttctataattgccccagccatttttgcgccccccctttttcttttctccttgaaataaatgttttagggtgagctttttgctccctcctctcacacactccctccttcctcgcctcctttctgggcgctgcaaaacttcagaggtgctggagcgcggcgaggatgggaccgggacggaaggcgcccgcacggattcccccggcgcagccggctcgggttcccccaatgcccggagctgtgattgtggccgctccgccgcctgtggacgcttaaaggagcagggaagcggatcacatgacgccgcctccctccctttcttcctc

SEQ ID NO: 845 - DNA, 134089 bp, Homo sapiens
gtaagagaagtaagacaatactcaaagaatatttattgttgacgcttttttccttatatttaacattttgagataaaggctaaatgagtgtatttgtgtgcgtatacaagtacaatcaatgtgactgtgacaactgcaaatgcaaagctgataaacatgtgttgccttgttgactcaaataccagaagctgcgttgtcattgatgaaggaatatttcgaagcgctgaacaattcttgataaagttccgaaacaaacaaagcacaatcttccctcgatttacatgggagttgcattcctggaaaattcagtatattttaaaaccatgcaaaatatccttttaaaaaaatatgtaacatggagtttaggaccaaggctcaggtaactataaaaatttttacctacataaatttctagtggagtgtttgaaatttgtttaggactgtgtccttcattgtgggacatttgcagatttctcccttgcccactaaatctcaatagcacctcctccctcaattattgtgacaatcagttcctccacattcaacaaattttccaacacctcccgagcagcactgccatccttgttgagaacgtgtatctagttcatcttaagatagaactgcccccctcatccccactttctctcccaaatcctgtgaaagcccagcacaggcactgggggatacagcaagccacttaggaggattcccagcttgtgtcattgaatcatctttaaatttatttttatttttttttatatgtcttatcatcttccaaaaaggatgttttggtgaactgcaaagagatatactcagagacaggaaaaagatctggtagggtgaagaatgaaagaaaaacaggcaggcagaataaagctgaaagctgagcctagtatctaaaacgcacactcccagggcttgtatactcaataaagttgagaagtaactgggttgtcaatttaaagaggaatacttgatcagacacacaattctatgttgataagattaaaaacaagctctagtcatccttccgtacctgtaggagattggctgtaggacctttgtggatgccaaactctgcagatactcaagtcccttatgtaaaatggcataagggaccatttgcatgcaacctatgcccctcctcccatatactttaaataatctttagattacctataatacctaatacaatataaaggctatggaaatagttgttatactatattttttcatttgtgtcatttttattgttatttttaattttttagaatatttccaatccatggttgggtgcggaacctgcggatacagaggactgactataatatcaaggtaaggacatggattctggacccagactgcatacattcaacttggcttcacttttacaaactgtaggaccttgagcaaatcaccacatgcttctgtcttgttacctataacaggataatatcactacctacaataccacacaagtctattgtgaggattagataaattggtgcacataaagttcttaggagagtatacagtagttacttgtaagcactatataaacatttgccaaataagcagaaaaagttctcagagaaaacagtttttaccagcagtttttctcactaatagatgtggaattgaattacctagattgaaaactcagaggaaacttgacattcatcaattctaatctgtttgtgttacagtgcaggaaactgcagccagacactgaaagtctaggggccaagctcacatattagttgaggatccacaagttagttgaggatcctggtcccctggttcttttctgctgctcttgccaatatctcggcctggagctggcctgtggaggggtgcagagaagcagcctattgtctctccttcccagagtgtccacaggttccaaaattctaccttctcccaactgttctataacaccccaaactctcatttcttcctaaaggacagagagcaaagaataaatcaggtgtgaatgacccctaaactcaaaccctcaaggaatatgcaaacacatagtagagttcctttaaatatagtaaatcttcaactttgaggaagagggcgaatgggtaggtgggaggcaaaggttttaaatttagaaattaaaattgaattgtctaaactggcaaaagtctcaccactttccagttgtgagactgcacacaaagttacttgagagtctccaagcctcatttttctcttctgtaatgtcaaaacagagatcataaggctgtcggaatggactctttgtggcaataagataccatattataaacaggacccaaggtcatgccaggtaagaatgaagtcacacacccttcctcttaaggaataaactatattgtaactgcctcaaggttttttctttcactctagcagttaaacaagcactgataagtctccagcccaccatgaacatgggacacatgcaacatgcatgtttgctttactatgtatgcgagcatcccccacttcctaaatatttattgccccctgtaacctgctgaatatgtaaacataaacgtggccaaaccgttcagcataaattcctgctttacccctctctcccttgaagtgcctgcttttggtgtctgctggaggctatgcttcccagcctatcaggatggccacctgcaggctgtaaccttttgttagaagtaaagctctcctctccaagtttctgaaccttgtgattcttcagttaacagtaacatggggatgataataatcaacacctcatgggttgttgtgaagaagaaatgaaataatacaaagcacctagcaccatgcctggcagagaggggccaataaatgttcatcatatttgctattattattattattattataggcatcagcaacctatcagaagagaaatagttttcctttgctctttgaagaaaggaggccgccccagaaaggctttattcgtgtcctcttactccatgaacttagttaccttgtagaggggaacgggaatgtctggaaagaaagaacctgaagctcagtcccgataggatcacatgaagcgtcacaaagacagaagggttgcagggctgaatccaattcaaccactcactctagtgtgttcctgagagtgctgtcttctctctctgacccttaaacaaatatgtctacgttcactgtccagaatataatataagacagggcttggtattattaagatgctgcttactaaatgaggaactctgagatattgcacaagaaatctagaaacttcatgaattgggggtgagtctcccaatggtgaaagttcaggaagactggctgcaaggggctttgcaaaatacacgcttataaacacactttctcttcctttaacaaggaaaatgataaaacttcatagttacagcgagaaatactgggaaacaaaaaatacgctcttaaaatttcaataacttcatatattcattctacttagctgttacgggagagaaatcaaatatcttactgttgattttcattttccaagggactttgaactatgtgtgtaggtggcagtaaataccttcgttatagctgctgggagctgcagactctgcacacacaggtgaaggtggttagacttgtgtttcctgggaagcaagggcaagtaaggagtgtctaccatgggccagctatatgcctttggtattccattcaacaccctcctccctgtgttagaggaaacatttctcctcctgcattcttcccagcctgtaacaggactttctgtcctctgggggattgggaagttatttcctgccccttcctctttttacttcttcccaagggaaagaatgacttctcttcttagggaggttggagaagggtcctaaacagcgggctctcttgtttaggctgactgtgagacaattttttcattgcttctgctttcctatggggagaaccgttgaatcgtagcctgggatctggaggttgatgtctctcttcttgctctccagaattcattgatttgaggcatgcatctgacctccatgtttctgcaccacagactcaattctcctcatgtgcaggtccagacccagctggggttgtatcattttgaaggtcatctgattgcaggtccactttaagggctcctactcaacaaccaataaaggtcctatattcatctgtatttgctgaaatatgactatttctcaattggttcagaatcagagaagctctactacccagaagagttggaacgggccttgaaatgtaacccaagcatcttattatacaggtaaaaagccaaaaatcatatgcccctcttgccagctgaccttcccagaccccacccaggtctggccacataataatgtgcattgcccaaggtggcttgattgcctggtctggcagctggaggagtgggccctgcacctgacctcactgtgtcttggctttgtccaagtagaccccttgccttcgattgttttgtgcctaatgttttcactcatttagaaacacctgcatctttcttcccctggcagtgctctgaacccttttttttgccgggggcactgtcaccagtgtcttgagatatgttcctgttctgtatctgaccccagtggaccggaacctgcacgtaggtctgctgcctccctgcctagcgctctttctgctcccaccagggtgcatacctctgtgaattacatggctggacttctcttaacatcagactctattaactagaacaatagttttatctcatcctgtgattcaaagacggttgctagggaaaccagtggggatatgtttaatctgtaaatcctgtaattgccctaaagtagcaacaattcatgtgcttgcttcaaaaggatttggactgaactgactgggaagcaggtgagtgaagaagaacaatcacaggttggctccccttgtgatctgttcacattcctcataaggtgttttttcctgctgctttgccaaaaagctaaagggattaaagagggagcactgcggtgcccttctaatggaccaggaaagctagaaagacaaaattatgcagttcttctcttcttatggattcaagtggtcagagctgagtgattggaggctgtactggtggtgatggagagagataagaggataaatactccattttattttaaaatggattcagaatcctataattgtagtttgtagggggatactaactccaaatgaggagaagcaaggtatttgggaagtcttatcagaagaggccagggtggtctaagcataggagcacagagtcgggtttggaggcgtgcccagcatcatccccgccaagcctttccttaatccacagcagtattcagtgggtcacccacatgctgcttgggcactgccaaaaatggagaacttgctccttcccagagcagctcattttgtgtttaaacagccctgattgttagaagatctgccttaaattgaactgaaacatggggtgctgggggcaggggacaattttcctccttgacttggctgtctggcggagctcacagaggtttcttcataagacatgccctacctctgtcacagggcccacacccagcaagccacactggctcaagggcccagaactatccagaccgttgaagagtcccaccttgaggcacaggacagaagcagtagggagaaaactaaacattccttgatgtagtgtttgattaagaataaaatgcacagcttctgtctctcggggccctgcaatgtttgtgatttaaaaaaaaaagcaaaatctaagtgcagaccctgtttcccaggagaaaagtcacacgaaactcttctttatacaaaatggttctgagaatcatcactaccattatcggtggagatgactcagtattctagacttagctagttatgcaaagtccagggaggtcattgtgctctcttttggaaacataatagttccattaatgcagctgaatatcacatttgctctgagcagctgcatcccactgctgactcatgttgagctctacaatcagtgaaaacttggagggtatttctcctttgtaggtgcaatatcatatgatccctcctaagcccagctctattgggactatgggtgtccagggtccctcctagctccttgcctgcttttgctgtcaagtttgtgagttcaccttctgtattttaaaattcaggattgcagcctggtgcgatggcttgcacctataatcccagcactttgggatgctgaggcagaaggatctcttgagcccaggagtttgatcaagaccagccagggaaacatagggagacctcatctctactaaaaataatttttaaaaaagtagccaggtgtggtggtgcatgcctgtagccccagctactcaggaagctgaggtgggaggatggcttgaacctgggaggccaaggatgcaggtagccatgatcgtgcctctgcactacaacctgggcaaaaaagcaagacacctgtctcagtaaaataaaatttaggattgcagggattgcaccctcctgtctctggttctttgttacctatcctgatctgtgaagtcttaggcagtcactgcctgtgcatagttgatgtatctatgtggtcccattctcttcagctctaatttatccagaccagcatgtttaataaggttagatgtctgatctaccctttattaatgtctattctcttttccaattcattgacagaaaagttggaggaaagccaggagccagggagttttgctttctttgatctgttgaagcagcataagtagtttacctaagagtatactgcccttgtgagaggtaacaatgcaagattttggaaaaagacatctaacctgagtgcttatactttgcataacccttttgcattgtttagtactactggtttttatgctacttaattgttttaaaacagggatttataaaaatagacacaatttgctaaattctcattcagttcagtcactcttaatggaaagtctagttttatatgccacaaagccataaccaaggtgccacctcattgtagaaaaagaatccagaaagaaagaaatggttttgagtagcaactttgaaaattccaaactatgaaacaaaggcagaaatcactgttacaaggtccttggctttccaggaagtccaaaacccaaatgaaaaaggcatcttgattttctctctgaactctgctcaaggtttactaagaaactacctaccacgtataaatgggaaacacacaaaagatgtatttcttggaaggtgaggggtgttagtgattttggcctcacattaagggagccagaacctgcctgaactgctagaaataaggggtggaaagacaggactgggttctggggctgcatccagggaaaacatgtcagtaccgtacacctaacaccagatgagtggacagagacatgtcaggagaaaagaggaaaaaggaatgccccgggctccaaaaagaaaaggatatgggattggtgtaagggtctgagggatgagagaaaagaaaagatggtgatacataatcacttctcttttttccttcagaatgatgacctaaaactaaacattggtcactgcaatcaaagtgttaatatgaaaaatcaagtacctcgctctgaaatttcagaatttcttggtggggagttaggactaggaagaatcacagccaaaaacaactaacagtaactcccatagcaatgctctatatttaagatgtagatacatccataatatatatactctggagtggtttattaaaaggcacttcgagccattcataaagaaataaatgatagtgcaaggcagccggactcaatggccaggaggggagttagcagtgagtgctcttgaggagatgccgaggctgggtgggcagagggtacttcgaggggggcctaagggagccctcagtgggcctgggtgatgatgtcctcagaatttcccagtgtgtgtgacctctgcagcttgagtgttcctaagggaagtttggaggataaagacagcatctctgggacaccagaccagtgtccttcaggtctgggagccccacagagcaacagctgggaaagtatacggttattggaggcaaaacaatcaaaattccattccagaaacgtgtcccttgcaaacctaggtacctgctgctcactgttcaatggtggcagacatttcagtgtaggcagctcagtgcttctcatgcatagacagactgcttcccacttccccacccaaggggcacctggaaacgcgtgtgcatgtgtttgtcactgtgtgtgtgtgtgtgtgtgtgtgtgtgtgtgtgtatgtgtgggtaggtgggtgggtgagtatagaggctactggtatgcagtgtccaggacaagagatgcttaatgtcctgcaacacgagatcagttcctcagagcaaatatggaccccattataaaacaatgtgctttggacactgtcaagaggaaattcccttaaaagaactaaatgtataccttactgaaaccaactaagtcggtatgcatttgaacgtgtatattccaatgttttctgcttttaaatttaaaagctcttaaagttagaaaatacagattagcataaagaaaatgatcaaaataatcctcattcctactatttaagtaattaatatgttggtatcgattaatgtgtctttccatttatttatgaaaataagacaaaattatgcatactatatttttagtcagctctttttaattactatattgtgaatcttcattgacttaaatagatccttttgtatataatttttagttgctgcctcatactgtattttatgtctgtaccattgttgaactatcctccattgttgaatagctagattttttttttttgctattaacacaatgtggcaatttatctttgaacggttttttattgtcagagagcaaaaggatgtttaacagctggaaggtaggaggatagatagagtgacaagagtttaggttctgcaatgagaagacattgcttcaagtcccaactctgccacttactagccatgtgaccttaagccattcagctcaacctctttgcctcagtatcctcatctgcaatatgagaataacaatacttacctggcaggatagcacaggagattaactgaagaaatacatgtgaaagtacctttcaactgtacctcactctgagagagaagggggaaaaaaacatgatcttccatttactgtgaatctctcatatgccaggcactttcctgcgttttacgtgctttattgcatttgatcctcatggcaaacctgtaaggcaggggctatttttttattacccacatgttacacagaagggaaatgagacatgtggataatctaccccatcatgggcacaacggtagaagcggcagcacagagattcagacccgggtctgcgggacacaccccaggctctgaggtggatacaatgcagaagagaagcacactccccagtgtggcaggaggccagttctagagccttccagacccagctccccgggagatgaatcaccagctagggacaatcccgaggccaaaaagctcatgatagcctgctcacagtcttgaatcaataggtcttttattagtctttaaaatggggaccacaatctttatatgtatacaatattcgtgcattccagagctctttcccatccattctctcactgttctgacaatagctctgtgctgtgggtggggcaggaatcggcttgtgaagcatcatcctatatgttaggacagggaagactggaactctggatgcctggtcccaaatcatttgaaatttgaataatcccagcttattggaaaaggaatcctgtcttttctacttggtatctgtgtagctttgggtaactcatttcatttctcagattttcagtttcttcatctcttaaaagagaccaaaagcaggaataatgtttatgtcaaggattgtcctaaaatccaaatgaagtcatggaggatattaaaaatgcctaccactgtgtccctcccacctctaaggcagtgtacccactccagccacccagcccatagtgtgctatggtctacaccagatgcccccttcccactccactgtgggtgattggactgaggtgggcaatgagctcaaagagtagttcactggccttaaaggaattcatcaaatactgaactgaatcaccttgattcttttgagattttttttcactgataattgaatttttaattctacttagttttaattaattttaatttaatagccacatggagctaatggtgaccataatgtacagctcaaggctataagtttattatctggggaaagtaaaacagaagtcaaagaacattaaaaaattgagagcttttcttatggggaaaattggcacactaaagataccacggacccagagaaaggccaaaaaatatatatatgagggaaagaaatggtaatgcctggaggggcccgtgttagtagaattcaatatgaaagtattaaagagcacttctggtactataaggaatgaaatattatgaaatgcttagtgctataaaataaagacaacctgacaaagtatacttttaattttattcctgggcttgcaagaagttatgtaccacttatgcactaccaccttcacccccaacaaagacctgaacacacagcaataagtgctaagcataggtgaaaggcagggttgccctgctggcaaatgctgatgttaaaactgcaatcaaaagccagctaacaagatagagagattaagcctagggtcccagcagtgggctaaagtttctataggtgggtaaccctctggctctcaacaaaaacaaatctctctggagaaaagcttcctcaatttgggtccttagatttccgtggattaagcaacaatatatgagcactcaataaaatatgatcaatgaaatataatcaaacacacaagaaagcaaaccactataagcaagaggtagaagagatgaggtatgccagacttctacttctaagaactttaaatgttggaatgagaatatttgaaatgtataataattacaaaattcattcaaaaaatatgaagtcacagaaataggcatgcaatgctagactataaaaagtgaaatggtagatttgaaaaagacttaaacataacttttagaaatgaaaaatgttattaaaacagcagaggaaagaattagtgaagtggaaaatagagttgaagaaattaaacagaatatagcacaggaaaaaaagattataaataagaaagaaggatcaataatcattataggttccaagtaaagataatatattgaacacatacagctcattttactaccttctccaaacttattaaaactacagcaaagggattttaaacaatcatataaacccacaagaatgggcaaaatatgagatgagataccagcaacaaacttctggaaaatggaatataaatgaagaattgataacaatgttaccagagctaagaaaaccaaatcctaaactgatggtggggaaatcattgaatcaactgaatttgcactggaacacaacacaaaaagtaaaaaaaaaaaaaaaaaaaaaaaaaaaatacagtaagaggcataaattagtaggaattaaagataaaatagaagaactaccaaatcaaaaattctttaaaaagactattagattaatctttagtaagattgagaaaagtgaaggtataaatatgtatgaacaaaggaatatatctacagataggcaaaattaaattttaaaaagatttttaaaaaatttaatttaaaattaagttgaaaaaatattttaagtgccaaaagagatagcaagaataatctacactactttatgtctatacattggaaacaatttaaaatgcccagaaaaatataacttgtgaaaccaattgaagaaatggaaaacctaaatagccttataatcattaaataaattaaaatggtagtctaaaatttttctgcaaagaaaataaaagtctcaataatttcagtgacatattattattgcattaaataaaaaaccaaatgtccaagaagagccaagacattctgaggacaaacaggatgaaggaatgtgcttttctagattgcaagccttattaaaaagctaaagtaattaaaacagtatggttttgaggtaaggataatcaaattagccagtggaacagactaagaagcccccaaaaatctctgtctctctctctctctctctctctctctctctctccatatatatatgtgtgtgtatgtgtatgtatatatatgtttgtatatatatgtgtgtatatatatatatatttgctcgataaaggatattgtgttgtagatcatgagtggcttattcaataaatggtgctgagagcattagttatccatataggaaaaaaattaaagaggctccttattctcttacatacaaaaattaatttttgatggaacagaatcttaaatatggaaggcaaagtcttaaaactttttgaagaaatttagaatatttttataatcttgaaatttatttaaagaatttttttgaaagacacaagtacccattaaaaaagaaaacattggtaaatcaactacacaaatcatcaaagataccataaatgaaaacataaggaattcatatctagattaatcttgaccgtggtcttaagacttccagcctcctgaatagtaggaagtaaatgtctgttgtttaagccactccatctatagtatttttgttatagtagcctgagctaagacagctttatataagcctttggggaccatagatgaactacatcacttggttctagcatgttctgtggtttcaatgcagaaacctagagaataactaaggctgggagaaagaaggaccacactggtgggagaagctggtgacaagtggtaaggagtgggcaacctgggtactaattcttgttttttcttccccagccttgtggtcttggccaaatcaccgggcctgctgtcttttctgtagagagaagggctgctcggttctcatttggattcaacctttccaatgcagcatttaaacacggaggagggatttttttggttgtcacaaggactgggggaccctgctggctaaatatcctccaatgtgtgagacagttgcaccctaaatgccagtgtgcccctattgagaaacatcctctctataacagtcctttgaacgagccctttacatctctctacacatacatgatgtttgctggtgggtcgggaaacatttggatactttatgaagcatgcaggtctccacccaaacccacaggtcagatggctgctgtccaaactttaggatctttagggctgcagatgagatgctctgttctggtgtatgtcctgcttggggggctgcccctccttgccagaagaagatttagttgaattcaattgaagtgtactattaccaaccatttgctcccttgttctgacagccagcaggagcagaaaactggcttgctctggtactaactgcattctcagaaccgtgcatgcagtgctttatcgttctgttcaaagctaagcagtgccctccttgggacactctgggaatgtacagtattcattgctctaagaaaatgccttggccacaaggagaaaacattcgctggctgtggcttgagccaactgggtcagcgccagcctgtgcagatgtctttgtggacagagaagaagtccctctgggagaaggcagcccatgctagggtgcatagattgatgagaggagtgacaactgtatttctgtccttacttgctctcctggccaggtgctcttatgcagtgcactagctgtacaacagtacctactggctggaccctctcattctctaccaattcagcagtctcctcttggcttcattcaggaggctgtctccccatggttgcctgaacccaaaagcaaaatgtgtgggtcccacctacttctcacgctctagttctaaagaatgggcccaggtgtccagcctccacggcctgacattcaatgctgtgtacactccggttccaagttgcttttctactcactgcaccccagactctctgctaaacaggctactttagtcattgccacccaaataatgcttgtgaagttgcatctccacactctcatactcttcccttaccctcaccttttatccaactctttcaaggctcggctcattttcagtcttctgggaagccctctcaattgcccccaatcaggagttactgaaaagtgtccttgtacctcccattggtcaccgactgcacggttcatgtattgggaaccttgattgttaagaagattttaagttccttgaaggtggaaacctaatgagaagacttgcccttcaggctcctctacttaagaatcattccaagcaattaccatggaaacaaatatcttctcttcctggcctcttggaccaaaacaaacagacaaactgttaaagagcaaggaatttggctccctgcctaggttggcagtgagagcgtcagaacaaggttgaggccaaatccatgaacctcatttagttagctgcccacgaacttggcttggaacgccttggccccatcttaaagaaagcccttcattctggggacgctggtcagcctgaggcccatgctccttagtcccaccacaggaagccttctctctccatctgtcactctgagaccatattggctgaagctctgggcttactcatatcctgagtcatccaacctcgcatgtccgtaaaaatatccgtatccttataggtggaggccttatagataggttgttgagtcagatttatgagtttgagaaagagatgctttggatgcaaaggacctttggtgagtttgcagaagccctggactcaaatctaccaccactcagaacagtgaatgccagaaaattcctggaaaagggcatctctttgctgaatgaccctagtaatctactcattccccaggtaattactgagccactctgtgttccaggcacagttctagtttctggaaatatacctgagaacaaaacagacagaaattctgcccttatgagcctccacttcagctcctggccaagtctgtttttcatatgatccaagcactttggcaggtgttagggctgtaaaagggatggcatgggacccccttgggtaggggacgtggcagacacatctcttagaaatattgccgcaagcctcactgttcaagtctggtgtgtggagcagctgcatcagcacctccagggagcatgttagaaatgcatcgtctcaggcccttcccaagcccttctgagtaagaaactgcactttacaatatgctcccaggtgaactgtccgcagggaaaggcttgaaaagccttgctacaggacagcaaatcccacaagctgtcctacagtgaaagggagcagaacgataatgtgcatttgagaaagagtacatcccatgcctcagatttagaaaggtggcgtgttcaagactgagatctcctcagaaagaaacatgcttaaaaatccaatgctactcaactgtatttgatggctcaacaacaaatcaccgactgtaatcactcaacagaaccagcatcctgtgaaacacaccttgagaaaccagtagtggaccttctggcattcccggattcaactttcttggcttcaatgactgcagatggagtgagcccatggggtgataactggcagttttgctgaggaacaaatctgaatcatgcctactgccaggctgaggctctgggccaaggtctcagcttgggatagggtgaggatcagaaggctggaaagatagagggactcggagactgccagctactggttaacttgtggcataaggaggatatatacagaaaacactggattctatagctgaaatatgtcatttggagaaatttaggagccaatataagcattccttatttgtcatttcatgggctatatatattccacaggtgtcaagaatctataatgatgatgatgatggcaaagacaatgatagatacctttttaaaacttactatatgccaagcactgtcctaattcatatgttcccaacagcaatgctaagtggtataatcctcatttctgcagatgaagaaattgaggcacagagctggctcctcgttttaatccgtttcatgctaaatgtgacttctgagacctaggtgacaggcatctgactggtgcagactaaactggccagatgatggagtgaccactggtcccctttatccctcgagccagcccctgaaggctgagagacttgctcagagccccgtcccagaagtgggcaagattcatatttgtgccttagcaaaactgccagttatcatactatgggcttattccttctggaatagggtaaagcaagaacagagaaccccctctgggggtgccacttaggtgtgaagcagccctaattgggcaggtataggctggagtgacctcagtggtaggcctgggaggggacacctggtttgctctggggcagtcgtagaaggctcagcacagtgctggactgcaggtaggactaagcttggattataaggcctgggatcttctcataatgctggtctgcagccactgtgtggcctgtgacaggcctttccctgggtctcagtctttgaaaataatgatacaccccccaccacacccggtcatgggttgcaccttgggtttcaactcaatgactgcttttcaggaggtccctctggggctccttagggttatggctgctccaggctggcaaatccagatcatgcaagaggtggcttaaccctctccctctcagggacacgaagaagatctgttgcttccagattgcaccaacacacatgcctagaaccccagtaatgaagctggaacctctgctgtgtggtcagacaaacccaaggataaattgcccctgcttcttgggatgacactaggaattcgccattcttcacgaggcagtccctggggcctagagccaattcattcagtttaacattccctccctttgagacaaagtatagggtggtgataatgaagtcagtcgggcacagccttgagtgctggctgtgtgacacagggcaagtcactcaacctctctgagctccagcatgctcattggtaattggtataaatgaaagtacctatatcatgggactactgtgaggtgccagcacattatcagtgctttgtaaagagccgctattactcttgttgttgcttggacatttgttatgaggggggaatactttttaaaatttgctttttaaaaacatcaacaaatttctgaaggcattttcaaatgagactttaaaatatgtttttctcttcttataaagttaaaatttttgtatgaggttaggcataatttttttttgttttaaattaacaaatagcaatcaagggcttctaagcaattccaaggacccccttgctgctctattccactagtcttccaccctctccctcctggcagcagtcgttggcatttttgtatgtctcaccctggaggctggcaagctctgcacctcctggtcgggagcttccagctctcccctgcagctgtcctgaattcctcttgctgtaggttgtccctttgtcccagagcactcaccctaacagggaagtccctcatttcttcattaacttccaggttgctccctccccattaatgctgagctggagaagcagggttcacaggaccttacaatagggaccaggagcagcagctcggagattcaggccgcctttggcttccttgaccctcctgtacccagggccagcatcagggagggaggaagaggacagggacaacaatcagcagggcccgtgtaagcatacacttcttatggatgactcctctgacaaccacacggggtaaggccaggctcacggtcacacagtggctgagccagaagatcagtgtttttgcttttccatctaataatggctccgtctatacaaaattttgggcaggaagggcaatgcatctatcagaactcattggtgacaggcgcagcaggagctaaattggctgagttgaaccaggctgttacttcctagctgtgtgaccttagggaaatcacccaagctctctgtgccaacaattgtgcctacctcataggattcatttaaggattaaagaagttgataaatatcaagtgattaaaatcctacctggcacatccatagcagggattctacatgctagatattttaattgttgttaagcctcatgaaggcaggagtctttgtctatgttggttattggtctgtgttagaacagtgcctggtacttaataggggctctataaacagttgttgggtgaatgaatctatttctttcaagataaaaactcttttgcaatgcagccattgtttatcttggccagcagagggcagcaaatagctgtggactgattaattgtggacaagggtggttttaattttgaaggctaacagaactgtccctcctgagccagttagggaaataaaaggttgccatgaacctgtacgactggccccgacccctcccactcacctttgtgcaggttagaatgattgtcaggcattcaactcacaaaaaatcttggttccatttcttctcaacttactttcaatttccttcctccctccctccctctatccctgcttttcctcctttctccgttttctctaatcatatttccccctgcccccacactcactcctctgcatcaagctagtatactgtacacactcccaaactttatctgtacaattgcagcttgtactgcaaaccatgacatctagagtggatccttatacagtattcttcccaaccaatgaatgctgctaaacctagtataattttttaaacaacatgtaatttgataactagacccagagaggtactatagcttggccaagaacacacagcaattaggggtaacgttagagccctagccaaggccttctgctgtccattatacagcctcatcacacatgttctcttttgccaacaggaggctcgtgtggtccctgtttgtcatccagtcaatacggccatcagcttctggccccagacacctttcctctgcactgtggcacagaggagcagactgctttggagggcagcttcctgggagctccagggaccctggccaggcggccactgccactgacttcctcggctcactgagcccgtgcctgcagctctcgtgtttcctctgtgctgcagtggacgcttatcttcccccgatggcacatttctttgtcacagacaggaccctcactggcagtcggaggtgagttcccggggagcttctgggtcttgttggtgccttctggcaccacttgtggatgggatggctctgacacccaagcctcaccactgctccgggggtaacccaatgacatgatctccccagcttgctagatcctgtccttcccaattatgatccaaaaaatcatgctaggataactgtctggaaaaaatatttaattggtcttccagctgggaaacaaattctatatgaattgatgagaaaaaaaaaacagaatttttaaaactagaaaaaatgtgggtgacctattatcttaggggatatttctttaagcatgaaagcaaaactagaaactataaaagaaaaaatgtacaggttgactacatagaaaaaagctctatatcctggtaaacatccaaatcaaaataaaagctagtgacaaatggagaaaagttgagctacccgtgtaacagacaaaagataaatatactaaatcagactctcaagaaaatggataaagaatctgaactgacaacctaaaaatatcaagtcataggaacatgaaacatgctcagtgttactggtaatgaagtaaatgcaaaattcaatttctgcatcttgaagttgcaaatttcaaaactacgtagtgtcagtgaggatgcgggccacagcctctctcattctgctgttggcacagttctggagggctctgtatgcttacaggtgtccatgataaatgcttttctgtgtagccttcatcgctatcaccttactatctattgcctcctccctcccgccttcctttaccacaccaatatacttcacaatgatagggatattgtttactgatctgccccaaatgcttacaatagcacctggcccggctggttgtggtggctcacgcctgtaatcccaacactttgggaagccaagacgggcaaatcacaaggtcaggagttcgagaccagcctggccaacatggtgaaaccccatctctactaaaaatacaaaaaattagctgggcgtggtggcagatgcctgtaatcccaggctactcaggaggctaaggcaggagaatcactttgaacccaggaggtggagattgtagtgagccgagatcacgccactgcattccagcctgggtgacgagcaagactctgtctcaaaaaaaaaaaaaaaaaaaaaaaaaaagcacctggcccaatattagatgttcaacatatgcttattgaatgaataattgatctttaacccagtagttcttaggaattgatactaaggcaacaatcagtgatgtacaaaaaagatttatatccaaggatgctcatttcaacatatattgtaatagtcaaactttgcaaaccactgaaatgtccagtaaaaattatgaaccatcctttttagagactataatagtaaagtcatgaaaatcatgttatagaagacaacacaataacatagaaagatttcctagatatattttgaaaagggcaggttatataactgtccagaaatttattttctatgtataatacaatcttaatgtatataaatctacacatatatgcatggaaaaacttgtgtaagaacatactgacattttaacagtatttatctttggatagagtaattgtaaaatgtttacatgtttttctttactctttcatgtatttttgcagagtttctgtgataggaccattttgtttttgagactggattaaaaacaatgtagcagaggccatgggtgcctcacccatattcctcaagctggccctagttccaagtagctaagagcctggcggtggccctctacctacaaaggatgggagtggagtggctctctctcacagcttcctcagccccaggggacaactctgcagcatgttcctcacagcttgacagaggccctggccgtgcaccttggtggctgttctttgcattcccttcttctcagccttgcttctccatgccacctcagtgcttcctggaatcacctttcaagccagctacttgcacacaaatccttgtcccagagtctgcttttaggaggagcccaggctaaaaggcacaaacgctgttttaaaaatcctgcccactccgtgtaaagaacatcagccaagcatggtgctatagaaataactcctatcttggctgttcctgtgtgtagttcactttcaatctctcagcatccctgagttgaagagagatcttgcttaactgggagggaaggccaaggggtttctggatacaggagccaccttggggatcttagagcctcagaagaggcaaggatgtacgttataagaaggggctgtccagatgataaatgaaattaataaaccacccctgtgatgccagcacatggctcacagcagatctgcatcaggcgcctaccattgccctaggatgccattaacacctactcttccttatgaggcttagaatcagggctgctgaggacttcagaaatcatctcattcaggtggggtgaagggggtgggtagcttccctgagggtcccacagcaagagttagagacacagccaggaccagaacttactgaaaagcaataatccaaggtctgacttgggttctgaggatttgctcagttatagatgtcattctcgatttggcctgaagagggcagacacttgccattcatggaggtgaagagcttgtttttaaggctggactaacatctcccaataaggtcatttggttctagtgagagttgcagctcacaacattcttgactcttctgctgcaaatatgctactggaaagacactgaagttcacagactgaagttcctttagttccaactctggcactgtaataggtgaccttgcacaggtcacttcacctctctgagtctcacttcttgtgaagtaagatctctactccgtgactgagaaggtggtattggggagtgatatgtaacttacaaagttgcatattacaacacacatcactgctgttaagttctgtgtgtgtgtgtgtgtgtgtgtgcgcgcgcgcacatgtgcacactcgtgatggagagagcttgataaaggagagaggcctaggccaaaggagctttttctggcctcaggtgaatatatatttgtaaattctctagcaattggaaccaattcactttgtacttggaaaagacttaactgcttttactttatatttcgaactgtacttttttaaaagctaaagatgtcccttaacctaactggtgtatgggaaaaaatatacataacagggatatatgtaaagttctaccattaagtcaaaaatattgctgaatacagagaaggtattggtaatacaaatttttaaaactaagtatttagtggttgcttggtcatgagaagcaaaaaagtaagaagtgagtatttttaaaaatcctgtaccattttcctaggacatcaagccctagtacaggaagggacattttcacactaatctgtgccagctggagcagtcctgccatctgaacatcatattttggaaccctgagaagctaggatgcagttaacaggtaagtagtaatgggagaactttctagaaaccatgtctggaggaggggttcaggagctgagatgctgagcctggggtagggaagacttgagtggggcaggccctacaaaaaggggttccatcaatccaaataaggaaaagtcacaaaggaaaggtctggtctcaatagtgaagggcattgttccctgagagatcagtgtgttgtcacaggagacaggaagctctgaacacttcaagacatgcttagaaggccccccgatgtcagcagaaaaggggctgctaatgtcatctcagaaaccaagttatccccatgcaacaaaatcaatcacgtatcaaaacatgatggagagacagcctgcagaagtcagatggttcccggagcactacaggataaaaaggaccttgaaatacagaagacaaagtacaggctcatgaatgtctggacacaccagcaaattgagcctgaccaactgcactgacatcctgatgagtcagcttgaatcaagaagatgggtcccaaataactcagggtcacgcagcagagagagatggggattagtcaagtgtgttcactctctcaccgactcttcctgattgaattcccacactatgctaggcactttttagggagctgtgtatattttctttggaggcacagggttaggccattatctcttccaaggacagcagtttctctgtgaatttattccttgtccaccaaaaaccttctatttcctcttttagcctccatggttacctgaaaataggaaggaaggaagtctacgatgatggagccataagatatatgcattctttactgtaaaagatcacacagaaattctagtttatagattccccaatgttaccattcagcctttggaagcctgattcaatttgaaagagtagataaaatatagtttctagaactgacaaggtgaggatgagacccaagaccagggtgtggccactaccatgtgaacactgggaggtcctccaacctcccctgacatttctcttgaacttctcaaagttacctgcttggaccccaggggtatgagttccaagggcccgatcagctatgagattataggctgaactcaggcatcagaattgttagagctttatctcagttctgagaaatggttaaaaccacccttgggcagtcacacgtggaatcacttatttcattactatggacattttcttgtaggaacaatacatagtgaaaatccactgggataaccaacataaaactgattttgttttcagtttgatatagcaattgcattttatttgtttgttgtaagtattggtaaactttcttattttttaaaaacagacatctgtaaaattatatacttttttcctataatatcctttaaagctgcttgaaaaatgtttattatgacaatgtataaaactggtatacatggccaataataaattttttctctaggttgatggtccttactaaaagcattttctcacctcttgagtttccacttctctttccactgattgaaatgggttgcatccaacctgcattcttgaaatggagacttctttagtgaaactccaacacccactacacatcggtggagaaggcagaacagccaggggacatactgcaacccctctcctctggacctcaagtttctcctccactgtctatttgttatttctctcctgtctcaggatgaaagtgtcttttcactccttcgatgctaactcatcaacttgtactcttggtcccaaaactctgatttggcttgtggcttacattagctcctcaacatctttccttcatggctggatctcacccttcaggtttacaaacttagttcacttccctgcggactaaaaaacacaagtctccattttactctggctcttctcggagcaaccattttacctccttccttcccaccacaattgcccactgactctgctacacttctctgtctaccttctgcccttgccacttaagaaggttacacacatccaaaccaccaaatccaagagacttggatccttaaatgctgctgaacctctgaggacatctaacgttgtttctttcgtcttttttccttatgaatctggttctttctttgaaaccccacatttctctgatttatccaccttatcttcttcccctttcctatagaatatggccatgtctggctcaccactcttggtggtcatctgcttgatgttttactgctctgcccagttgtccttcttcctctcaatggtggtggctgcccaatctgctggacccctcagttctaattgttagctcatttcctcaaagagatggcttttaaaacctagcccaggcaaacccaaactcatcatcttgcccactgtgctagatcttttctgattgtttgcccaattcaaaatggattctccattctttggagatggacaccgatctataaggtaggccccaagcagccatttgacctgacttcctggtcacaggtgactggcacagggacagccacctgcctaagactcctgtttttaagtgagagaaacaagaactggataaagactcagtagtgaatggtactgctctgagagaaaggtgcatggattcctggtgctaggggcccttagagctgccccacttcccatcttcctggttaattcaactcttccatggatctctcatatatgctaggaaagttctagtacagtctgtctcttagctaagcttgctagagttggctcctacttagaaaactttaagtagtgaatccactgacatttgtcatccaagaatctctctctctgtccgaaaccccacccattcccttccccagcgagggcttgaaatttgactctgatcgatctttctgtgcaacccacatccagaacattcaaaccttgtgcattttatctccaaaataatcctctcctccaagtcctctgctactgtcctggttccagtctctgtgatctcttttctgggcttgtccagcctctccaggctccagtgatcattctgatcgtatcacttttctgcctaatatctgaggctaagtcttgtaactcttaccacagcattaaaaacccttctccatctggctcacaggtgcacagggctcatcatctgctatttccattcctatgtgccagccaggcctgatcgccgaccttatccaaacattgtccatgctttgcatctttcttctatgatttttgtactgctgatccctttgcccgttggctctggtaaaatctttctcctttaaggtctatctaaagtccttttcctaacccaggggatagagaaacgttccctctatcttctgggacaggagttccctgctggactgggaggcacggctccctttgattcctggcactgcagtggttgattggtaagtggatattgagtgcacaggatcgtacaccatcccaatgtccaccaggttaggaaaaggcctagagagaatagccaaagtcaaagcattttctactgtcactgcttaccacgctttaagccaaagtcaggaaaaggcaggctaggggtgctgagtggtgaattacatggactgtgccccagacctccagacctcagtgtctgaaaaacaagttactcatgaaactggttttagactccaggaaaaacacatttatgtggcttgctgttcataaaacacttccatatatatgaactgattgaaattttcactgtgaccccagtaagcagttaaagtttatcgatataagtgaggaaatagccaggtcagatgtaaatcacagaccttcaacaggaaacagtgttccttctctcggctatctccagtgcaagtgttaaaatacaacgaaaaaggctattggggaaagtctgaatagggcagaggacggctctgcttctaaagcacgtgatgttctccccacctttgttgtcacgcatatgagcatcccttgccagcctagggaggctaaccacacaggacagaaaatgtcactctttctccaggaataggtattatccccaaacactttgatttgatgataaagtatatcagtttttcagaaacctatttcccccatcaactccccacctctaggttcaacctggaaaataatctgcacgcatgtgtatgagttttagcaggaggggatatgcatgtacacatatgcatatacatacaggtttatttaaatgattggatctacacttttggaggctatttgaagtatcttatcaaaataaaacgcattttaagcaagaagttaaaaaagcttttcagacccgaaggccatttaatacagtaaatcttacttgggtagtttagcaaacattttttaaaacccacatccaacagattggttagtattagatacacagatttggtttcaaagctgaaatacccctggtggaataaatcttctcatgaaattcagttatattatgccacaaaacagggacacttatctattgacaacttaaatattaactcagtgggctacctggtgatataaataggaaaaaaacagtggtcatggattaggagtgagaagactatgacaccagcctaccttggactgggaccgcaaaggatgttaaaatctatcctagaatttaaaacaggaaaaatgtcaaatattccactccccattcggcccaaaccatcccccaaggaatacacccccaccccacccccacatgaggtttactaaccagctgctacagatgttactatgtcactaattaacaatgatcacagaaaatgtgtcataccagagtttttgttatcatacacaatgcattagtggctgcaggaatcttcctccaaaagctaccgtcagaaggcaaactgacaaatgtccatgccgctggtccaagaaaccacagctaagagccatgaggcattcatttgtacattgagctctctctggcatgctccccactctagttagaggggctggggtatggagagaccgtcccagccgggcgctgcagcctcctactcctgggcctccttgcgggtcaacttgtagatctcagtgggtccgtccacatgggtgatagtggtggtgagctggagttcttccccactatggacacccagatcgcctgaaacagggttttcggtgttagatgcattcaaggaggaaggagaagcaagctggggttcatctcatggacaactgccctgatgctagccctctttgacattctgagcacacagagacacctagggcacacaacattcagaacaaggactaactccaaacctgttcacttggactttgcagaactttttaaaataccatttttggctcctagatgacagtcattaagatacgtgagtcagctcactgctgatattattcatagtaatcattaacatttaatgagcatttactttgtgcctgacgctattctaatcactttgtaagtgatcttctttaatcctcgcagaagccctctgaagtaggcagtatgaacgtgccagccttacagatgaggaagctgggaggtaggcaaggtaattgtcctgggtggaggagcaggcccacaagagagctggcaaaggaacatctgatgccaagaccaatgtgatgggctaaaccagcataacacccctcccaacggatgggtcagtcaggcaccaacacatttgctatgaataatttacaaaataggagccaggtgcagtggctcaggcctgcaatctcagctactcgagaagcaggggtaggaggactgcttgtggccaggagtttaagatcagccttggcaacagagcgagaccctgactctaaaaaaaaaatttgttttaattacctgcgtgcagtaactcacacttgtaacctcagctactcaggaggctgaggcaggaggatcactggagcacaggaattctaggctgcagtgagctatgattgcaccactcactccagcctgggtgacagagtaagactttgactctaaaaaaataaaaaaataaactacaaagcatctatgtcacgtgaaagcaaataagacctgcttatatctatccatagattggggaaggagccatgtctaacacatctaggaacaatgaggggctttattctccaggaaaaaagaagtgccagaaacgtgctgtgcatttccttctgccctcaggattgtcctaagtgttctgaactcattatcagtggacagtgttctgctaaaatggaataatttgaacttttctaaattagtaggagaaaaaaattttctctaagttaaacctcgaaaactctgctacctgccataagacaagtgaatgtataaacaacaaagggaaaatggaaaacgcaaccacgctcagtctgactgtgtgtgggggtgcacgtgtgcacacatgtttgtggagaggggtgctggggaatagaaagttaaacttgtgtcagtgatttttatattgtgcacatatcatatgataagttttctggaactgaagtttttctaatttaaagcatagaattaagtaactaaatgctgttttccattgaaatgccataccataacttagaagcagccttggccctacccttaggactagtaatcttatcactaatttaagaactgctaggcatcaatgaatctggtggccttagaaccccagatgtcactcccacccactggcccagcaggctgcttggctggttcccttcacgtgtgccacgcagtattagtttctcatcgtagacccatttctctgtggctgcacagcaaaatcagtcctattattaaatgccaccctgtaagctctctacccaggagattccctggcctcagaagcagactcattggctgctgcagaggactgctgaagacatttggggctgttttggcaagggtctaatccacaggactatgggtagagaaggcattaaaggggcatcagtccagcctccagcacatccacattcatctgccctcaagccagagcatagatgccaagtaaggctggtgagaggctttagctgggctactttgggccaagctgaaccaccacttgtacagtgagcaactactcccaggccaataacttgtattctcactgctgcaacatctagtccacacctcagtcaagcacaagcagtctaagcttcacatttctcagtcaaagctatttctggatttgcatatctgggctagccatcagaacttcaaagccagtttcatgatctgcatgtctgtgtgagtcatcaaaatttcaaagagtcctgaccaccccagtggacccattagcactcataaccgtttacctaaggaatccctttccctgaggacttcttagaaatagatgctagagagtaattctactcaggctttgaaccaaagatgttaattctttaaacttaaaatatgactccaattagcagatcttagaatatgcatatgatcctacagatcacttgaaaaaacagccaaaattgccttggcttctttatttaaatggatacctatgtcataatgcttaacacgtgcctgacacagttctaaatactgtacaaatattaatgcacttaattctcatagcagtcctcagaggcactattatcatcactcccattctgccgatgaagaaactgaggcacagagaggctaagtaacttgcccaaggcccaagctgctaaatagtgtgtgggattcaaataaataggtgccaggatgcaggctctcaacttttgggttctgctgcctcttcttaaatattcaagtttccagcagccagtgagactgccagtgaggtatgaagtccacacacacagcattacagctaaaaatatccgcatacagccgggtgcggtggctcacatctgtaatcccggcactttgggaggctgacggcggcggatcacttgaggtcaggagtttgaaccagcctggtcaacatggcaaaaccctgtctctactaaaattaaaaaaattaaccgggtgtggtggcgcatgcctgtaagtcccagctactcagtaggctcaggcagaagaatggtttgaacccggaaggcggaggttgcattaagtcaagatcgtgcccttgcactccagcctgggtgagagagtgtctcaaaaactaaacaaaacaaaaaactacacataaaataatttgaataaattgtttagcatatttactttgcttttgtatctgataaatttatagcatataaatcagtgcactgacaggagagctgttataaatttatgagtattggccatatgcactgttaggggtttagcatgccctgtatttccttgtacgatgtgaagctactgtggcataattaatttctctactgtgctggatgaggacccagataatgggactccatgcaccaaaatctatgtttcacatgtgattttattgtaccttgaaggccaactgttcccccttggggaatgggtgtgtgaacgtggcagtaacatagcacgagtggagatccctccacttgcctcctaattccatcacctcctacttctgccaaggtcttgctccatctgttagtttccccctctcttggctcctgctgttcagtgcacaaacatgctcaaaagtctcttcccatctcagacaagaaaaaacccttctgaaaatgtgatatgtgtcttggggtgaaaaagagtgagaaagaaaaaagaaaagaatgctttagtttgcagtaaatttctctccctggttatgatgtcaaattcatcacagctcattaacaattagatgacggtctatttcttcctaaccttgtgaaatgagaccaatctctggcacagatttcatcccaaaggactacggcaatgcatccatatgtgtggagtcacatccacaggtgtgtaagcggctgcttggttgtaactgcctggaatgcctaatgaggatgaagaaagccatatgcactggagacagcttcttaggaccggcagcattttaatgacaattgtttgtgtatctgtgcccacttcaataaaaatgacaacagctactctcattctgaggatgtattacagattccgggagagatcggaggtaccactagaggtcttctaatattaataaggcctacgtacttccatcctcaccactaccaatgcaaattaacaccccactgcccaagtgtgaaagccagggagctcccataccatgagttcatatttgttctcaaggtcatacacaatgtgtgccggagccaagattccaaaccatctgtgtctacctccaaagcttatgttctttccagaacattcatgacctatccttttttgtagaattttccctaggcccacaccaacctctctcctattcaccttcaaagctaagttcaaatgataactttttgtaacgaagtctctggttcacagcagaatgagaaaaacagaaaagtgtagtattttaaagccaaattattttcatgcaaagaactgcttaagaatatgtctgccttacatttttggtgttaatatgattgttatgttaaagaacaaaatagtgtcgctggtgcagtggcttacatctgtaatcccagcactttgggagacagaggcaggaggaccacttgagcccaggagctggagaccagcctgggcaacatagaaagatcttaaccaaaagaaaaaataataataaaatggtgaatggtaggtttcttcttctttttttttttttttttttttttagatggagtcttgctctgtcacccaggctggagtggagtggagcgatctcagcactgcaacctccgcctccagggttcaaagagattctcctgcctcagtttcctgagcagctgggactacaggcgcatgccaccatgcccagctaattttgtgtgtgtgtgtgtgtgtgtgtgtttttaagtagagacagggtttcaccgcattagccaggatggtctcgatctcctgaccttgtgatccacctgccttggactcccaaagtgctgggattacaggcgtgagccaccgcacctggccttttttttttttccaaagaaagtaaatacccaggacagtatgtggtatatagtaagtgctcaaaacacccatgaaagatttgcctggtgcaggcaagggcagttcctctgtactctgcatggctgggtctagcctagcatatcggcactggtgttcttccccactggcatttaggaaaacaccctcagttagaaaacaagtgtgccttgggatagctcagctttgaggatcccttctgggagatggggcagagtggctttggtggacagggttaagagccctgggtccagttgtctctcggtgcctgtcaaccccagaggtcatttattccaggcttggagcgagccattgcccatggacctccaaagcacctcctgacacttactgccaggcagtaactgcaagtgggagaagaacacaatagaacttattagtttgggggtaaaatcttggtgttacaggctgaattgtatctcccccaaactctcaaattcatatattgaagttctaacccctagaacctcagaatgtgactgtgtttagagatagggccttcttaaagaagtaattaagttaacaatgaggtcaattggggatgggccctactccaacagactggtgtcctttgaaagaaaaggagattagaatatagatatacacaaagggaagaccacgtgaagacacagggagaaagtatccatctacaagccagacagagaggtctcggaagaaacccacgttggtgataccttaatatcagactgtgagaaaacaagcttctgttgtttaggacaccctgtctgtagtattcgtatagcaactctagcaaacatttaggaagccgaaggttcttcccaagaaggtaactgagatgtccctatcatggtggggtgacaagaattctaagactcagaaaaaatgattttaattgactgggccaggaaaggtcaggtcactggcacagcaatagccctgggagaggcagggggcagaagacacctgattacaaacagctgagcaaggggtgccaggctggtgacggtccatcagttggttcccaccttcactggggaatgggaaaacgcttttaagacctgctttagggtctgggtccagcccgtgtgacaagaccaatcccatcagtgctcacagacatcaagaagctcagctggccatgggcagatcatctaatgtacaatcagggagatggcgtcaataaaagggggcaaccaatgtcagggcctcaggacttaatccaacgctttaccgaggcaacaaagccaaagccatctttcctatgaaacaaggggcaggagacctcagaaacctccaggagtaaaactgacatcacactgtagctagctgccaagacgcggaaccagtgttgccgcttttgctccccgcagagtgggtgcattagacagaaaatgcttagcgtgaacagaaataggagggaatggtggcagtgagggcatcttgtgttccctctgccacagtcatctagttgggaattctgtgtctcacttctttttttaaaacattctgacaagaattttataatcaaaagaacacaaaaatcaaagctattatcaagaattgtctgacttcataagcagctccaacttcttattcccacctgaattgtggttgagtgggtttgcacagtttttcatgtgtgcagggctttgctgctggagccccgggaggtggtatttttgctctgagaagaggattcactttagcctgctgcaattcatatctgcctgggaagacatccagaatgattcacaaattggttatggcaacaggtaaaaagaacaactgtcatgaaaaggcagcagcagcaacagcaacagcagcagcagcagcagcagggcagaaaatataagtgttccttgaaggaaaggtaactaaaatatctttgctaaatttaaaaatctatatgtgcacgtgtgtgtgtgtacactcagacacatatgcataaaatgattacacatataattctatgtacataaaaataaaatgattaatgtgaatgagtttgcacattcactgccgctatggtccaccagccaataggaaggaacccaggggaagtccacgaaagcctgtggctataaagaatgtggcgccacactcccgcagcacctatctgctggtgagaacactccagtgtggagttgtcctgccacctttcaagaggtagatgaggaaatcttgtcccccagaccaggctaaagaccccttgagagcaaggactatgtctctgtcactccttcgagcttcacttcactccatctcattcaagatggcacaaggctaagtactaaggaactaaggtatgaggtatgagctaagtactgaggtgctccgtggttcatttgtaaagggtcactttctgatccatactatgaaagagaaacagaaatatatgagaaaatgctctttggaaagtgaccttgtcttgaacctgtggcccactttgttcttctctgtccattctatgaccaaaagagagaagaaaaagtctatcgtgaaatgctcaatgattccatttccttcctacccacttctacttcctcctgacacttggcatgtccctccaactcacataccaaacaacctccatcaaagattctttcccttttcttattgcctttggcatcagaaactgcttgtctgtgctccgtccaggatccatctaacaaaggctgaagccccacacacctgggattcactctctgtagcaagatatctgaattcctagctctgaagcttcaaagcaaaggagagaaagaaatagggagggaaaggccaaagccaacttaaagacttcccatgagaatggaaaaggagcatgggaatgctggaggtggagagagaatgccatccagagactcagagaatgtaaagacacatgtatccttccttgcaagagttcttctttgaggtttccacataatattccaaactaggtctttccaaggaacttcgaaatcttggcaaatgctccgtaattcctaggatacatcgtgtgatctggtggcagatgaagagatgaaaagtgaaacaaaatagagaagaaaaataagcagaatgcccaacatggaagagaccccttccaaatgcacaaggtcacagcaccatgcaggaaagggaagggcccacaagctgccaggggttcccgggggtgctgggaaatcacagatcatgttaccaaaggagaactgctaaatcttatgacttttgtgtttaggatcagcatatggtccccaaatagtttgcccactaaattgcctgaagaatgttttttcacagagggtctacttggcatttcacaggcaggacatttctttatgacatgagccttgttttgcctattgaacaacatttagtagcacccctagaatctggacactaaatgccaaaggcatgtcccagttatagtcacaaaccaaaacaactgtgaacatttaaaaacacccacttagcagaggattcaggggatatgacctcttgttgagaattatttgcaagttttccatgaaattacagatcaagctgtctttgatgaaaaactctgttgaggaagagtgaagtgcttttctcaattgcaacatttcaagcctaggagactggctactgtgtagggtgggaagtcctgatgggagctgcctaatatatggctcaaatctcaagaatctgtccaacatggtggtctgtagtcatcctgcctctgcagggttggccacagctctgggctcccacttgctgaacagtgttaaagttggacacgttctcaccagtgtttggaaatcccttacctatgacagatatcactctctgggctgccacttagtggcaagaagtgttcttctgccccttccctgctaataggaagaaagacaaccatggactttcttttcttttcttttcttttcttttgagacagggcctcctctatctatcacccaggttagagtacagtggtacaatcatggcttactgcagcctcaaactccttgggctcaagggatccttctgcctcagcctcctgaatatctgggactacaggtgcacaccaccatgcctggctttttttttttttttttttttttttgtagagatggggtttcactatgttgcctaggctggtctcaaacttctgggctcaagcaatcctccagccttggcctcccaaagtgctaggactataggtgtgagccattgcacccaggctaaccacagaaattcgtagttcaaaaggacttttaggagatcacttacatttgggagcagtggtgcacagagggttaagtgttttgccaacagtcacacagtaaaaacaaccaaaagaatttatgtacataaagtgctgtagcacacagtcagtacttgataattatttcccaccggtattatcattccatcatccaggaagtccagccattgctttaagtggtatttctctggaaggtagaaactctacctactcacatcaaggacaaggccacatggtttccttcagtgtcccccacaggatgaccatggaatgaaatcaagattcttgtccacaagcccagcagtgcttgctgctcgtgttgtggaagcccactgcttgacaggctgaatgctcccattttccacatgtacagtaaaaacaccgagtggtgtttttactagaaatggaaaggaagaaggctgcctagctcacaagccttctagcaaaacagtcagtcaaaccaaagttgggcagggggtaggtaagtaaatattctgtattctcacctcagaccagagatgggcttgaaactgattgtaacatgtctactccaaagaggtcaaggggtgagggaaactcatgtccagcatgctctcgcatggacatggcaaatacaggatgaagacagacagtggctgagaccactccacgtcccttgacccccagcacagatgccttcctctcctgctccacttcatctcatctctcaagtaactacccccctcccttctccccacaagatcactgaaggctaatctagaactcttacttctaagcattaattcactcaatattttaaaagtatcctaaagaactggtccttgccctgaaggagtcgatgatccagcaggagcataaaggcacagatgactcatcttccacctctacacaataaatgtcatgtggaaagtagactcatgatcccctaggcatattccttaggacaacagtttcaagagatacactgcctaaagaaagggtgccagggccaaatgatctaataattctggaaaatgctgttaccaccccccgctttgtaaagactgacagtacaaattaatgtactaaaggcattaacatgtattgcagtgaaaagccttattagtgctgatcaactcaatcattctcaagcatgtttgactacctaaatttatcaacatttcatggagacaatattccattgaatgtcatttgctggattctaattggggtgattgggaataggtgttaaagaagatgctgcattttgactgggcccaaaagatgagtagagtttcattagtcccagatggaggcagaatgtgcaatccactcatgcaacacacactcactgagtacttcctaaaggtgaggccaacccttggctctggggggctgctaccctggtttccactgcaaggcagagtgaaaggcactagagcactgatttgagaaagggcttcctatgtttggggaatagcaaatgcatggctagagtaaagcaggtgtaaaaagagacagaatgaggaataaggctgaaccaaacagaaaaagcatctattagatcagttgtttatcaggccacctgttacctgttaacagcactggcctagacagtgttaatcatttctgtctgctgtggctagtgaagaaaccctgagcaagatcttcccttctctaggcctcagtttctttatctataaaatgactggattctctaaggctacttgcagcatccatgtctcagtgttctgtgattataagatataaaaaggcagcagcacataccagcactaaaggacaggaagaactggggacaggagaatagctattggtttagacatacatcgaaaaatcaccttgaagaaaaatgagcagaagaaaaatgaagcctattccatcttcagctctcagggcccagactccctccacctgatatcttaggattctgcttctcaaatgggaagaataaacatggcatagtttccaacagtcaattgtgctcaaaaatgtaaagaagaaaatttgactcttgttctaaaatcaagacatattttagacttagcatgcaatattctcaatgtattttagagatttaaaaatgaggacttaaagaaagatctggcttgtgtgggctttttgtcttatgggtgagtcccctgggtgctcattcaccgtctcccagtgtgaggagtatacttggagggaaagtttcactgggcatctcagagctttagccatttaaatcttgtaaagacagaagcctatttatcctgacttaagctgttctaaagagacagaaactcaccattggactggtcttctccatagtttttatgggatggtgcatacaagaacatcagagcaaagacatacagattccacatcccatagatgcctgtgaaaaaggcactgttcacttggactgtgacgccgccccatttccaatggccttccgttacctgcggagaaaggatggtgatattcaattgaaacagagaagaaacagaagaaacataacaccaataaaggaaccaaccaacatgaaaaccaagtctcttctacatgtgggaaacatgaagggccatgtaagactccatcttttaatctgaatcatttcggtgtaaattaaggtcaactgaaggttctctagctttctgtcaggcacagtcagtggtccttaccttgcccacagattagtatcacctggggagtgtctcttcctaaaaacagcaattcattgctatccctaagttaaacaaactgtgtttgagcccatcacttattcacaattataattcctcctctgctgtctgtcttcccagctagatgtcaattccctgcaggcagagaccagttctctgctgccatgtctttaaggcctgatgcaccatagattaattcaaatccagtgtctaccactcactcggcttaatgtaagacaagatgaagactccagacttcagaacttcagtgtccgtaagtgtaacataaaagcttgcaggttatcgaagagaattaagtaaaaatatttctagaacctgcctggcaggtactcagtaaatattagttatttctataacatcccttgaagtaagccactcatgaaaataattatgaagctttcatatgcttcaaaattctgcaagagatgttttgaagctgcttttgtctgtgttaatgatttggtaattgtcttaagggctgcctaaagatatatggattacactaagaactgtcaacagagctgctgagctaagtgactaatttgtgccagctctgagacaaatgaaatgattttgaccacttctgcttactacgggacacttaaaatggaaatagaagaaagtattgggtaaatattcctttgacagctgaatgaggctgcgttgtataaactttctctaggaatcacttttaaattgtaagatggcaggctagattgaaatgttaagaactttaacaagcaggtggatttcattgcctgtttatgatacagtgggtctgtgttcattatcttctgtataatccataacccacttggggccctaggccaaattaaggtctaagtataggtatttttttctgaaagaccaggagtgtcagttaaccacattagccaattatagacttagcagttttagtttggccttggtgatacataattcttcactttttgtgactcataaacaaaccactattatgaactcttatttattttggaaaataatgcattttatataaaatgcccagaagtgttttctggcaaagatggatttcataaccattactaattttaggacaatgtaccagcattcaagctacttaggacttcttagaaatgtctccaaatgtcgctcttctttaagtgcagaatatactaactttataaaaactatattacttagagcatcttatgatgatttttattgcatataatggaaaggaaaagaaagcattaagatagtttccagaaatacaggtacctgctgtcataacacagagaactcttctgtatgtgattaaggaggggaggctaggctgtcacgcatcctagctgcaagagagaatatggcaatatggcagctcttctactctgttaaggcagtggacccttcagctcagggaagggccagtaagagaccctattcctgcgacagaagctggaaatactcaatattgacaattttagtgacattgattcttgctaggattgacatgactgacccatctaaggaaacaccaacctatgtgccttgcacacagtggtgctcgatagacatatgttgaatgaacagaggtaaagtacaggtatgtgtagggactccaggacaaatacatggaggtagaaagtggagatggaaagaaccactcttaaaagtacttgattgaaaagtaaagacaaagtattgcagtccacaagtcataataattgaatttaaaagtgagaggagatgccaatgtgtgacaagtgttattcatttaaaacattgctttccgttatacttatttaaaataagtggttaacacaaatattagcaaagctaagattcttttgtattcataacaaggataagcatatttattcaatgctaatgatgtgccagatacaatactaaatccttttacatgaaacacattatttagtcttattaatgacgctgtgaggtaggtaggtaatatttccattcaacacatgggtaaactgtggcacagaaagatggagtatcttgcccaagattgctcagccagaaagccatggctctgactccaaaagaaggtattcttaaccattatacaacacaagggtaggaatgctatcttaaacaggggttgatctctgaaggtagcacatgctctgaaggtagcacatgaggcaacgactatgtaaggtcaaatttccttttgaaattcacttcattgcccataatgtacattacaaatacaacatacatgcacacatttgtctattcaaatctgtatagtatgcactatatatcctggacatagtaacatatggtataaactggatatataaacaaaataaaaacttacagtagaaccactggaatgagatgcccatagtatgagaggcacacaccaagcctgacaggaaatatcagactcatgctcccgtctcgtacttgctctgggacacatgcacattgtttagagtggagttgcagaattacacaccctactgaatgtgcaatctgtaaatgtggtgtttcctgctgtgggcaaagagttgaactgcagaaataaacggtatagatagtgtaactctgctctttggtggctggcttgtttttccctctcctctcccaattattcatgcctaagacatcctcagctctgagcacattcccaccaatatgtaccacaatgagcagcctcaacagagcaggccttgtaaatccaaaatcttactaatgccaaggcggaggtaacagtctccccccttttaactttgagagaaaaatcaggtagccccagcccccctccgccaaaccctcccccctcctcaaaatccccaaatctcaccctctgcataagtcttatttctaaaagtccctgtttttcctgattttacatttgaacaatttacttttgtgtgaaaccacccaattatacccctggagccaagtgaaggtcaaatctctttacacccagtagtcttgacaaccaacattccacttaacaacaagatttccaaatcccagacacaggctctcttaccggaaacatttcctctgtaagtaacagaatgaagtgatcacacacacacaaaagagctggggacaggctctctgggagtttgctgcatgtggcttgacctgaatgtcaggcacctgggggtccccttaatgaaggtcggtgaccttctcccctgcactgcacttctgttccctactgccgccacctctaaatggaacgcctctttcttttccagagggaaggggctgaaataccagactgcgatgtaccatctcttggttgctatgactgaggccattaaaatggcaggcattaaaagactgcacctcagtacccagctacaaagcctcaaggtcactgcattccacagcttcccgtcgcctttcattcctggcctcagagcttcaatatcctggcgagatcccctcgcattatatttcatgaggcttaaatgcaagctctcccacagcaagcccgagagtataatgggggttttaatacattccttttacctaaggctgggatccatttcaaaaagttacccaataggtttcctttcaggtgagctcattgctctgacattccaaaatgacattaaaaaataaatcctctgatgactatattaatacagtacctgggacactgagagttatgccggaaaacgtcttagatgtctataaataaatcttagaaaaaaaacccagcaggaggaatgtgaggagctaatggaattcaaaaggcctcattgctacccccttagagttgaaatccactccgggccgactgtcgcagcagatataaaaagccagccacaggctgaagctgtattagaaaatactgaggcaatagaatattaatctttttctccaaagaaaagccacggactatgctccttggaagatggcttcctttgctataagaagtacactaattaaacatgtacaaggttaaatcctggcaacatgcagctgcttcagggatcagtccttcttgacttcaggtgggaggcattccccgcagaggcaagatatacatgaggcagtgtggggagaatgacgtcagcctcccaaactggcacaaggacctgtgtgtggccttaggatcaaaagcgtccttctttctgctttcctaaaaacatatcttgaaattgccttttatgcctcaacccatcttccttgagatgccgtttctccaaggaagtgctctgtgccctctcagccttgcaggtctggctgtgtcaagtgccactgtgcactactgagggactggaggaactgaaaagcattttggtcataggagggaatagccacgggagaagtcaggcctcagacactcttgtttgaatatggatgtttgagccttagctggtagaataaaacactctttcagagtttgaaatagttttactgcaaatggagtggaaagcgaagtttccaaggttttataaacaacctgatataaacacagcagtgttgtaggtcaaagcagatgtggtgaacagaacttacaaagacatatatgtgtatcagtttattttttccacgttcatttcaacctcagcagagctagcaacactaacactccccagtggcagagccaacaacagggctctagaggctccaaacttggggtcctcttgggtgtccttggatagaattcaaggggtccataaactagaatagaaaaaattatatattttcactagtctctagctgaaagataatgtttacttcaattatggatgtagaaaaatccctatagtgttagtactactgtgattttctcaatagaaatcatgatattttcacatcaattacagttgtagatataaatctgtaatatacctgtagcatctgtttcactgtaaatatatattacatataatatatagagatgattccccttgaaattcgaagtattttattttacttatttgaaaccattctaagaggagactcgtagccttcttcaggttgctaaaggggtccatatacaaaaatggttaggagtccctgtactagggaaacttcccagcagaatggagcaagtcgtgtcctaagacactatctacactactgaaatcctccattttggctaaatgacaaagcactggcaaaagagtcagaaggactgcgttctgatctctaacttattgcatgtcctttggcaagaaagacattcaagcttcttgctattcataagaacacagctactcatgcttacaatgtgccaggtgctctgctaactacatttggttgccacaatgatggttcagtcaacaacagaccacatgtatgacagtggtcctgtaagattataatatcatatttttactgtatttttctatgtttagatatgtttgaaatacacaaatacttaccattgtgttacaattgcctacagtagtcagtagaggaacatgctgtacaggtttgtagcctaggagcaataggttacaccatatggcctaggtatgtagtaagctataccatctaggtttgtgtaagtacactctatgatgttcccttaatgaggaactcacataatgatgcgtttctcagaatgcatccctctttgtaaatattacttcctgtagtcattacagcaaccttctgtggttctattgtaatatttattttgcagataagaaaattaaaccttagaactgttaagtaatccatccacagtcctatccagctaggaagcaacataaatgaaaactttctccaaagctattagatatcatagtctagcaagctaggataacaattcctgccctacttacctcgtaggatttttgtgatgctcaaatgaataatagatacattagatttaaacagtacttcccacccttcaaaacaagttatgaatattttaaaatgattgttattgagattttcaagtatagcaaaatgttgagttttggaaataaccagtgaaaagacaagatgctatcaaagagacttttgaattacatttcatatttaagtggcaatataattattacaaggaatagctgatggactgtataaggatctatgttaatgctagataaaaatggaatcaaatttatgcttgttagtgttgtgctacacggcttgataagtttttctcataagtaaataaaatatgtgcccttcaatctggctgtaggcttttaatttatttggaaacttttatctcctacaaggttttacggaaagagaaaatttagtccatttggccaggtgatatcaagacccagaaaaatatggcttgaccagctgtccagaattatggcctctctcctcctttcctcagtggctctattgaatttctgtgcagggtagagggatctctgcagagacattctcaccttgacatctcagggtccacttacctgactaacgatgaagaagatgacagtcatggcagcgcaggccaaggtgataagcatgaggaacttgaacctaaaaattagcccctattagaaaagaaagagtagtttaatactccatcagctaccaatccttttctcactatgtaaatctataaaaagcttaattttaaagaaatctgtaaaaccaaatccctaagaatgacagtaaaatagtttcccatagtaatatttcttctgcagaggtgagtgtggctgaaaatttcttgggccaagtatttcctatgttcttatcactcataaagcagcgatacgagagcctgggaaattatattcacaacacgtcgtgaggctgctaatttccctgctaagctggttatgcttctctgcaagggttcaaagttaccaaatccaagttttctgtggttgtaataaaattctgctccagtgaacaaaaagaaatgtgcatattaatcaacatgaagtggatttggttgaattttctcatgtcactccagctctggagacaggcaagccttagaaagtgcctgtggtttcctaagagcaggatttaagagaacctgtgtttcagagagggaggcctattattcaggggctcttctgtgcagatctactgcatataaaaactctgaggttctgtagtttctgcttctcttttcatacaggaattaggcttgtttctccaaggacagccacttaggcatgaacccaggggatccctgataaatcaaggatgtgttgcttgcattggggatttgaggatgttaagtgtttctcttgaatgaggaacataatctataaacagagattactgaactctgtctgagcatctgctggatattttaggggaatgtggcctgttaagagtctggaaatcagatcacgtgggctaaaccctgtttaattacaggacagggttgattctgggacagaactttgactaaagcctcatcccaacaaaatcccaattatgccatagtccaatctcccagctagtatgtaacctacattccatcaccaagctgaagaaccggctgaacaagtttattcattactgaaaatggaaacacatttgtaccacagaaaacaccaagatttaggccagctagatgcttctcagagtaagatttggcctctaattttgcccagagatcctacatgagaatctctcaatttgtatttcaaagtaaaggctttctatctccagggtgtgtgtgtttacacatcaagtggaaagatcaagcaagcaccagttccagaacgagccaagaaatctgcccacctcatagtgtagccgccggactttgctcatagctggcaggctggactgcttcccactgatgttccgaaacacctgaaataccatgaagcatagaaacaggaagtagaggcagaggcagattccagccacgatgatgaaggccatctggtcgtgtccagtaaaggaaacaacgggctagccaaggccaagttgagccgggtccaggcccttctccccaggtctgttggcaatacttgttttgtctccaaatatgtagaaaattttcaaggggataaaatattaaaacctgatattctaatgccaatgataggtttcttgacacattagtaccacagagggaggtgttcaatattgctttctaaaccaagtaagaaaagaaatggtgtcttgcttgttagaaatgaagaatctaggccctaccctagacctaatgaatcagaatctaccttttaaccaggtccccaggagatccgtatacacaataaatttgagaagcactaataaaccatatattcgtcactatggatcagatgaaaaaccacagtaaaatcaccagaagggttcaaatgtagatccccaggtccctccctagatatatggaatcagatattccagggctaggacatcaagtatgactatgtttgggaaccactgggctagtccttggagttttataagaatgcgattgagatactctggcataattgaagaggagatacgtgggggctcagtgcaggggacctgggcatgggcttgaaagtcttaaagtgaaaccagggatgaaggactatttgcaatcttctgtcaccacagaaaatcttgtccaacagaatggggattcaaggacacatggcacaggtgggagtctgggttgctgccagtatacttgagacccactagggagactgacctgccaattagagccagtctgagaaccaccaagtcttaggatagcgtgagctgccttggaaggcagatgacctgattccaacccctttctgctacaactttgcccaaattgcctttttttttttgagacagagttttgcttttgttgcccgggctgaagtgcgatggcacaatcttggctcaccacaacctcctcctcccaggttcaagcgattctcctgcctcagcctcccgagtagctgggattacagggataagccaccacacctggcccaaattgtctatttttaaaagcatttaataagtatgaacttggcgtgcatatttcattaaataatataatatctaatgcagtttctccttctttcctataatgaacatcatcctggaatgaagggaatatagttattttctgcaggacttgaaattttactcactccatcctatctacaaaattaaaaaagttgaactagatttaacattagaaacattcttcttgttgtgcagctaacatttggtgggggcataacagaggaagggtagagcttctctctcatctttgaggaaatgatactactgatttagtttgctcacaatgttcttgtgacactgagaaaccaatataaacatcatggcaagacaaaggatattccctagcacgtggcaagatatgagccatcaaggaagaatacaacccaagcctttctctccactccagagcagagtctttttctcccaagatcatttcacatactattccggaagataaaatatttaaatccagcatcctaaaagggataagctaagactgtcacttctgcttcatgaagatgacttagagtttatgccaaccaaccagaagccttggcgacttctctggaactaatcaccttagccttatctccacttggtctcaggaataaatagcagcagtgtgatttgccagcacaccaaggtcacttaagaagtctcacacataggtggtttcagaaacaggctcttccacaggggcccagagatgaacctccatggctccagggaaaagctagtcatgcttcagtctgcaggaaacagtgtataacagataattcagacaggctgcagtaagcctagcaactcggatccctctgctgtgaggataggctgtgaccttctcattttgcctgctctcacccaggcttgaaagcaagcagtaattcttcttattattagccttaattgtgctgttatgattggcctgagaatcaaagccctggctgagtacatatggggagcatcagcagagccttagaaaatgatcttggggactgggtggccaggggaagaaataaaaccctgagcccatcaaggaaggatacggccagctctgttccaatgtctgtagtccagatactgtagaagggattcgtgagttgtacccctctacaaagaaaatgagatggaaaggcaagacacaattaatacaaaggcaacgggaactttccttttcacatattcttagcttttcagctgcaggggtgagggctgtatttaggctaaaaaacattacagaaatcctaaagagaaatgaagcttgtagaatacatcggcccaaatatttttcaactgtaaagagctgtgcctttgatttgatcccagaccttgtctgaggatgtgaccacgtccagtgcttccaaaccaaaggttcccgaccaccattctccttttcaaacactcctcctaaaatgacaggagtgggcgtggtgatgcacagtttggctcagtgtcccacaaacacttgctcacctctcacacatgtcaaatatgaagaggcagaaggagccaacggcaatgggtccgacttgcttccaataccctgcgatgtggttccgctcgtgctgatcctgaggaaaaccaaattgagaagggagatagaggggagaggaagaccaagcaattctatgggggagtcagcattcgaaggacacttgccgaccacctattgtgtatcaagcactatgctagattctaggtatgagaacaaagaagatgaaaatctcttcttcaggagctcatctctgtgggggagtctggcacatacgtagaacatgacaaagcccagccataagggctctgagagtaataagaacaggatgccatgggaacacaaagaaaggcctcggctcccaggcaggggacattttgtggtccacaaaataactcattctgaattaaatttctacgtgacttgtaacttgtgtttataaaagtgactgatcctcagaagacaaagtaaagacattaaagcatttaaatatgtaaagtgtgtctattatggtgaggaaaataggcatattttctccccatccttattaaaaccaggaatgagtccccttgataaacaaagacaccaagagaaagaaaaggaaggaatgtagaatgagaaaaaagggaaagcaaagatgatcttagcctccaggtggggccccaggtgggtcagtccacaccagctccctgcggacaatccttggctggcttcctggtgctggaccaagttccatccactcccccgccctgctgctgaggcctcattctcagcgcatctctgctggaggacacctcatggagaaagaccccttaatgtagacagtttagcagtaggaagaagtctctctctctgctctcacactgctctcctggaagggcagcaggacttgagaggtctggttttcatgattgagccataatggaatttaaaaacagtccactctgctgtgaagcccatgtgcctgacgtgaagaccaagttccagctggcatatcatcttagccacaatgtgatgatgacaccattcttatttttaaccatggtaccttcaatccctcttgaaatatgatttggtgtctgtgcaaactgaggagaccgggaaggtctgtatttcagagtaataggggttactaggccacctggacacattgccagctggaaagagccaggcccacattctctgatggttaacctgtattcctggggacaggacaagcagggcagaagccagcagacaagaaactcaagctcaagggcaagaaataatactaatcattagaatgtgtgtgtttatcttaagttactcacattctgtcatttaattctcatgaaaaccccatgcagtaggtctttacatcccattttatagatgagggacccgagattcagagtgataatgtcatttgcctaaagccactcagctggtcagcaggtggtgaagcaggaatgtgaaccagagggtctgcctccagagttcccacttgtaactactagtttattctgtctcacccactgctgactagaggcaaaggggggcaggtgtcagcttggcagcctgcacagagcagctggtacagacgtctgtccctcccggcggctcttaccatcatgtgctcgccacagaagatgatccagaaggacagaagcatcgcatagaagatgccctgtcggatgtcaccaaacagcagcatccaggtccagtcaaacccgatggaaaaccattccactgggatattgataaaggtcatggaaatcccaagggcaaagatgactctgatggtgagaaaatatcaggacagccactttattcatctggaaggcagattttcaaacaattccccgaattcagttttgagacatgagatgttacttattgggtctgaagccatatgatcaatttcttctgcacagagatgcaaaacgtcctatgtagttggcactgctgcagaatgagggagtgctataccaacctttctatggaagtgaacctgacctccttaatgcctcacactttactttggtaccactgcagatggcagtcttcctataatgtttgtgtccccttgccttctcacccaggcctcagtgagtacaattgtcctctttcacctattcaggttatcattcatctgatcattaagaacactcattattattgtgatatcctcagcaactatgaattatataagcatatttgtttcaataatacatgactccaaacacatttgaaatgtaaattctcttgactgcttgtttagcttttattttactcttcccctgtcacactaagaactgccaattctctactaaaatataattcttaagtcactgatttattcatacttttttccatccccttgaaacacatatgttaattaagcacagatcatgtaccaggtattgtgttagcactatggaatcctaaatgaacaggacctgttttttcactcacgggagatacagttagtagaggagccagataaagagacaactgaatagattaggatcaggaacatcatagagttttaaagcatagagggctgctaccaggacttctgactttgacacagacaggaatggagctgacttgtgagtcaaagtgagggaagtggaaagggtgtttggaggagagggcagagcctggatggaggcatagaggcctggaagaacctgctgcatttggggatctgcatgtggcacatcaggaaatgacaggacatgagaccagagaaacaaagagggctgtgctcatgaagaaacttgcataccccactggagaactgaaatttatcttgaagagactttttattggaatccaataaaaagtttaaacaatggagtgacatgattcattcaaaaaatatttattaaactcctactatgtgtcagtcactattctaagatgctgggaatataactgtgaacaagaaaagcaaggattgtgctcttgtgatgcttgcatagagatggaatgagagagggagtacaagaaaaagataataaatgaagaatgagcatcatgaaaaaaaaagctaggcaagagagtggagagcaatggggatgtgattttacgtaaggtggacagacgaagagatcagcaggtgtgaaggccctggggtgtgggtttgagcacaataaagggggctggtgggtggtggagaggacaagtgacaagatcagaggtggaaggcacccaatcatcaaggggcttataggtcagggcaaaggagatgaaaagccagtggagagctttgagcagaggggtgacaggatctgattaacacttgaaagggggcactcctggctatcctgtgaataggctgcagggaggcacgtgatggaagcaaggaaaggggttgcgaggctgttcccactgatccaggtgagaagcgatggttggttagttagattagggtggcagcagtggaattggtgagatttcctggtgaggttgatgagaagtgtgaaaaacagagacatacaggatgactcactgctacatttccagtctgaacaactgaaaggatggagttgccttttactgaaatggggatcctgggagggaataggttggaaatgggacacaatcaagtgttgttcttggtacatgtgacattttcaatgcaaatgaagacattaagtaaagagctggaatatttgggtccagagttgggagaggctgaggctaaagatacagattaagagtcatcagagaatagatgatttttcagaccacaaaggtaggtgaaatcaacccccctagggaaagcacagctaataaagagaagaggtccaaagcaggtgccccagtcccaaagtctaagagtctggaaagatggaaggagacaggaatggaatctaaatgctggtcagcaaagaagaatgaccaacagaagggtagaggagactctgggaagaaaaactgatcaattatgtcagatgctgggatgaataaaaaaaaagtgaggaacaaaaaatgacctttggatttggactatgaaggttgttggtgatcccgtgaaaagcagttttagtagagtggtggagatgaatccagactggaaaggactcaagagagaacagaggagaagacatatgcacaaggtttttgagaagcattgctgtaaagaggagcagaaaaagggtatgtggcttcagggggaagtgggaaatgggagaattttgtctaagaatgggagatggcaggacatgtttgtatattaatagaatccagcagaaagggagaagtcaatgatgtggagagaaagtaggtacatctacaggagcactgtctttctgtaagtgagaggagctgggcttaggggagtttcttcactacaacacagacaagtatctgattctgaccacggaatatcccgaagagcaaagacaggttaaagaaccagaaaggtcagctgggtgtggtggctcacacctgtaatcccagcactttgggaagctgaagcgggcaaatcacttgagctcaggatttcgagatcagcctgggcaacatagggaaaccctgtctctacaaaaaatacaaaaaactagctgggaagcatacacctgtggttctagctaccgggaggctgaggtgggatgaccactggagcctggaaagtcaaggctgcagcaagctgagatcccagcactgcactccagcctggacaacagagtgagaccttgtctccaaaaaataaattaattaattaaaaagagccagaaaggtgagagaggtagaaccccgaggatttacttaataacaacttgcataggaaaactgcaggagaaaaaggagtccaggatgactcctggtcaaatcactggcctaagtcacacactggctgcttgaactggacaccagcaaaagcaagagcttggcagatcatgagaagccagtattcctgaagagcgctccaaaaccagctcttacttttccagaagcactgggggtcgggacatcatggtgatcctcctccaataccacaccataatgatgaagatgctgggcgtaaggaaggtcttcatggcaaaccacaccttggtgaagcctccattttggtggatcccctaggcagagaccagtgataattttgaaggtgaatattatcttagcatttccttctactagcaaatgcttttgtgggagaggtaagtggagacctcgtctgcgaatgttcacgatcaagagctttcacattcatagcaggtactgccctcatacacccttggactctcctcagagataatagaaatacatattaaaagagccctgtgctatggacctgagaccagagaaataaagagggcatcccattcacaataacggctttcatgttctggggtctgaaagaagaacatggggctttggggcagggtcactatttccaagagacttcgaattatcttaccttggactcatcccactgatattaaaatgctaatacctaaagatacactttagaggtacggattaatagggcaggtatggattaatagggcatacagggtgtatgatatctacccagctaccacccccacagtgtaccccccaaaaaagccacatttgaggtagaaccagaaatttcaggtaaaaagcagagatatcctctatctcttaacacctctcttggccgtttaatcctcattctaccctcacatcttactaatctggtctactaaggctacaagagctttttccctatgctaagattacgattaagtacatgatcaattttttttgtaagcttttcattagaaagttgcagatatcctagatggtcaatatgttgagattggtaagtgttaaggtaaatctattctataaaatgctaatcaatattggaaagtatatttatattacattcaccaatttatattacatataccattaaataaagaaagcaaggaaaacagtcagttcaatatgatcctactttttgtaagggaattactacgtataaaaaaaagcctggaaggagatatatcaaaacctgaacagtgattatttctctaaatagtaggacattacaggtaattattatgcttttctgtgtctctacacaattcttgtgggactttgttgagattgaaaagaaatggcctccttgcagcaagttctaacttttccccaattaaacaaatatgatggaaagaacctaaaccacccctattccttttaacatttgtgcttgcaaggtgaaacacataaaaaagaaaatttacttttatctcagtgttattcattatgcaatcatgactatttcatgatcttatcatcattgtaatgatcttaagtgatcttaagcccatttaaaatcttaagtgggcacaataattgcattgtttcccatttctgtaatctctcacacaaattagttcactttatgatctcagccatcatgagtatgttattattcccatttctcagatgagacaggtgaggcatagaggtgccaagagtgagatggagttcccctccaatacacatgtcaagatcaattacattcacttaccaccaaccggatatcctttatctccccaattcccacattgattttcttcttctcattcacaggcagccggatgtttaaaaggtaaaacttatgggccacagacccaatttccatgaaaggaaggacatcacattcatagtaacggccctcatgctctggagtctggaaaaagagcagagggtttgaggcagggtcactatttccaatagactggctctgaattctgttaccctggatccataacatcaattgtaagcagctaatgcttaaaggtacactttagacgtacagagtaacaatgcatactggaggcatggcgtctacccagctatcccaacctaaaacaaacatcaacaacaacaacaacaaaaaacagctgtattcaaggtagaaccagaaattttaggtagaaagcagagataccttccttctatctcctaacacctttctaggctgtttaatcttcattagaacctcgcatcttacgaatcttgtctgccagggctacaagagtttttatctgcagtgtgttgtcagggtcctctaaggctctgtggaacagtcagcttcttaaacgttcaggtggaagctcttgctgaatcattacactctttaatgacggctaattattctcctgattttggcctgagggagaagctagaagaagctgaaaatatcttctttttattcacttgccaggaaaaaaaaagacacaaggagccgttggtatttagggaaggtcgaaacagaagaaagaaagataataagattagtggccagagatacccactaagaattttctgcctccggtgcttcctaacagtccaagatggcagaagggaatagaagttttaatgaaataagaatttagcccagtgtctaggaaagcctcttggacttcgtgccaaacaatttaagagatactgcccagagcacggtggtgggaaattggacagtagggagacaccttttttttgaaaactaaattctgctccacctcaccaggactcccggctgtgtacctgctgaggggtgggggccaggggtaaagatgagcataaagaggcatgagcttcagcaggccgggacttttccctgatatagaagatgagagtctaccatcaatgttgggtttctatgtcagcttcaatgtttccttggcacctcctgatcaagtgataggggagatctaatttgtcgttcctaagcctgaatttgcaagacctccataatttgtcataaatcttcagagcaaagatccactgaagaagtgagaagaaagaagataacaaagagtccatagtctaagagtatgtaggaaggggctaggaaggggctctgccccttctgagatcttggctggtggggagggttccttactgaacagtcagagcttagaatgcagtaaacagacctttgtacagagacagagacacacacggcaaggtagaggtggggaggtgcttctacctcctcttgcccaccacggcacacataaccaatcagtcgtcaacagtttttatccctaaggtgtgagcagctcttgtcagacacaccagttgattagagttggcatgtgagatttttaaaaattcttctgtagaaagaatgctgctttttcaaacctcagctgcaggtcagatgattcttcctatatagatcatctttctctcccctccactcctttctctcttatactttcaaatcagggaggatgggggctctgcaggtactactaaaagttcactgcaggctctaattctccctcagattaagctgcagtgaggaggctgattatcctctgtggtaacagcaagagggtattttctgatttgtttccagttagggccttattttattgatggaaattgagaacttgagggcggaagggaacaaaacctacttagtctaattccatctggtgtgtgtctcgcccagggtcccaaaagtagtagcagaattgggagaaggacatgggccctgcccaaaggcaggcattgtgctgtgataaagactcctgaactccaggccaggaggctgattctagtcctgaccatgttccttgctgggtaccttgggtcaccctgcctcatttggcctcagtttcctcctaagtgagaaagttaagtaagatgatctccagggtcacttctaatcccccacgatgggtctctgggtgccccacacttccctgtcactactgagtgagtaacatggacacccttgacacaaatttacctaagttcaaattaaaagagacacattggcatctgggacactggctcaaccttcctgtctcagagacaagttcgttgtatcctgttagagacttttcttcatgcactaaagtcctgcctctgccagtatttagggcatttaagaagattcctctctctccttcctttgccccacccccagttctcccccaactccagcatgagactagctcattaggacaaattacagcaggtggcaacttgacttttttttttttaacttcacaatccaccagggactcaaaagctttaaagcaatttctcatttaatcttgagactcaagactaaatttcactgcaatcaaaaagcagagacttgatgattcatttccttcgcacttttcaagatttaatatctttcttgcaagggatcaacacatcctaaagataattaagcattaagaagcagttgcaggcaaacacccttccccctcgctactcagtgccctccatgtgtataaatgagaaatgacttttcccttttctatggataaaattctgtatccgaaagccatctagcttagatgttcaaccagtatttcaaagatgcagtcaacttgcagagatagctagaaaggtttttaattttcttggttgcatgcaaagatctgaaaatgttagctgttcctctctcctgcttcctctagtttgtctatcattcatttctacctacaaatggctttctctggaggacagccctatatttagcactcagcagagggtctagggcagtggctctcaaacttcatagagtttaataaactgaaggcctgttaaaacacagattccttgctcctacaccctgagacattgacttaataggttctgggtgtgccctgggaatctgcctttcctaaaacctctcaggtgatgctgccactgttggttctcagaacacattttctgtagctttgttctaggaaacctgcgggagggagactcccctagtgtttcaaaaaacactgcaatgggtacttaggtttacccatggagggccttagtttatatgttttctcctagtggcccatctggttaatatccgctttgactctcaaatatgtcccagacaagatgttaaattagaaggtcatcctgcctacgtcattgtatcatctagtccaggggtgtccaatcttttggcttctctgggccaaaccggaaggaggagaattgtcttgagccacacataaaatacactaataatagctgatgagctaaaaaaaaaaaaaatcacaaaaagaaattataatgttttaagaaagtaatgaatttacattgggccacattcaaagccgtcctgggctgcatgcggcccgcaggcagagttggacaagcttgatctagcccttaaacagactcccaaggtaggtactcttatctcatcttgcagaagaaaaactgaagctcagacagattatgtaagcttacctgaggtcacaccgtcagtgataaaaccacctaatctttctcctctttaggaaaaaaatggctaaagctggggcaaggtactcagaggcttcaacctcatgtttttactattttgcaggaaatcttaacagtaataggcaaaagcaaagttaggaaaggcccgtggcaggagagaagaggaaataaaatgctccgcagagcaggtattaccaaagctgtcctcatgcgaagaagggacacacctatgaaaagtaagcaaatctttccacatacctgagaaccaaataaaaactgtcagcttagacagcaaggggtcataccttgggagatgtgaaggtgcatttgagtttccgtggtactctttcatgggccatttcagtccactcagcaaacgcgtcatcacggtaagccagggaaacgtccatggagacttctgcattttctcctgcaagagaaaggatgcacgtttcagaaatgacttttggaaagatattttagaaacagctcaaaaaattcttataggctttgacttggaaaccaacgagacaaaagggaaatattaatttctatcaaactccaaacctgaagacttagaagtcataggatgaaagtctaagccaaatgctgggtcccctctcatgtccactctgccagagtcaagagcctccatttaaactcttccagagacaggggcctcactctctctgagggagcacaaatggtcagacctcatcctcccataacttgtaccatgggtcctaggtctgcctgtagaagccacgtggaaggtgatgtccttccttcttccataaaaagtgccttatgttcttgaaaaccataccacatctgcctgcattctctttcctctctgataaacatgaccaagtttttcaaccacctctcagacacgtccctctggggctcttctctggtcacactctgtctgaaaacatccttctcaaacttattcccgaaagttctcaaatataggatttgctacttttccaaaagtcaaaatcccttcatattgtggatgaagttaatgtaaaaggcaaagtgtttttccaaaattaaagacttatacacagataggaataatacataattgcacaaatgaatgttcacacatacttccatatgtgtggactggaccacgaatgagttaaactcaccacagaactcattaaggagatgagattaataaaacattgcacctattaattttgtctgttttatactatgatgagcaagttcaagagcagagaagtcttttttttttttttttttttttgagtataaaggtttaattctatttaaaaagaaagtccattaaatcaacttcaagttcttaactcatgggactattttggaacacttctttgtaaatatcattttgttaggttattggcaaaacagtttcaaggttcacttccctcccttgaaccaggtccaggtcattttgctttggggtaaattaaaatcagaattctaaaagttgagcaactttgtttttttttaattgacttagctctaacccaccattacaacttaaggacggcatgacttgataatgatggacttgtgtgaggttttgagttttcaattaaactttgtatcacatgaggtaattgtcagcattcttgagtctggttatggaataggcagatagaaccctgtagtaacaagagttggaaattggctaattgacaacgcacttgccttaaacatctcaagtagagaacttttacattagtgagatgtacttgaatttcagaactcaacaaattttaattactttttactgaaaactgcagtgaatgctaaatgtctacgtttacaataaacaaatacagtaacagtaactcacactgaaacaaaacatacttctgatagccattatttttctgcttgggacaattttaaagtttttcttttgtcacaaaaacaggaatgtatccaaacaaaggctcaaaagaggccatcttttcaaacaaaaaggcaatgattcacaaaagactgtgaatagaacatgtaactagttgatacaaatctaataggatttgttaaaatcagtcacatctaatacatctgaagtgctcttgtataaaatatcacgtgaagaaaagaagactttatcaatgtctaaaaaagtgggtttgttcatagacaatctgacaagttaccataaaaagtgtttcctgagacataaggaaatgcaacattattcttcttgaaccgttttagctcaactttccactcaataaaacagcagaggatctgaaactgagaaaatgtatttgagtacaaacagcttgtgaaagttaatactttttttttgcatcagagggtttttactgaacttacaaccaacttgcccactcagtatgcagttcagatgtgagagatgcttctctgtacaggagcctgtactgtcttcaatcctatgcgagcaagtgtctaccacaggcaaacagttttctccccattttgtagtaatgtaattttcctattagcaaaaggaggtcaccagcccctgtagacttaagggactcaagtcacaggatggggatatcctcttaatattttttattttgttgtttgaactcttgatgcaacattgtagagcagggtgttcaggacctgctgtgcccaagggactgataaaggaaaaagctctatttattctttgtgatttgatgcacagatgaaaaacttaacacacaataacagaagttggtcgttaataaatcacatcctagtctttcagcgcttccgtaagcagacgacatcttcagttttctagctcttgtagttttaacactgcagcatcaatgatgcataagtccagaatcagttacaaagaccatcatattctttttctcttagttcatcatttttcactatctcttggtcccaaatgtatctgaatgattaccttccggcattctctgctattgctcgttggagtgctctcgattgtccccgtgttttgtgggctggttgggagagggcgcctgggaaggatgtgccactgttgggaggttgtgagtcactgggatgcctccagggatgatcccttccacggctgcaggaagtcctcctggagccacgcccacgatgcctggcggatatctgtatgtggcaccattgagctcaggatgaattgcttgctggtctattactgaccaaggcgctgatgtgacagagaattccttgttcacacagtttcttaagctttctgggatgtgacctgtgatggctcggcggatctcagtggcagctgcctccctcatctccagtgacgcctgcttgctgtaccaggcagtgtgaggagtgcagataagattcggtgcatctttcaacggaccctgagcaaagctaaagggctccgactcacgcacatagagggctgcccctcgtatcctgccctccttgagagcttgtgctaaggctttctcgtccaccaggccaccacggggtgcgttcacaaggaatgctccctgcctcatctgctttatggtaaagtcattgatgaggtggtggttatgttcgttgagattgcagtgcaaggagacgcagtcgctctgatacagcaaatcctacagagtgtagaccctctgcacgcccagggatcgctcgatcccatcctgcaagtaggggtcataaaatatgacgctgaatccaaaggccttggctcgaactgcaaccgcctaccccctgcgatcaaagccgatgaggcccagcatttccccacggatgctggccgatcccgaggccaactcgcggttctgctccatgctctgaacccgtgtgccttaccgcagtgcttggtacagccatgtgttcctctggtacagattgaggatgtggcagatggtagagtccggtgtctcttccacggctgcagacgggatattgcacacagcaattccgagctcgctggcagccttgatgtccacgttatcgtagccactgcctatctgcacgatcactctcggggccttaaacttttctaggtcctccctggtgaggatgatggtgtggtacatcatggtacccatggcttcgttagaaccttctcgtggatttcctgcgtggactgcgcgtcacagaaggccacagtggccaggtctttcaggatgggcatctccacagtgcagtcgcggccgtccagcagcgccaccagggggcaggagtgcagggggccgttcatgatctgggggcggataccttcacaaattctgtccaattgctgtctcttgactttgtgcttatccacaagggccatactttatggaactttgcaactctcagatcaaaaggcaaagcagtcctctaagaacttaggggaactcgcaggagtctccgtgcatgacgccactatgaacccactataaatctgtacacactataaatctgtacactataaatctatagttcacacgatgggctgtccgtctttttaagggaatacagcttcattggttcaaaaccatttaaggtgatgaaaccctcgtcccggacggtcagcgtccacggcaaaaggcgcccactctggaggccgcggtggcggtggctcccgcccctcccaccccaccctgcggcggtggcggtggcggtggctgcagctgtgcagcctcccctcagcgcagcatggctcccttttcggtccctcgctcctccgggccgctcccgagccaccttaaaatgacgctcgcacacagggacacacaacacaaaaacttaatctctccagctccccaccactccccctccctccctccgctaccccgctctccccaccctacccctccagagaagtcttaatgaggaaaaaaaaaaaaaaagcacaaatcacatttccaaaatgactggagatcctgccaccactagggttatgaaaatgggcacaattttaggctctggctattcagccttgaagaagtctcagtatccaggcacctgagtttgctccatacccacctcctccagggctgcgacaaggattaaaagtcaagttagtgaaagcactgcatgctgcctcatatgcagtaggtgcttaataaatgtttactaaacctgaacacatacaaatcacaagggaaacagataggaataactgccctctgaaaagcagggcttttctacggtggcttaaagctgacatggcagcatggcagatccctggttctcagaagaaatctcggaaaaggaagagatgatccatggaagaaggaatttgaggccattctgatatagaggaaaccctcgatgaacatcagtacccactattctattattcctatttttatcctcagttaaacatagtgaattagccactgtgttttcctcctgaaattccacaaaataaagacaaagacagtaaaaagaaaagcaaaagatattaaatcacaaggggaaaaaactaactgtagacacatgagcagacaagagatttcatttttttttttttaagacagagttttgctcttgttacccaggctggagtgcaatggcatgatctcggctcactgcaacctctgcctcccgggttcaagcaattctcctgcctcagcctcctgagtagctgggattacaggcgtgcaccaccatgcctggctaattttgtatttttagcagagtcagggtttatccatggtggtcaggctggtcttgaactcctgacctcaggtgatccgcctgcctcagcttcccaaagtgttgggatcacaggcgtgaaccactgtgcctggcctcaaaatttttttaaaacataaaaaatacatgaagtagggtttcctggcagccacagcctacactcctatagaggggatattctagaaaagtgagccaacatatctgcaggaacctgaagccactcagaatttgaaagtaccaggggttgcagaaggcagaacaaagcatggcactgacaatggggtgactgggtcaaagtctgcacacaaaactgctggacctcagttctcccacatcttcccatctgtgcaagatccaaggagagactctggacttgaggacaccaggggaatatgtagacccagggctggaggtggagaagagcaagagtctgtagaagaaactgtgccactcccagcttggcagaaacaatgttcagagttggtatctccccttggtcagggaccaagctggctacaacttctccccacttagtagcctcagtggtcaacagaaagaatcagtcagagctcccatggagtcaaatcttaggcaataaagtacatcctacttataacgctgggagtaggaattgggactttaaactgtgttgaaaagggtgcttggagaaacacaagagtataaatatgaaaagctgtaaaaaatgtcatcagctcacacacaggttacaaattactcacaggttgttctccttggagccatagggttcagagcaacactagccttagacacaggcaagaggggcctttgaagtttgggccccacacttttaaagggtcccacacttttaaagggtcccactctgtcaactgttcccttctttataggacaagaagactcccaagtgaaggggatatatatacccagagcctacagaccccctcacttctagaccacgctccgagatgtcagactccagaacattctgcctagacagctctgaactcttatcttacttccaaggtctgtgtggcctctttccaggtctggcttcccaagaagaactagacaaccacctgtatactcttggatgttcggtgggggtgggagtgaaaaggctgctatttgttggaagatatgaacagagcttgagctcggaggttagggtgtccatgtagaagcacgcaaggcccctctctttatgggatggagccagcggtggggagaaaaggggtgtaggggcccacacttcctgaccagtcacattttggcacagaattccaagtcgtccatgagtcctcaattcgaacctggccatcctgttcattatgcaagtaactcatcatcagaggatgcaacgtacttggcttaacagtttgctggcctgatttatcacttctaaatatttagacacatgataggcatgccttcattcatactgtttccccaagccagacaaatgtttgtagtgggcctggttcagagcaggtgcctcacagagacaaggctagataggattgcttccttgcctggtcccagcttcaaaagttattctaatctgttgaggatcctcaaaggaaaaactattttaaaatatgcggtttaaaatgaaaattgtgcacagtattttaatgtacaattactccatgttaagctcctgtggtttctgtgctttaaattacctcatttaatgttcccaacaattccatgaagtggacagaatattttattttaattaatgagtaaagtgatgccctcagatcttaaggaacttgtataaagtcattgaaattgccttaaaataaaatcacttttttggtattgcttaaagaaaactggctaacttgtgatagaagaagcccctcaaagcagtcacacaatatgaatatgctaagtctttaataatagcaacagctctccttcatcagaggctaacatgcaccagccttcttcaggcctcacatccatcctgggaggaagacgttatataaattgcccaagaacatatggctagtaaacagcagagctcaagtctggatcacgtaagggccccactgcactctactacctttgctggtgaaaacaaacaaacacagtagaattcaaaagaagctaacagctgaatcaagcatacttggtcaaagagccactcaacacaaactaaatacctttccagctttctacaggagagaaacaggcaatgttcctgggaggctgcaagtatggctcataagaatgtctggaattatctaatctaagctttctaaagccatctattgttggctgttaaaattatagcatgttctgccgtctcttcacgttaccatctccttacttcccgtgcaatctgaagcagaggtgttattcctgtttatgaggtgaagacgccataactcagaaagccctaccctagaaataccagactcaggaccctagagcttcatagccaatagtctcatagcatcctgccatcttttatgatgtacataaaaaaatagaaatcacagggagaatggcctgttcaagtgacctttactagactgtgatatcactcctcacccccagacagatagcacacatgaggtagcacaggtcaatcttagcagacctggttccttacctgttaggataagacttaacgcctagaatttcatgattattacactagttactgcatgaaaaatgctcaagacagagcagaaagcatgaagggtaaggtattgttgttgacattttattagggaagtgaaactcttatccttaattcaaaataattaccaggtttcaggaacatggagcttcccactatgaatccctaatccaaacctagatcacaaaacccagaaacgggaaagcactggacagaggaatacagtaaaactgcgaagctggttacctgaattgttttctcttctgcctccagtggacttggaaataaagttcagcattaatgatgatgttgcatttaataaaacactggtttcatgactcctgggatactgtgtgggcaatacttcccctccaccctccagagataatgaaggcgaggaatccaatttgaactccctgggagaatggcaggaaggctaagctacatttggcactatattagaactttccctataaaacaaggacactggttatatcagtttcatgggggtacagttgtaaggtatcagcatagggcatttatagatttgaaatccatggttttccatacctatactataccagcagctttggtatagaagcccataggtcctatgggctagccaagcttcacatttctcaaatagctttggagacatattttagttgggtggagaattcattcagaggaggaagggaagtgtggaaaggcactgtcgttcgttacacttactatttccatcctgttatgggggcagtttcccctatgctccagggttccataggagcagacctagactgcaaagtgtggttacagacagaaagatccatgcctttccatgttgggaagcatcaactaattgtatccttaggaagtctgtctctataccagttatactgccctgccctgcttgagaaaagcaaagccaatcagtttttctgcaggcaagtggaaagtcagagaggagggcaagtaccttctataagccagaaatggtgggaggggggtgctagaaatcgctaggaaagaggtctagtgtccccaagaaatctagggcagctgcttaatgtaagaatggtccctggggtgggaatgtggggagaaggaaaagcaatgaaaaggccactagagccttaattgaggaagacatcagaatgcttgtcacctaagctctacaccttctatatttgaaacaggtatttcccagccaggatagtacaaagtgtataaattgggcaccaaatggatgtgattttgaattctccttttatgacttcccacctgaacaaccttgaataagtctcagtttccacctttgcagtatggaaacagtgggaactactccctaagtctgttaaccaataccagttccttctccatctagtcccagggtggctgggttatattgttgacctattaactggaataaaaggggaaaaaggagaggacaagatatattagaggaaatcaggaatgattttatggttgtcaaaagcttttaggttcctagagacactttgactttcctgggcctttgccctgggaaaaaaattaaagaggtttcaatgctcgtgtgcattcccacattacataggggagctgccagtcaccagagtttgtttgggtaacctcagaaagaggccacagagacaaatctcctcccagcctctggcagacatataatctggagttatttatgccagcattccttccccaataaaaaactctctgacctggcttgaatttttcttgacgctttcaattaaggaaataacaaaaccaaccctgtcttatacatggttaggtctggcaaaaatggactcagctaattacaaatttggccctggcggttttcttaagatgccctacaggcctgggtgtgagtggttataaaaatgaatgagtacaattattttgcaaaccagcctaacagtttagttcacattgcttctcgtctttcctcatcaaatcaagcatttgaattgcagagaattatcttccacatgtaagaaaacatatttctaagcattgcaaaactggttccttgctgtattctgatgcattatcatctggttgaagtcacatatctgtctatggaacatgacaaggacaagggagaacggtgctcacattaggttctcttcaaagtgacatgcagttagaaaacatccacttacccctattgtagccaaggctactagtacttaaatgctataccactgaaaaagtaagtggagacatcaatttttttaaataaatgaatctgaagtaccaccgaatatagaaaaaaaccatatctattgttcaccaggttggagagtagctctttcctcatctaactcaacacgttcaccctgaaggatttcatctgctcctgggatgcaagtcaccctctccagtccagatttccctcttgatatttgaatttgcatgctcacttttcaccagtctctcctctttcatggtttagaaatgcaaaccaccaaatttggtcaactctactaggtgtctttcagatttagcctcctctcctcactgatatgccgcttgttcaggccaccattatctccagcctccatgactaaaacacctgccctgttcctgtctaattttcacacttcctgctacagaaatgatttctaaaacactttcaatgcctttatattgtcttcagtgtgatattaagactccttaaatggcataattggctaaggtgttatgtagcagcctaggttctagttctatgaacgttcactaccccttctacctaggttggccacttcaaatacagcccctctcctctccagccttggaagatgagtaagagctcagctttggagacagacaggctgggaccacagcccaccttagctacttggtgcctatgcaatgttgggagtcactaaatgtctctatctgtaagatgaggataatggtaatggtaatgcccttctcctatcactgtgaggagtaaatgagataatgggtgccaagcactcagcacaggcctggcatatagtaagcactcagtcaatgctggctactatttcttttttttttttttttttttttgagatggagtttcgctcttcttgcccaggctggagtgcaatggcacgatctccgctcactgcaaccttcgcctcctgggttcaagcgattctcctgcctcagcctcctgagtaactgggattacatgcatgggccaccatgcctggctaatttttttgtatttttagtagagacggggtttctccatgttggtcaggctggtcttgaactcccaacctcaggtgatccacccgcctcggactcccaaagtgttgggattacaggtgtgagccaccgcgctcggccgctggctgctatttcaaggctagtactcaaggttatctacacctgctgtactcagggtccccataatcacaccaaattttatgaagagatgcctcctttgagagggtaaattacaaaaggcttctttatctgggctgcagacagtgcttggcatccccgctcgtgccagactcctactcatcttctggaattccccccagatttactcttgccttcttttactcacccaaactcaatatggcaccccccccttgctcccacagtaccttgttcacccagcaatatgacacttatgacacttattctccatgttgcttctcctgactacttatccccatctctctccctacccatctcctatttaggctgggttcctaaaagccagggactgactcagtcttgttcacagttatatcactcatgtctttgcacaatagatattcattgaatatttaccaaattaatgattatcatccttctttctccaaataactcttacaaacctaaatttcctgtcactctaccatcaaacaagtggtttgctctatattttggtgacattcatactttctttctccatcacctgcctttttacttctactccccccaaacccctgcacacacacccctgaaatccctgtgctagatggaccatccaactctatttttgtttccaccaaatatttttgagcacctactggtgtcctcgcacaagattggatgtaaagcctaaaaccataaaaaccctagaagacaacctaggcaataccattcaggacataggcatgggcaaagacttcatgactaaaacaccaaaagcaatggcaacaaaagccaaaattgacaaatgggatctaattaaactaaacagcttctgcacagcaaaagaaactatcatcagagtaaataggcaactacagaatgggagaaaatttttgcagtctatccatctggcaaagggctaatatccagaatctacaaggaatttaaatttacaagaaaaaaaaacaaaaaaccccatcaaaaagtgggtgaaggatatgaacagccacttcgcaaaagaagattctaatgcagccaacaaacgtgaaaaaaagctcatcatcactggtcatcagagaaatgcaaatcaaaaccacaatgagataccatctcatgccagttagaatggcgatcattgaaaagtcaggagacaacagatgctggagaggatgtggagaaataggaacacttttacactgttggtaagagtgtaaattagttcaaccattgtggaagacagtgtggcgattcctcaaggatctagaaccagaaataccatttgaactagtaatcccattactgggtatatacccaaaggattataaatcattctactataaagacacatgcacacgtatgtttattgtggcactattcacaatagcaaagacttggaaccaactcaaatgcccagcaatgatagactggataaagaaaatgtgccacatatacaccatggaatactatgcagccataacaaaggatgagttcatgtcctttgtagggacatggatgaagctggaaaccatcattctcagcaaactaacacaggaacagaaaaccaaacaccacatgttctcactcataagtgggagttgaacaatgagaacacatggacacagggaggggaacatcacacctgggcctgttgaggggtggggggatgggggagggatagtattaggagaaatacctaatgtagatgacgggttgatgggtacagcaaaccaccatggcacatgtatacctatgtaacaaacctgcacattctgcacatgtatcccagaacttaaagtataattaaaaaaaaaaaatactcagagaagttccaaatgctgtatataaataaatacaaatcttatatagaaataggatttggaactatatacatgtatataaacataaaaatgtatgtttatatatgtctataaagagtgaaacaattaaacttcttctataaaaaaaagagtagggataaaaaggcatataaggcaaagtcattgccctcaaattgtttacagtaaagtggtgaaggcaggtatataaataagtataattccatgtagtttgtactgcattagaagtatatatgaagtatacagtcagcacaaaaagatcaagagttctgagtagaaggtcaagaattgtagcacagaagacacaatcttctggctcaccctactgagaagaggtgatatttaccaatgaattgcagaataggagttcactaggcagcgagataggaaaaggcattacaggcagaggaagccccatgtataaaaagtcacataagcacaaaatagcagggaaagcaactaattcaatatggcagggaatgtgagagggactggagggaacagggaaggctagagaacaggaagggtctaatgacaaagggaagaagcttgccctgagtgctgcagcattttgcttagaggatgttaaagcaaaggaggagattctggcagctgtgcggaagacggactgggatggggggccaggtagacaaagagacatcctaaggaaactgaggcccactgctaacacagttctcagtgtgcttaagacgatttaaccttgtggaaaatactgccaggaggatattttctaaggaatttgtttaccaaagaatctgaacccaatgatgaaccaatctttcgctaacaaagctagagaactcagaaccatctaagttagcaagtgttaaaacactggaaagcaaatgtggcaacagcactttcctatttgaccataatcaacatcaatgtggaaagaaaacaaacctgaaagcaagtgaggaaaacacacagtgggtttctttgctttctctccaggacactgtcagtacacagagcatttagaatagctgatttgatcgttgtgaaaatctacctgcgtgcccctctctctctctctctctctctgaatgcaattagagaagacagcttcattcacactgtgtctaaaaatagatgatggcagagttcacagactgacagctgcattgtcatacagtaaccaggaaaggaaagggatggctaatttaacttaacaacttccaaaacaaacagtgcagagggagtccaggataaagaaaaaacacacaggtcagttcttcaaagagctggcagagggatggggtcgctccatggcagtttattagtcctcccaaaatcctgacgaaaccagctaagtattttgcccagatctacccagagtccttcagacaagagctctggcagatgaaccgctacagagattcaggcaatattaggcagcagggccaggactttccctgctgacttcttcatacatcccctggacacaagtaagctaagaagagtcatgacgtttttctaggcaagataaataaatgagttttttccccctttgccatatctaaattatactctgcctagcctggggcatttaaaaaaaagttatccaggaaataaacatgcatcattaaggggcagaaaccaggtgtctaaaagaagcaaaccatttctttccctcccttcagtcctaaaatgttttctgttttcctcctcagtctgccttgcccagggaagggattacggttgggcttcaaaagaaacaagggaataatgcctgtggacgggtagcagattctctctgcagctctcccgcagctccatgttggctctcagcgctgctgccagccagctaaatgtcagatcacggcaccccaacattccctcactgcatacctccatcgccctggtgactaagctgtttcaacagctgtgttattgctggagtcaggccagtgttattcacacgaagtatttgtttcatacggcttatgtggggaattattgcactcagctttggggttctatttaaagataaggtccttcccttgatcaatcagccaggacattcctcgagttgggctccaggagacagtgggacaatattctactgccacccggggttccagataatggacagattcataatactataaagaaggtggatgaagcatatgtgtgtgtgagagaatgggaagcataatggaaaaccatgacccttggtggagctgcggaagaactctgctgctcctccctcaataaaagccacccacaacacaagagtgttaagctggactccctttctgctcttcttctccagccatcaccctcagcctttcccttaaaatcattgctctttcctttcgggtcacgctagcactgttgcgttggtctctacatgcatcactccacacacctgccccgaatgccatctcctccctcagcccttggcttctcctatctcatcaaatggtttatgaccattgatgttcctatcatgtaggaagcaagttgggcctgttggcctggtgacctcctccactactccacatcctcttctgagtgtgagtaagataagggctgtgttactaactgctgagttaatcaacccaaactcccttatatggagggacaactgggaaaaggaaaaggcattacatccatgagctttatgtcctgtaggtgggactaatttctatttctagctcattctaggctgaatctccatcaaagaggcctactggcctgttctccctccaaagttgttctcaccaagagcaatcgggcaccattttctgatgctgaaaagatctcagaaatatgttttcttataaatgaagtatttttaaaagaaataaaacaatgattcctaagagctcacattttttactgcctactatgtgtagacattttcacccatgcagatgccagccagatggaaaccatcacaggcaatttcaaagtgaggaaactgaggcccatggccatgctaccaatgtgagagggaggcaaaatgagaacccaggtttgcctgactcagcagctcaagtactttccccttatgtctctcagtcatggggtaggaaagttaggacacccgcttcttgctctaaaaaggccactatttagccaaacaatttgagtaagtcactttacataatgtattatttcatgaaatactacagttggatcataggcttactaagatcctttctagttctaatatttcatgaatgtagaaatctaaaacacctccagctgttgactgccttctatacttaaggcactgaggccaaaacaaagagctataaaaccatgcctgtcctcagggcacttataatggagtttgagtgacaaaggataacaagttgagtttgactaatggaagagttaaacaattaacaaatacaaaaataccagagaaccagactacagggcagtgcttgagaaataacaccgcataccagcatgactatacaaggagaaaagtagatttcaacaatggtaacacccctaacccggaaaatacatttgtgctgccagcagaaagaaaagaagagacagaaaacgcttgcaggaaaagccagctactagaagggatcccgtctgtttcacaggaaagctttgtttctgacaagtttcgtaaaggaaaaagtaggctagaacaagcttttttatttccaacccaccttttcttcgttcccatgaatgaggaggggatacaaatgagagcaggcagccagggacaaaaataatatggctggtggttcctgacctcttggattcctgccaacagagaagcctgagaggcaacatttaattgtggaaaaaccagcctggctctcctcttatctttttcctctgtgacttaaacccacaattactggcaacccctagattccgagtcacccagctggtggtggcagcaatggctgtgtctgtagctgaaaagcaaaagggagtcagattttacctgcctccgaagccagccctgggagcacagccctaacccagcttgatgacttctcccattaaaaggttcacagatgccctcccgttgggaaaaccaccaagtgagaagtccagatgggaaaaaaagaaacacgattttcagctgctgtataattcaaaggacaagctacgagtctcaaatcctgaattccacattttatttcagcactagagatgtgatgttcaattccttttcttaagaaacaaactccaaatttcttagctggtcatcaaggcaactcacctaccaggccctctgtctttcagcagctcatcttttttctctaatatggacacttttctacagcccaacaaatgggcttaccgtcctttgcacatatgttatttcagagcatttcatgatagaaaaatatggtcttagtcctcactttctcacctagaaatcactttgaagaagtcacttaacttccataatttcatacttgtttaaatttaaaactttttctccagtaacagcctcacagaggacagtagagatttaaccttgaacatctagcattgagcctgcagaggagatgcataatcaacgtttccttctctatacctaatgcctttgctgagttaccttcatccaaaagaatgttcccattgctaactcttgtcctgatcttttcttaccactcttccactccaagaggttgtctcccatacacctctgctcccatcttaatattcttccatttcaaaatattttaatttacatgctgctatgtttatagtcaaatataattaaatcatgcctgtgggcacattctcctaaggatgctaagaattttccacatcttctattttaggactttatccaattgcttcagtgctgatcagcatgcattttggtactcatggggcataccctcatcgggattcataaacctctgaattccatgggtgagcttcagggcttccattgaaatatgaatactaaatgtgcaaatggggtctatgcatatttgtctcccaaggttaaagtccttgacctgaagttaataaccactgtccggaagtaatgaaaggcctgtggctaacatccatggacggggtcctttttctgaacactcagccctgccacctatgtttctgggcttctatgctctctctggaacacaattcctcctttctattcaagtccgagaataataactactcactcttatttatttatttagagacagaatctcaaccaggcaggagggcagtggcgcaaccttctgggcccaagcagtcctcctacctcagcctcccaagcagctgggactacaggggcacaccaccacatcctgataatttttgtattttttgtagagacagggtttcaccatgttgctcaggctggtctcgaactcctgggatcaagagatctgccctcctgggcctcccaaagtgctgggattacaggtgtgagccactgcgcccagccaactattcacttatattgagcatttactatatgtatccagcacttactatgtaaaagcctcacatacactattctagtttaatccttacaacaaccctataaaggtagtactactattctattttataagtgaggaaaatgaagtacaaggaagtttcaaaaacttccttgccaagggtctcataatttataagcagcaggccaaacattcataatttatgattcagcccaaacactctggcttgaaagtacttaacccagtgctggagttgtctctccaagctctttcactttccagaaaaaaataagactgcccttggactgtttctttgccttcacattgtaagtgatcacagattccaacgcctttaaaactccacctttgactcaatcaaaacatttccttttccgtgagttaatcatttccccttctatgtttatggactcctttgggtacttaatgcactgaacacactggtgtaattttttaattctctctccatgaattagactgtgagctcctaattattttgagtacacatggaatatttactgtgcctggaattgtgctaaggatataacaatgaacaacacagtgtccctgcctttaaataattcactcttaggccaggagtggtggcttacgcctgtaatcccagcactttgggactttgggaagccgaggtgggcagatcacaaggtcaggagtttgagaccagcctgactaacattgtgaaaccccgtctatactaaaaatacaaaattagctgggcatggtggcacacgcctgtaatcccagctactcaggaggctgagacgggagaatcacttgaacccaggagggggaggttgcggtgagccaagatcacgccactgcactccagcctaagcaacagatcgagactacatttcaaaaaaaaaaaaaagaaaagaaaagagaaaactaaacaaaagagggttatgatggtttctgaaattgtattatgaagaataaggacttatctttatttcttaaatcctgagcaaaatgctagcatgtagtacaagtcccaataatgcctatcgaatgaatgaatgaaattgggaaagggttttcagatactgaactgctaaactgaaagatctaccatcccatcatgaaactctttgaggttatttatacactgactcacctaaaaactgcttcctgtgttggtgtctatgatacattttttaatgtcagactaaaaatacacttccagtacaccaaccctgtctgcctacctaaggagtagaaatgaacacaaggtcgcatgtaacaaaagaaaagaaaattcactcatttcaacactaagctcaccctctaacaagagcatctgtcttgactgagcactatcttctagaatggttttcacttgagggtctctgaagtcatctatttacaaaaccaaaggataccaatgagattttttataaagtcagagaatcttaagtgagtcatggactctcaacttcagagagttagagtagatgggaccttaggggtcgtctagtataatttcccactcagaacaggaagcactccatagccctgtcaatagactcatggtgggatcaaggcactggagtcctaacatcatgtacactcatagcctctcgacttcccagctgggagactggcaaatcatgtaaactctgtcatcctcagtgtcctcactctgccagatataattgttccgatgatcagatgaaataaacgttgtcttaattagcgaacatttgtttgcaagtaacaggacttcacccccactaacttaaccagaaatcagctggagggatacaggagtgctttaggaaaatcaagggcagaaaatgctgagaagctggagggtctgaaaccaggaatagaaagctgtcaggaggaaagtcaactcttatagtctattgtaattacactaatagtcttcatctccatttcctctttgcatctggtcttcccactctgccagtcaacaatcacggcttctctgtgcacgtgtagaatgatgactgcccaggtggctctcatggcttttcagtttaagtgctaataaaggtagatctcgaattactgaaacacaatttcttataagagagaatttgattgcttcccctttggccaagggaccactgctagtctgatcagttatggcttggggactgatcatatggccagttgcccattcagtagaggtggtggaacatgctgagggagggggaagttaaggccaagttcaggccaagcaaatgactgacaacaaagacaagcaacagcatctctagtgcgatggtactttgcaaagaaagcactgccccatgccagctatcactgtggccatccttatgatcctcaccaaccatcttctgcttgaccactaccagtaacaggctgctcactactggtagaggcaaccttttcatcagcaaacaacttcagctattagaactcttttccatgtgacagcaacttaagatactaaactgaaatatttgtaatcttctcccaagccttaactttaatgaaggcataatcttgcttgttaggtcaagcctgggcttttctttctagtcaaaatatgaataatgggcaaagcaagatgttgaggaaaagctgagtgttgggagggaaactgaggcagggcttgcataatgtctttgggaatgtgtctagacttgctggttccttacttctagccctcataggctcctaggctcctattcccattatctcaagtagcagaacatgttccatataaatgctaaaccatcacagctgtagatcatgtgcctgctcttttgacctccacattttcaccacctgtttctttgttggattaccaataaatagcatgggctcccagagctcagggccttcacagcctctgtacactagtgatggccccctggtgtcccaactttctctctcaaactgtctttttctcaatcctttgactctgctggactttgtcacccccacaacctggtgttgggtctgatcaccccaacacaagagagatagattcactatgcaattattttagcaaacaacctggaccagaacaaagccagaacctcttcttcctataaagaattactactatctctctactaacaccattactaatgactcactaaagcaaaagaggatctggaactgtttctagcatcagtgtgtagacaataggtagggttggggaaaatggttttttccaatgtagagtccctagcacttttgcaagcagaattctgccttgctctcatttaacttccttttgcttagaaaaatataatccagaaaataatcttaacttcatttttttaagttaaccaagataaagttgtgaattccccataaaagaacctcataatagctatgttatgaccagctggcatttaaatactgaaagacccaaagttagaagaggaggtgaaaacaaaaaaataccttctatacattgggggcaccattaagggatgtgctgcttctggcttctctgctcttcacattagtcaatgatgtcaccaggtttttattttagtaatcaggatatacttgtatggatgcaaagagaatatcctcatttatattctaaactcagagcaggaaatgagacacgtgggtgatctgcagctgtggcactataaacagggccagcctaccacctagtctagattctagactgcacttcattccctgaaatactgattgggagattttaaaaaattgaaaatatatcattttagaaagaccagtgcatcttctgtgcaaggatcttagagtccgctgtttggtagaaggctgactcacctgtatggggtggtgcacgtgttgttaggtaccatctacctatctacaccactgatgtacaacgaggagatcctgccctggctccagccagctgtgccaccgtgggcgagtaccacagagttcaagctttctccagctgctaaattaaaggattagtgctttaacttgggtcaaccacccatttgcaaacctgacaagaaccacaaacactcttacttcaaaaatgcatataagcaaataccactgaaattttatgtagagtatcaaggggttctcttagcccttacactccagtctaaactgcttggttgatgattgttagaccagcagccctctagtattcctttcagcactccaagctaaaataaaacagctgatgtttagtaacaatttctgcaaattattcaacaccatagaagagtgttttgttaagactagagactaatctaacacaatctactcaacaatgttaaattgaccagtaaccaatagatgactagaagaaagtgtatgtaactagatataccaaactatagatactaattttaaaatcttggaaaggttttggaggagccctactgtttctgaattggaatttttcatttgcaaatacttaacaaaacccaccaagccagatagagctctatagcgatgcctatggaggagccttataatgatgttgtccaagtaatgtgcttaacaataatcacactcaaagccaaaggttcccatgctcctgccaatataacatgctcacaacggtcaattccaaaggaagagctgtcaagaagtgcctgaagatttcctcaaagggagagataattcatgagcaaacaaacatcatgtccctaatcttctctatcctggggtaaacaaaatatagttttctcccatgatttcagttgctttctataccaagtcagtaagtaaaactgattcatactggtaacttccaggttccagccttggtttgaaggggcacacaattcaataagagtaaagaagactggccatgtaagcccatcttgaatactgacaacttccgtaccatttacctaacactacaaaccctactccatttaagtctctgagatctttttgatgtattttgagcttttcaacttgccttttttggtgggagaggagggaggaggagaacaaagggagaatttgaagtttttatttctgcttgcattgactcaaattgtggtaaagaaacttaaaaggtaactttaaaattctagtgacactagccaacaatgaaaactatctaattagaatgttagaggttttttttgtttgagacagagttgctctgttgcccaggctggagtgcagtggtgcgatctcggcttgctgcaacctccacctcccaggttcaagtgattctcctgcctcagcctcccaagtagctgggattacaggcacacgccaccatgctgggctaatttttgtatagacagggtttcaccatattggtcaggctggtcttgaactcctgacctcaggtgatccacccacctcagcctcccaatgtgctgggattacaggtgtgaaccactgtgcccagccaaaatgttagatagttttaacacaggctataacatagtcataaattaaagaagacatggtcgtaaatgaaagaagacctctttttggtgggagtagtagtaggggtgggagagtagagttatacatttcttcttagcagttgcttcaacatattttattaataaggactatctgctgaagcacagaaatacaattatgtgaatatcatactaccaatggcctgttccatcatagcagggatagttcttatagtgtataaaatcctctgccccattcagctctctttatggagctttcctcagaagcatcagaaaacacagaattaaatatcacaattcttgttgaaggccaaaaattagttcccagaaggattctttgactttcatccttctacaaattcacccatcaccattgtagataatgtgaggggtgaatttgtagaaggatgaaattcagagaattgtttatgatcaatagattgttccctttattccagttgtcttcccttgatgtccacttaacattccataataaatggacaaatggaaaagcacaattactctgccaaaagtcagtcaacattctcccaggacactcagccatctaacttgaaaactgactggtaataatatcattctaattactttaactagaaatttgttatacagaaatgctttcagtgtggggaaagaaaaatcacttgccacttatagaaagaattctgcttcatgtgaccatttgcaataatgaaacaagtaagacaacactgggttccagtgtacagcacaaggatcaaggcgaaacataatgctttcattacgtaagaataggactgacattattctggctttcccctacccttcatcatttaccaatattttttcagtctcaggaatttttcaacccctgaaactcctagatttactactcaagacacagctatccatcttgaggctttctgccaatggctctagtgcttctatttcaacagcttatagatttgaaagctggaaagagagatatgtaaacaaattctctaactttgatctatgcacccaggtttctcaaaagaagcccttggagagtctggggtatactaagtgtatgacttgcagttgtaatcattagagtgacaacccatttccagtgggtaccgttttagccaacccaaacctttcttttcctaatgcatagagtgactttttaaaaaatggtatatttgggaaagtattttagaatggcatgttaacaaaacaaaaacactctagaatatattttcaaataacagaacttggccttaccaagaggtctaataccatcaggtaaataatcatttttatcagtgattcataatacatccagactctaaatgttaaggctgacttttttctgacactcttctctgcctattcatactccatttcctaactcctttagagtaaaaattgaaatcccatatccctaacaactagacagaagcatcatgtttacatcctgacaaattcattaattctgtacctctgaaatatttagcaaaaagccagcactgactcaatcatagatttccacagacaggtctgttcatatttgtaattggtattcactgaaaggtcaatgactcctgttcccaagtatctatgagtctctagattttcttaattggcctcttttcctcagctcttacagactattgttttaaaactaccaccatttagaagttgaactccgagtgaggggaaaaacaaacaaacaagcaaacaaaaaaaacactttttgattcccactccactcataatcaacataacacagactacttctgacccaggtgtgatggaaggagcggggcacagagtcgggggaggtttctccacacaccaagcaagcaatcaatcacttccacagcagacatcagctgggtgtccaaaaattcaattttgacaccacttacctggaaatagcatcaagtctcataggttgaaagctcagtcccataagactgctccccacttcagatgcccatcgaaaaaacaggttgtggcctgttataaatacgcgttcccatgaccctcctccttaggattgattgatttgctacagaggctcacagaactcagggaaacacttaacttatgcacgttataaaggatatgacaaaggatacacatgaacaaccagataaaagattgatagggtaaggcatgtggtatggcagggatccctgaccctctggcagcagacaggtaccagtcagtggcctgttaggaactgagccatatagtagggggtaagaggtgggtgagcaagtattatagcctgagttctgcctcctgtcagatcagctggcattatattctcataggagtgggaaccctattgtgaagtattcatgcaagggatctaggctgcatgctccttatgagaatctaatgcctgatgatctgaagcggaaccatttcatacccaaaccatcccccatcccctcatctgtggaaaaagtgtcttccatgaaaccggtccctggtgcccaaaaagttgaggatggctatgataaggcacagagcatccctgtcctctctagggtgccatgctccgggaacctctgcaagttcagctgtctggaagctcccagaacccagtccttttgagtttttatggaggcttcattacctaggcatgactgattacattattggccataagcgagtgactcaatctttaggcctcttccctcctggctgttggtgggtggggctgaaattagttccccacccttctaatcatgccttggtctttcaggtgaccattctgaagctatctgggagtccccagccatcagttgactcattagcatgcaaagaggcattcctatcactcaggagattccaagaattttagaagctgtgtatcaggaaatttattactataaagtaccttataatgccatcatttttctcccaaaggcactggcttgattaaattcagaaattaaaacaatggccagcttctatagtgtaagtcaatgcttttctagttttctgagggtttggaaactcaaatcctagctaaaacctgtatcacttttaaattgaaaaatttaaagggaataaacatttaaccccaagtgactagaagtcatttaaaatatgtagtacttagattattttatctactcaaagactcttcaaaagtagatgaaaacactaaccagatatatattataaacccaagctttaatttcagagcccaaacatgaaatctcttctcattgtttgaaatctgaaactcatttcaaagactgccacgaaaagttaaaaaaaaaaaaatggattggtcttgacttttccttacatatgaagtaatattgttacaggtgaatctctgataagcaggaagccatcatgtgtaataggatcttgtttgccacactcccaaactcttctctgaagtcctgttcattgctgtcagaaaggaatccaaagtaatgataaacaatataaaaagtagagagtctcatgcattcttaataccaaaatcagagagaaatctagacctgatgtgcctgttatactaaaacatgtgtgtatatgtatattgctgaatatatataacataatatatataatctgtataatcaatgccttgctcagtgtccataagcaaaggtagagaggataaatttaaggaaatgaatattcccacaaacacaacatgtaacttctcatataatagttagcagctggccaggcatggtagctcacgcctgtaatccccgcattttgggaggccgaggcgggcggatcacaaggtcaggagatcgagaccatcctggctaacacggtgaaacctcatctctactaaaaatacaaaaaaattagccgggcgtggtggcaggcgcctgtagtcccagctgctaggggaggctgaggcaggagaatggcatgaacccgggatcgtgccactgcactccagcctgggggacagagcaagactccatctccaaaaaaaaaaaaaaaaaaaaaattagcagccaaaatgtgttgctgctactcatgaaaagtattttttggtgtggttttcttgatagctctattaagaaagttattttatacatttatcaaatgaataattagtggtccatcttgttaactttttagtatgccccctattaagtgctagttctcatgttataagaaaattaaggattatttttaagtcagaaagcttgagtacagtatttttgtagatgaagataaaatattttaaagcatgaagatgtacatgagaaaaaaataagacattaatatttatatatagaaatgttttaaagctttgccaacatgggcatttttgttgtttaggattagtatttgctgggaagtaattcatctgtgaaattatttaacatgtagaattatttcttagtttctggtttgggagaaatgctcaagagttgagcttaaaatcattttattcacactgctaaagctgaaaaatgtaaacagggagctttcaatacatttcaaatgagtttggagaattctaaaatattcaatccatttataatgaatacaaaacatcattagaaactggcaaaaaaaaaagtagctaaaagtattcgagttatttcacattactgggaaagtttcttttaaaaagttcagttataaataacattcactaaacatatttatccttttttcaattttggtggtataattttagaaatttatcgttgacttttaaaatttcacctaaacttacctgaggctctgcattatgttactcaatgattctgatgccaagttttgaaatcaaattataggccagtcaccttcagtgatgtaaaaggtagaaccacaagataatccagcactttcctcacaacctgaaaacggaacctgtggcaagtacctgcccaagtgtcagactatgctctaaacaactgcctgtcatgtaacaggctgctcgaaagcagcaacatactactcctatagtcaattcttaacttcttaaccacaatttcatcagtgtaaaaaatataggagcagtggggaccagacttacatatactgaaatgttaaacaacagaactcttattttgaagtgtgggaggggaggaagcacctcaatcagttgctttatgttccttttagtggcagaagaatgatacaatccagtattttcatccacagctccctaaacacaaagctgtggatttcataaatgtaaatatactgcgtaatctgcccactgggagttcatagtttagtaaggactcagagaagacaatttcactgtgcagaacacaaggctgataaagtaaacatcacaaggccagtaatgaagaatgcgtaaggaaagacagattatatccaggaaggaatgaggacgggagataatatagaaaatacctaggaaggctccaggggaatgtaaaatttgggatgttgtgaagaatgagtaggtttatctgggaggagcccttcatttgtgagaagaggaatcacaagagaggaagaggcaggcaggatcaatatcagcgaagacgcaaagggagaaactctctggatgtgtttacagggcaggaaactactccttttgaggatgcagagaatggttactggccagcagtgaggaaggaggctagaaagaagccttgagccaggaagcgagaggactctgaacaccgagtcttatttgttagtcactgaagatgttttgagcaaggaaatgataaattaaagctaaaagagtctcctccttatcagaggtttcaccttcagtggtttcagttagcagaggtcaatcacagtgtaaaaatattagatgaaaaattccagaaataattcttaagttataaattgtgcactgttctgagtagcatcatgaaatcttgtgctgtcccctgataagaatcacccctctgtccagcatctccctgctcctgcctgttagtcacttagcagccatctaggttactagatcaactgctatgtattacagtacttgtgtgcaagtcatccttattttctctcattgccccaaggtgcaagagtagggatgctggcatttcagatgtgctaaagagataagtcaagtgcttcctttaagaagatgaaagttctcaacttaaaagaaaaaaaaatcttatgctgaggttgctaagatctacaataagaatgaatcttctgtccttaaaattgtgaacagtatattttttctttcattattaattattgttgttatcttttactgcacctaatttataatttaaactttattctaagtatgtatatatgtataggaagacacatcatgtatgtatatagggttcagtaccgtgattttaggcactgggtggtcttagaacatatcccctgtggataaggaagacttacctctaccacgtgcttcttttataaagactaatctcactaaccaaggtgtagaagtaagaattggaaaaatggctgaatttcagcaataaggataaatataattggataattgtaatagctacttttaatttttaactgttttaatagtacttactatgtccaggctgggtgcagtggctcacacctgtaatcccagcactttgggaggccgaggtgggtggatcacctaaggtcaggagttcgagaccagtctggccaacatggcgaaaccccgtctctactaaaaatacaaaaatttagtcccagctactcaggaggctgaggcaggagaatctcttgaacccaggaggcagagattgccgtgaaccaagatcatgccaccgtactccagcctgggtgacagagcgagactccgtctcaaaaaaaataaataaaaaataagtacttactatgtcctaaaagttttacataaactaatttattccttagagtgagttggttaattaggcattattatccatattttacaagggaggaaactggctaagagcggttctgtaacttccccaatactgcagagcttttaaaaagtggcacaaggatttaaacccattgctgtaggactcctaagtccatgctcttaaaaaactttctatcttaccccctaatctagatataaatcagggatcacatttcaaatgaaactgtgactccattgaaaagtatgccagcaggtagtcagcctctaagatggtccttaatgatccccatctcctggcattcatgctcttctgtaatcacctcccttgagtgtgggttgaacttactagttcacttctaaccaacagaatacagcagaagtgatggaatgtcgtttgcaagattcagcggtttccctctccagcactgctcaggctctctcttggctcactatccctgggggaagcccgctgccatgttgcgaggcagtcttatggagagacccatgtgggagggatggaagcctgccaacaaccatgtgagagagcttggaagcagatcccccttccccggtggagccctcatgcctgatgagactgcagaccaggccaacagcttaattgcaaccttgagagagtttgagccagagactcccaaactagattcttgacccacagaaatgaggagctaagaaatgtttataggtggccaggcacggtggctcacgcctgtaatcccagcactttgggaggccgaagtgagtggatcacctgaggtcgggagttctagaccatcctggccaacatggagaaaccccgtctctactaaaaatacaaaaattagccaggcgtggtggcacatgcctataatcccagctactcgggaggctgaggcaggagaatctcttgatcacgggaggtggaggttgtggtgagccaagatcgtaccattgcactccagcctgggcaacaagggtgaaactcagactcaaaaaaaaaaaaaaaaaatgtttatagttgaaagctcctaacttttagggtaatttgttacccagcattattaatacagtcagtagacagtaattatttattattacagggtaaatctttttctttatacttggagctagaagtagggatctgtctaggagagattatacctgaaataaccacaaccagcccaaataacagaataccacgtcctttacctttccacccaaacatacataaatcaggtaatctacctatctcatcctcccatggctcttcttgttgtccttattctcctttgcttgaatgcattcttaggaatagaaatgctaaaacccaaacctgcaggtttcaaaaaaaaatttttagacatacagttttgaatctcatagcaaactctttccttcccaaggctcctcacattacattgtgtattcttattatagcacataacatgttttttcttatttgtaggtttaagtgtctgttttccaggcaccctcttccctaacccgttacaagaatcatgtctcgtgtgatcttatatccccagtactgagtgttcgtatggctgggacttaataaagtttaaatgaactcatgaataaatgtgttgcacaaccaatgagtgagtgagtgaacaagtgagtcaataagcaagagtttagggacatgggaaccaccacttaaaagcttgaggctgttgtgcaaatttggaccttcatataagccatttccttctatatagaatgctctttcttttgctcatcctcacctcctcaccaggcttttctctctttaacattcacctcaaagagctgtctgattgcctctctacaactctccccgccaacacacacccacacaccctaccagggaagtcttccttttctctgctgtgaagccttttctttaagtttccatatcctcctgggcataacttggtcacagcacccagcataccacactgtaatgattagttatttgcctgtcatttccacttagccgtaagttccttaaaggacagcatattcagctaacagcagaatgcctagcagtggtaggcactcaaaaacagtttaaaataatgggcaagagaatgaatgaatgagaaaaagaaaactgtatctagaaaattatctcagcacaatctatttatttcaggtaagctatcagtcaggtatacatagtgctccaactcctaaacagagtaaaaataattgtacatcaagattattacagatacatgaaaatcatatttagaaatagtacttcagatcaggcatggtggctcacagctgtaaaccaaaaatttggggaggctaaagtgggaagattgcttgagctcaggagagacccccataaaattttaaaatttaaggccaggtgcagtggctcatgccagctactcaagaggctgaggtgggaagatcgcttgagcctgggaggttgaggctgcagtgagctgtgatgacaccactgcactccagcccaggcaaaagagaaagaacctgtcacacacacaaaaaaaaaagaataaaaaattacaaaattagcgtgcctgtagtcctagctattcatgaggctgaggtgggaggatagcttgaacccaggagttcgaggatgcagtgagctatgattatgctactgaactccagcctgggccagcattcgagatcagcctggggaacataggagactctgtctcttaaaaaaaaaaaaaaaaaaacagaagaagaaagaaatagttttcaggccaggcacagtggctcacacctgtaatcccagcactttgggaggccaaggtgggtggatcacctgagatcaggagttcaagagcagcctggccaacatggtaaaaccccatctccactaaaaatacaaaaaaaaaaaaaaaaaattttgctgggcgtggtggtgggtgcctgtaatcccagctacgtgggaggctgaggcaggagaatcacttgaacgcgggaggcggagattgcagtaagccgagattgagccactgcactccagcctgggcaacaagagcgaaactctgtttcaaaaaaaaaagaaaagaaaagaaaagaaaaagaaataatgtttcaatctatggacaggccctagacagagctgcctttaacacatctttttccctttccctcacatccttgatcccatctcagtcaaaaaggaaaaaacaaaaagttttcttacttctcagcctaagattcctgatactgtccccagatgccatacatgtattggcctcccagaaatcacccagtgattttctccccatgaaaagtttatatgtctcatgccctcagagtttttaactgcaaataagctaaaaaaaaaaaaaaaaaaaaaaaaaaaaaaaaaaaaaaaaaaaacgaaaaaaaaacctggtttggtggggaaatgggtgctcatgggttggcatttccattttggtaggcatctttttctaaggccatagctttactcaaagcccagtggaaaaagacatttaaaaaaaaataaaaacctttcaggaaccctcaagtcactccattggggtgaactcccctgtgacactagagaggtggtgaagcttggtggttagggcagttttctgagtcagaaatctcagcttttccactctctagtcttcagatcatgagtaacctcactggtgcccaagtgttccatctgtaaaatgaaataataagactacctcaaggaacctggtgggaagattaaatgggttaatacaggtaaagtacacagaaagtgcctgggaagtagtcaataattgtttgctattactattaccatttttacttttattagaattggctcaaaaagaacccaaagagggcaatgctcaaagggaagaaagggatgagaggagagtacacttaactgatttggttgtttagcttgaaggcaatgtccagctgcaggataaacagcatgaattggaaccaaggactcatctccatgtgggggaggggaatgtgaacagaaaacacgatgtcattggcttcaatttcccttggaattgcctcttcaatgtctcggatcttgtcacaatgattgggtccccaaggcacgaaccattttgtcttgtgatggttcttacgggcatccacacatttcaccgacatgtaggacactgccgttgtgggccctggagctgaaaagagaaagtttgtctgttttagaaaagccatctattgaaactactgtttctggttaatattctttccactgctgtgttccctccagcttttgtatcgccttctacaagtggggctcagcaatacttagggatcttccaaatctgggtgaggatctttcactgacctccagaggtgtcataacagtatctctgagaaccttcccattatgttttcaattgctgtgaaagaatacatttgtaaccagtctagttatacttccccacttcaaaacaatgtcacaaaaaatcaactgtgctacagttcccacctgattgaggtcttggagagctctggtgcttcatagagaacagtatctaaagtcagaagaccttagtcttcaaacctggattcgaagcctggttaaaaacctactgtcagtgaatcttgggtaagtcagttaaatctgtaatagcttcaggaccctcatctgagaaacggaagagtttctaagattccttttggctctaaaattgtacaacattgcttttgcttaagataaagaactaggggacaccagttagcttggtacctagcagagaatgggaactcaaacactgactgatacttcaaaagtgtactaaaatataaacgatgcacttcaagacagcaaagcaactttgaaatgtgtaactttaaaaacactattttgtgattatataatggttatatgattataatattaataacttggaaaatacagaaattttaagttcaaaacaacatttacccaaaatcccactagagggaagtaaccactgttggaaaatgtcaaaatgccatctgtcttttctatgactgtgtaattagataaaaagtttacacatgaattaaattgtgtaactttaaaatatacgcaaatattaacacatatttataaaatagttatatcatgcatagttttgtagtcttttctttttattcacttagaaaagcagagtattgtgtgataacaccagctctggaggcgacctgtctggtgtcaaatcctggctctctcatttttagttgtgtcaccacaaatccacactaggaaagttttgggcaaattactaagcctatctctgtatcggttttatcatctcttagatggcaataataatagtactgatctttccaagtcactgcatattttaaacaagttaacatatgaaagcactcagagtagtgcttgggcacacacaaagtataaaatattagccattatatcatattttctttataattaaaatctttcagttagtagttgcaaaatagtcaatcacacaatacaccaaaatcaacttctccttcatcagtttgtaaaggctatctataagaataatcctttgcctaatatgttttgttggaaatttctcctaaactttccatctgctatctaaatttgtttatgcacatttaaatagagaagttccagatcttatatggaatccctcttttatgtttttccccccatgcttttgtgtttagagaaactgaccttcttcatctcaaaattcaatagtcatctatattgacttctatttattttttgcaatttcattttttctaatatttaaacagttgatccatctgaaaattgctataagagatgcagtgaggttctagttttatttcttaaatatttaaattatagttgattgaacagaccctcccttttgttgatttatcatatcactgttaatctttatgtatgtaagcatgtttctgaacatctgttcttttccatgcattaaactgtcaattcacgggtcagcacaacattgctttgaattttataaatttattatttttatcaatatctgctagagtaactctcttccccaatccatttcaaatttacatctttttgctaggatattgaagattaaattaaatttataaataataaatatataataataaattaatgtggacagaattagcatccttccccagcgtttagttttcccatccaagaacagtacttgtttctccattgtctacaatctgtttttaaatttcttggaaaactttcattgttttctttatgtgggtcctactagtatattttaaaatagatacatctataaacctttgaaagttagtagttaaaagaaagtgtcatcaattatggtttatgtgtgtggtttaaatatgtgtatttctgtgcatctgatacttggtatattatgtttgcagaaattctctcttatttaatagagatcagatagcaatggagaaacatgaaaagcaaaaagaaagttatataacgggaaaaatgtgtattattaatattctgccctacttctaatgttcgaatccacattatttttctattctattaaacatctattttaatgatacatttttagtaaaatgttatgtttgtaagaagttaggacaatgcctattaatacttaccagaaaactcaacactactaagctctagctgaacatccttcatgtagaaggctgaacactgcaatacaagttgccactaacccctgctacagacgtttttctttaaaactcaaaactgtatcacgaagacctcacatctaatccatctaaaatcagacatctgacttattcttagaaatatgagtcaatcaaactttggttatcctgactcagctaaatagcccactgacattagaaaagccaaatggcacatttaactgaaccctttttaatgtggttggagaaataaacagtgagacaaaagtcatgaattctattttcggctaacatactcaaactgactatttgctgcagaaaatagttactacattttaaaacttctattcttccaaaatgaacctaacctttttttctttattttttaccttcttgaaaaacaagtctctcacttctcaggccaaaacgaaaaataactagctgagttcctcagctaagctccaaaaccacattccaaacttaataacagagaagctgaacactttatggtcacaaagtccgcatttttaatgaatgcagtgaacgcctgcctttttaggggcctgcattattttcatcctctcattagtctagtgtttcttctataaagaaaaaaaatcccagaaatactaatattttcataaatatcatggcagtgaacttggagaagcctcaagtgcatctcaagctatactgtgagaatcacaatttttttcacttgaataaattagtccttgagtctcaaaaatgctttccataacttcaaaacctgaagataattcaacattttccgtttttctaatagtgttcaaaagagaaaacacaagtattgcttgagaaagtaaacagacatcctgatattcaaacatggacagttaatgttcccccaataatatatttacagctcagtgcaatgtcctactccagctaaaagtgaattcccaagtgtttctttatatagacagcattatcacgtaaaccaaaagcaaagcttacagctggtagctggtcacctaccatagaatgtgttttcattagctatagtcaaaattttagctacatgggtcacaaattgtgtctagaatcaaaaaaagtttgatctgtctgtaaatttttttaaagtgtgtgggattaagagaaaagagctaaatggaggaagtttaaatcatcttcaacctttgaacaagccacaataacaggtatttgtaatgaaggccttacttagtcacttgcgtggttctagggattaatagagtttgtgtattcaagagggggctggatagattcaggtcaacaaactgagtcatgtttgctcaggtgaaagctaaaaataaccactccccagtattcctaggagagtaatgcaatattacccagctgcctcagcacacattataaatgtctcctccacccacccatagtataaggtttaactgaaaacaagtaggccaaaaactacttctacaccagaccaattcaatgacagaataatttggccaaaactaaatatgcctagtcactgtaaactggttaactcatggttggttaagatagccttgggaatatgcacagaagttataaaaccatgagctattcattgaaaatgcagtccattatgaattcagttctttttactttatcaaacatgaccattttattttgtctgtatttcaatacagtatttttggcctccacttttccactacagcacatgaattgtgaaatgtgattctatataacatttaatgttaaagtgatatgaaatcaataagacttctaacaaattcaaggtgtgaagaaatgtacaaacacaacctgaagtctctatgaaaattcagtggtccctcagttacacacattactatggctcacagtatattgtccaaatttgtcttgagtatctaccatgcactagacactgccggttctggagtaaacctgataggcaccaaccatatggaacgtacaaataacggaggaagcagacaataaataaacaatttcaggaaaaaataattttgatgaatgttatatgtaacctgacattccctgagaaagggcaacagtcagatatttgggaggtgggagaaatgaatacaccagaatgacagaaaaatccagtcatcgttacaacataaccttgaataaaaatgtaagtgaacaatgactaaacctgtagtacttcttttggaagaatattcattgactccagtcagcttcctgttatttcacttcaaatggctatccagtttacaaattactatctagccaaccgctagcatttatcatgcttaaaattgagtcaacattaaatcattagcccctattccttccagaacctgtaatttaagagttagagagagacaagacttggttgcctcttagaaaagttaaaataaaactaaaacaacaggctgacatgacacattgtctccatttaagccaacatagactatttatttctttgctttattatgagtaatgaacatttctttagcaatcacctaggagcattactattatgcaggtaccgtactaactaaagacagagacgaatggcctcccagacccccatttgctcacaggctagtgtgggaggctgagaagttcacaaagaattacaccctgattggaaatttctttgacagaggtttgcacaggatgctccagttgtaaaaagagctgagggtagctttcggcagggcttagccttggaagagagcaggtaatagccaagggagaatgggggatggccaaggagggaaggtgctgaggtagagatagaacatgtgctgggtcatagaatatctaaaacaatcatattttctgcagatatctgtgcttgaatattaaaaattaaaaagagatcatttaacggtgaaaactgtagtactactcttatctctgtgtccacccttgccttttctaatcagtggtataattctactagagtgccttggcctctgctcccaatcatccctgctgtactctatagagcaccataaagaaggaataataaacagagccacacataacaaagaacttttatttggcaggaatgtttccttttatgacacctatctctgccctgtaagtagccacaaggccagaccagagatctgctggaaggaggcggagtgagagggtagtcaggtgggaatgaagaagctccccgtcctattcccacaaatggccccaaagagcctttgaagtctcagtcatcaggtaataatagccttcctctaaattagaggaagaatgtctgccttgcaacaaagatgatatttaaagaataatctgctttggggtacaaggggaaggaatgcagagaatagaccagttgaaaaggtaattcctgtttataagaattaataatcagaacagcaccattttaaaaagtaatgacttaaagtaaaaatggtcaaagatttcagaaatgttttagagaattttatgtttacaatagaatttatctaacaaaaatgataggaacaatacacattgatttaaaaacatacaaaaagttggtagcagatactttctcctactgacttgagacattgatttaacacctgaaaactaatctcagttaaaaagctgccagcaccatctctccacctgtaaaaatgtgaatatttatttatattttataatttcattttatttattctctatcttgttccataaaacattttggggtactagaactggttattagcctttattttttaaaaataattgggactgatttcaacggatagaattaatgttggggcgggggtgggcagagactacaaattacttggtctatgtctatatcttcaaaagtttggggagcttatattctccagctattgctttttttttttttttccagctattgcttttgaaacaacagctgggaaatataagctcctcaaacttttgaagcaatagctgaagaatgaatataagctcccaaaacttttacctgatctatgaagttgaatggctcaatatccattttactttgaaatgtagagaaaacctccattgcactatgaatggtatttataagaactaaaaggcatatgcccaagttggttctaagctctgcctatctaaatatctctgcttgccttatgagaacttatataaaacatattgagcacttaaacccttgggcaattgcagagtgtgctttggattttttgagtatcaaggtggggagggtcgaaaagagggagaaagggaacacaggtgtcagaaaagactagatgaattcctgttatgtaactactttttcaaatgcccccaaagtacttatttaacctaagaaaatctttagctaagtttagaaattagctttaaatatgctcaattgattttccttagacattccacatgcctttcgccagctcaaaagccttaattctggttaaaaggaaacatgtgaaatatactgcacaacttcagtggccagatcatattaactggctgagctgtgaggtcttatgagccaaacctgcttaccattcactgaaagtcagttcctaaaaagatttcttaatatctgccataccacttatctaagttttgggtggctaattagaatgagctcttcaaaaagttcagctaaagaaagtgcaaatatttgcattaaattgacttagtacttaaatgattcagtgtgttaattcttttactgaaattgctctgaagttatagtagacacttatgctttctccaccacctactttgaagagaagattctcctatatttcaaccatacccattaaatcttactagcttactaaatgaagtattatttcacaattcaatctcaattactggagagctgaaagtgtgtctacagagactagaccagaagtgatttttacaattatcaaagctatgcccttgtgcatgaaatggggtacgctaagtgaaatgaaattcattcttgccagccactttcagtcagttagttatgctaacatctgttctaggaaagctaattttttttaatacagcagaacattcctttacactgaaccactaccaccaaaacacaaacatacatactacatagcagagttgaatgcaaaataatttgtaccgtacacacaaaagtcaagcacttatttaaaaatagttctttacaatataaacttatgaaattatggacattttgacagcaattttccaaaaattgtagcaaacacttgtaaatacattccgactcaaaaatattgaaaatatcatatgtttacattttaggcagatgaggattttaaatgcttcgcctacaacctcaattgttgtggagccaaagatgcaacagctttgaagaatagaagaattactctatatttgtcaggatctacgtggcaaacaagcgccacttggcttacattacttgcctggcttggatcccatggaatggaggagcattggaaccaagaggaaaaaaattaaagtgctttgggacagcgagccaaactcttacatagtatttgaaatggtgtggcaaacatgaaattattttaggctcaagattggtgctagttttttaccctctttttgaaaaaatagtaaaatgcacataaagggccctgccagaggtttagctcataaaatctgccaatcattggatgtgctaattggtgtagcaatccagtggtggcctggattaggactcaaaaactgacccttaccacccttggtgtcctgcagcaaagacagcctaaatcgaaaagactgatggaagtatatcaaattacgaatttctctatccctgaaaaatgcctgcaatttctgtttctccatcactccagaaatactcaaaacagcaaaaattaaatacatatgaagtgaacacaaaagacctccacagaaaaatcagtggctcatctgttgacgctattgctcattgctcggctggccagtcatctgggctaagttttgactttgggccagtgcttcaaaatcagcaacctttcagccaaaagactgtggaatgcagccaagaccacctgtggaaagtgaattatagcatctttaatttactaccttgggctatgatgtcagaaacccagcatggagggcgcaccagttcttgtgtgggaaatctctcagagcccccatggaggcccccaaagtggctctggcaaagctgtaggggtggaggtaacaaaaaaggggacacctggctctccttcttaaatcagctcaccatgggcacacatttatattggaattttagggtcagaaaataccaaaattaaatcttctagaagaaacacagtcagtggctttgctctaaagtgcctattacactctacaagtttccaacatttgttatttaaaataatcagacatttattattcataaattacatatattcttttatcaatattattgttaataataaacatgaacaactagtaagtgaattgcaaagaactttcacatacatagattatcgaatccacctagttaacaagtaacataattagcaccattgcatattcagaagatcagtggtttttgtctcatcagtaaatagagttaggactggaacccaggtctgatttcatatctaatgctcctttccaatacaactatctgtttatttattaacggttactatttattagcactctcagattacctgagatagttgcagagctgagggatgaatgaagacgactgtggccataagtagcttgctgaagctccacaggcaaggcactaccagcactgggctgggtgtcactcaaagggagccagcaagatagcttttctgggagacttacagtcagggacagagtacctctaagacttccataaagaaatgatggagtaataggctcatgaaaatgcactaaactcccttgaatctgataccctcccagtttttaccgggtcttggttatgacttcatattgcaggtaggcagtgtttaggatgttagcctagagaagatctgactcaggaacacagcgctgccatggaagtctatgacagcacttgcaggcatagtgagagacaggaattcaagttagagaaaatctgactccagagcaacctatggaagaattacttataattcaggtaggcaaacaatggcacagtttgactcaggaaagggtgggttcctcaaccatggaaacatttgggaagtaaatggatagataagagcaagagcctgaactaaatataagttcctctcagtcacaccaaaataagtctcctatccatgcatatggtatgtcagggaatggagaaattaaggtccaacaaagagctgcatatagtttattgatttgttttctattttctgaccagttccagataaacagataaaagcaattaaagtacagggcattctgaatggtcaaaaatttagtattgtacattgtaagttaaggctaagggcaagtaagacctgttaatgtctttatctggaatttcacaaatgccaagaataatcatatttccttccttgattgattattcaaagaaaacacaggcccttataatttgcaaatttcctagaattgagggtagaggtacattttaagggtaacttgcagttttaacattcacattcttaggaattattattattattaatttttttttttagacggagtctcgctctgtcgtccaggctggagtgcagtggcgcggtctcggctcactgcaagctccgcctcccgggttcacgccattgtcctgcctcagcctccagagtagctgggaccacaggcgcccggctaattttttgtatttttagtagagacggggcttcaccgtattagccaggatggtctccatctcctgacctggtgatccgcccgcctgggcctcccaaagtgctgggattacaggcttgagccaccgcgcccggccggaaatatttttttaaaaaacattgaaatcacaaaattaaatagtctatgcaattatttagtattttaaatttcatcagttttaggttctagctcaagggccgtctctccttcattcaatttgttaaatgcctatagtgtgccagctggaggcctcctctgattttccttcagttgacaaaagatccttacttcctttggtgccagtatcacctggtctatgtctttattatagcattctactttatttgcaggcatcacttctgaaccctacaaaattataagctcctaaggggaaggactacatcttattctgccttgtgccactaagcacagaaacttaaacatgcaagtcctccagacctgaactgaactatttattatatggcttttgtgtcataataaacatattaatgtaagttatgctcaatgtaactaacaaaattttatcaaatgcctactaagcatcattttttaaatgccatagtggattaatccttgtcccgcctgtatcaaagtacacttagactggcactcagtgacagtttgggaagaagccagagctgccttccgtgaggtcagtctcccaaggtcacacatgtgctcatcagagactcacttcctacaaatacttatgacggttcttccagatccgtgtcaagcaatatattaaatgaaatactgaattttgaagatcaaaatgaacttttcctaaactataacccaatccacacaagtaatttacacatcaaaagaaattagatagtaggcaaacaaaacaatggtaatttttttaaaaaaaactgctcccaaagggtttgtggccaacattaatattgcaggaacatgtttagataactgctgttcagcatagttcctggaaacaggttctcaaagccaggacttacagttatttaccttcttccagcactgccctgagggttttaaggcctaaatgaatagaaagcaaatgggggacaaaatgaaataaaatgttcacatctcagcctttagtgtatataactaatgtttgaagattttatgacaaaatgtgtcttcttaagaacacatgtagggaagattttggccatttctttaacaccctttaaacagtacctaccagagaaaaagcaaacactcccttctaaaagcatcaatattctacttctgagatcaaaactacaaaacaggctcagacagaaacctgggcaaaggaaccttctgctgcacgtatgtactatttcccagagatgtaaatgatttttttctctctgccccagtgaatcacatatgaaagttctcaaagaattagtaaagaaaaatggtgaaaatcttcttggtgttgaaggaacagtggagtgtagctggtatcagaagttctgaagtgactcagagattcagaagggtgacaggcaggggcagtttttactagaggaaagagcgatgtaggatgaacaatttactgtccctgttgattcacataggatgtaagtacaagagaagtcaaggatgtccccaaatttcttgcataggcagcagatgagtgatgtcattcactaagacaggaatcaaagaaaaatgaatgacatgtcatatcacacgtagaatttgtagaagctggagatgtatagcttgtttaaaaggggggtttagtatggagggttgaagataaaaggtcaaatatgtgaatgactaaatgtggaggaggaattagatttaccctgagtggttccaatcttgcaagttctcaggaaggaaatctgagatcaataaaatcaaactggcccacagttcaccacaccagttgaagaaaatgagctgccggcacctgtgtgagtggaggtgctcctcagttaacacttggtgagtgcaaagaatgcagagggcatttgagcaccgggtagggatggaaaggtgacttttagggtctttgttatcattattattctatgggcattcttcatatataatatttagagcttcgattctgggccacaagttgatctgctattcctgaactactacaaatttgagcataagaatcttggcagaataaattatcccaggactcatgattgctgggttctagcaatggatatgcattaatcaggcaaattattcaatcaatcttgggccttagttttctcaactgtaaaaggcagtatttaaactgttaagcacttttaactcagcaattgtaggattctaaaaagaatgtatgtacttctacgttatgatgaaagtcactcttttaagtttaaagaaaaagttcctacaaattagggtcaatttatattccaagagttctggctgtccctatcaggcccctcctccccctccttgtccttatattttcacatctgttagaagaacagatcttaatggtcctattctcgttctgttactgtttgggatctgaatgtattctgagtgttttctgtcttccaacagctggagagatcaaagaactgttcctaaaagcaaggacaagctacagccaactgcatatgtaaactttcatactgatgtatttagcacagtgaattatacccccataatttataatatgagaaggtaggtctaatccaataataataaagacctttaggagaaaacaacaaaaaacaccattccagcttccagccagtggtctgaatactcacagcctaatacaacacaaagacattccaatacaatgaaataatttggatcatgtccagcctctattttttaggatgatagaaataagctcaagagagctaagtctatttattattcagaagaaatgaaagtcatagcatacacttctaagccaagagatcattgacaaaatttgctaatgaaatcaattcataactttctttcagattttcatttaaacggctgggttcctaatatatttcaaaatttacactgattaccctctacaaaaagtatgtcataagagaaaacaatgattacagagtagcaagggacttactttcacaggaacggtgctttatgttgctgaaggcaattacaaaaagagagtaagaaaaattaaaagcaagagctagagctcagaaaaacttgggttcaaatcccaactctgttactcactagcaatttagtggggcagcttacctagccttgtagaatgccagtttcccttttgtaaaagtgtactaaaaggtactcgcctcctaaatttattttgaggataaaatgattaatataaaaaccctattacagtaccatgaaaatagtgaagccttaatgaatgttagctgataataatagtgctgtcaacacatgagaagaattagaatctggtgggagatgaagacctactccatgttctctgttctgtcttcttgccctgaggggtgtgttcatcaatatttaaggaactagaaggtgtgcatcttggatgttaaaaacaggggctcccctcacctatcagtgaacagccccaataccagagatgattctatacaaattttaactggaacatctaagataaccctgagaaatatcccaggcatatcttaagcagcctgttatttgagggaacacagaattaacccttggttttatccttagaaaaatgggatgataacatcttttttcacaattatcttcacaaattattataaaatagttatggcagagcaaaaactattgacatgggtatttgctaccctttcccctcctctcttcagataaagagaatgctggttttgcctcttctgtcacaaccccctcacctgccccccgatgaggattcaactattgctagatggattctttgagttttcatgatgcacaatcaaaagacaggggataggtagaagatatgggcttgagctcggcagggagaggggggcggtttaccagcgggagtgttggggagattttggaagagacgttagaaacatcaaagtagatgggaaagaaaatagggattgctagaagtactgctacagattatatatcccctttaccatgctttgacagttaaagaacagaagttgttaggtcactttaaattcacctttggttgactgcctgtttctttgacagaatccctacttggagactggaccaaagaggctatgtcttccatagaggcaacatgagaaagtaagagaggtgcaaacacatcatgcaaacgttaggcagaatttattgtgttcatacatgacatggggaacattgaaaggattgatgtcttagaaaggcgtgttaggagtgtgggtctagaatgcataaggttagagatatgcctgcactgggccatcatcttattttaatatttggtccaaattctgggcttctcacaatcagagagctatacctaccaatttcctcttattattcttggctgcccggtccccatccctctactcagagatttctcaagctttgcactaatggcattttgggttgaataactgttgtgggggtttggcttgtgcactggaggatatttagcaacatccttggcttctacccactagctgccagtagcatcttcatccccactgctggcaagttcagggggggtgtgggtgggggaagtcttctccaaacattgccaaatattccctggggagcaaaactgcttctggtggagaacctctgctttaccccaatcatccaggcttacaagaaaaattcatactccatcaagccattctacaacacttcattttcagagtttccaactacagagattccaagttctcagcaattcataaccattacagtttgcctcatgttacactgactgcatcaggctgtcatttagaaattataataatggctaccacttgttggatattttttatgtgctaggcattgtgctagggacttaacagggtgattttcattcttatacagaagtaagtgtggccgggcacgttggctcgtgcctgtaatcccagcactttgggaggccgaggtgggcggaacacctgatgtcgggagtttgagaccagcctgaccaacatggagaaaacccgtctctactaaaaatacaaaaaattagctgggtgtggtggcgcatgcctgtaatcccagctactcaggaggctgaggcaggagaaatcacttgaacctgggaagcggaggttgcggtgagccaagattgcacaattgcgctccagcctgggcaacaaaaatgaaactccgtttcaaaaaaaaaaaagaagtggtagatattattatctccattcagagatgagtaaaatgaggccctgaaaaattaaaataactcatccaaggtcacagccaataagtggctgaactggggtttgaacctaatctgtcccaggtccatagtctctccttgtctcaggccacactgtttctcctgatgagaaaaactaatgcagggatacacaagaaatacatttacccaaagttacatgagttcaaatggcaattccactgtatggactattgtagaggttgttgatctcagcactatgtggactcagcagtatggatgtctttgttctagggacatcaacaagctgatttttgaattatgaattttctgcagaaaataggaaaatggtgctctcctttaagtagaaacaacaaacagtagctggttgccatggtagcagaggtaaacttaaccttgactgggaaggcaatcaccagaaagggacagcaagtatggtcaggagtctaaaccagaccaggggtattttaactggagaagagaaagtcaaaggagagaaatgatagtcatctttagttatttgaaaggctactgtgtaactgaagtgaagcatacattcaagattattctaaatggaaaatccagcattcatgagtggaaattacaatgcagtcatggaagccagttttccactgaatgataagaaagaacatttaaccatcgtaatgttccaactggattgaaaaactaaacaagctgtctagagagcaataggtcgctaaaatagaaagatcctaacaggaaggtcatctctcttgggagacccagtgtgggtgagactgggctaaacaaattctcaggccccctccccaagcaaaatctctgtttctccagagaattagtaaattggggttccctgttgaaaacagacaaatggaaggtccactgggcggaaagccccagccgctcatcactacaagaggagaggtaaactacaatctcacctgggaagaaaatgttgtttaggtgacacaaaccaaggggaggagaaaccttgtggaggatttttcccctctgttctgaatagatgatcaaggggtaaggcagtaagggcaaaaccaaaaacaaaacaaacagaaaaaaacccaccaagaatcaagcagctttctgctgtcttccaaccctcagacactctgatgcctctttcttggaatgtaccgccacctcccactgctttggcctaaagactgcatttaattttaaaaagaaaataggcaaccatccagctaggggacagttagagtaacagttgattagtccttttctaaacactgtcttttgtttcattgctctttatttgctgtacaccaacaattcattaaaaacatctcaccactagatttagtgaatggagaggacaggtctaaacccaaacattcctcttggaaaaccgactacattgtaaatttgcagacctgtccaggaaagtaaaactgttacaaagtcaacctctactgaggcacacagcctcctttgtaaaagaaaaaaaaaaaaaagaggtgctaaaaaaatgacaggtttttcttaaaaaacaacaggtttttcttaaaaaacaacaaaatcttattcatctttccatattcagcatgaagaacacctaagagaattttccctatcgcctcatctccagggcactcaaagcatttacaatctcattattttatacaacacccattaagtgggcaccaaagattattacccttctttgatttctaagaaagcaactacagaaagtttaaacaagttgcccaaggtcgttcagtaaattgagatgcttggattttccattcagtgattgttctagggacatagtgcaaagtgactgaatcctctaaactcaccaaaacccctaagtcttacagatctcttccccatttctcaccactcatgagattttcatcatctaatcacaaatctgccaccatgtggatcttggacatgggtatcctaccaggccagtgccatgtctgcaagaagcctggtgctacacctgacagctttcaaatcaccatcaaatgattcctttatctagtgaagttgattctgcctggctgcatctgggaaatttttaacccctcgattagccattgcacagttggcttaacttggatgagacagaggacaaaatagtggtggtttaaaaaaatacctcccccattctgattacaaaggaggcatgattaacgaagtaccctttgtatccgagctccattctaagagaaagagaaagagctttccttcccccttttttgatcgctgagtcttttcctacttgtctcatcacccacacaatctgttcacagcccaaacagacaatccagccagtctgtggagagttcctaaaacatttatgttgtgaaagcagacaggatgaacaggacctcatctcgacaaaggatgatgggacattcagcaaaagagttcacgaagggaaatacagatggagtcccagagctgaatgaatttgcccacaatgtctaacacaatgccagcccttatgggtacttgtaaaccttctggtcaattcacagccacctccaggttttatcccccaaattccattacttttagaacaaagggttttaaaagaaaatacaattaacaagttaaggaggtccaaatcagtgctttaaggatccttcaatttctctagacctttaaacataaaaatagcaagttagatgaagattttagttccaacactaccagatcgggagttgacataatgcacataaaatacttaatacattgcctggtacatactaagtactcaaataatattacctaatattttcatcttacactgctctattttattaatgatgtttttatatatgtcattgcctgtctactcagctaaatagttccaccttatctgtttttggtataatccaaaagataaatgccttcatataattatcttatttaagctttcagatctatagtaggttacagatgagacagtaaaagcaagactaggtctcatagctggcaagtggtagattcccatactgagatctcaactcactaatttaacatccagtgctttatttcaataacaccacagatgaacagattatcatctctcgtgcctctttgtattcttcagaatttagctaagcgctaagatataccttaatgatcatctaaaataaatttctaatgataggtaacctaacatgtctgaagatttattttagtgcctttaataaggaagaaaagaaatgggtggaaaagcccaaccatacttggctttgaggaaagacatgcctctgtttttatttgccaagggaaagcattaccaggtccatttagaaagacaagaggaagtaaagccgggcgtggtggctcatgtctgtaatcccagcactttgggaggccgaggcaggtggatcacctgaggtcagaagttcaagaccagcctggtcaacatggtgaaaccccgtctctactaaatatacaaaaattagccaggcatggtggtaggcgcctgtaatcccagctactcaggaggctgaggcaggagaatcacttgaacccgggacgcagaggttgcagtgagctgagattgcgccattgctctccagactgggcaacaagagcgaaacttcattccaaaaaaaaaaaaaaaaaaaaggaaagacgaggaagcatgagggattcaatgatataccaaagagataaatggggctagagccagaactcttgatactctgctcatggctttctgtattaagttcattattaatttggcaccttgagtgagatgaatcttgccttggattatgcacatcaagttgtatttcagatggctgtcccatactttaaaggcccataccaaacccccatgtatcaaaaaaaaaaattatctgatctaaaaaatgcctagatcccttagcccttaacaacaaactgtcttattttatggatcttgtcttcccaaatttaagttgctggagggcaaaatccatgtgtttactccttctgtagcccatggctaacctagttcagaacttgtagcaacgtgtgctgctcattgcttcctcggcctcacagccttctagatgtcccaaagaaacctcgagtcatcataacatctactgaatttcccaaccatccccagcactactgctcggcttgggcagtcattaaagcttctcttctgccttcaggatcttcatttcagctgctgggacatcctgttgccatccatttcacacagacatccagcccagcaggaacccgtgttgcaatgagctttgcttcaaagccagcagcctggccaagttccaggaattgtcactaatgatcttcaccagcaacttggtgctcaacagtgatctctgaacacacacacacacacacacacacacaccccatttccaatactgctctagttagaggagctgcctaacagaggttggttccataacttattttattctttaattgttacagaggacttatttcatcaaaataagctaactgtccaaatacactctgcaatgcagcagtggcctccaccaacttactccttttttttttttgagatggagtctcgcactgtcacccaggctggagtgcagtgttgtgatcttggctcactgcaacctctgcctcccagtttcaagtgattctcctgcctcagcctcccaagtagctgggactacaggcaggtgaaaccacattcggctaatttttgtattttttaatagagatggggtttcaccatgttagccaggctagtctcaaactcctgacctcaggcctcccaaagtgctgggaccacaggtgtgagccaccacatctggttccaccaacttatttttaaactgaagaaggcataacaagtgtatcagtttcttttggttgtaagagacaggaaagcctgctcaaagatacttaagcaaaaactaaattagtaagatgatactgaaaaatatctagagataaagcagtcttctagtggttgttttgagaaatcagattatgtcaacagatctcacttctctacagtcattgaattccaccctgtattttattagcttcattctcaggcttcattggaaagactccaacaattccaggcttatattctgtgagttgaaattcagtaagaaaaagagaggacatctcttcctggtagcctccacacaagtctcagaattcactctaattagactaacttgaggcataaatccaccgtggctagtgcttggcttggtcacatgtccatcactggaatcagaagtgaagattctcttaaggcacatggactgagagtggggaaaaaaatgctccacaaaggagattcaggcagatcctgctgccaaaacaaataggcgaaacactaggcagccaaaaaacaccaatcatcctctccaataaatcttccttcttttcctaatctccaagaagttgtattactgggatgatccaactttgaaaatagtatattaaaagaaaggaacaaccacgcaagtcatataaaaatatatgtagccagtaggcacatgaaaagaggtttaccattactatcaatcaacgaaatgtaaattaaaagaataagatattatcagcacattgggaaacattttttaaacaaaagtaatcaccagtactggctaacatgcaaagagatagacattcccagatttggctaatgggtgatatgatgattatcactgaccatcaaaatccttaaaaatgtgcatttcattttacctaagataaattcacaaaagtgaatttactaaggaaataataaaggatgtacataagaatttaaatacaaagaagatttctccagtattgtttataatagccttaaactggaattattctaaatgtccaacaatagattgagcaatttaattttatccatactatgggttatcatactgacactaaaaataacctttcaatgcatgtttattagcatggcttaaataagtagaaaggcactatacaaaagaattaataaagtgggcaacaatagcatcattcactaactaaacccagtaaattagtttcaccctcatctcctaggcactccctggttccttctttaagatttaccctggggttctaaagacccagattccacccggggaaagagaaaaactctggacaccctcagcaggctaaaatgtgttgaataaatatgtaaagagagaatcaacaactgttcatgggaatggcttgctacacagaggagggtgaagaagatggaccacaactgtcatttacttgtcctggaagagagctcaaaaagaaatgtttggccaatacacagtgatttctatcacaagtagttcatattttttaaaactactcttttttcttgttcttcaacttgtcataatgtagcaattaatattcaaatcccgagttattccttccacaaacatagctactgccttgccaaataaaccataccacaaacagttactccccatctcagttttcataagtttaaaatgtaaatatccctgatggactggcctatcttagagtgttgttgggaagatcaaataagatgatttctactaaagtaccttcaagaaggataaaagcactatacaaatgtgaggtatcaggtgtatcagtgcattacgcagatttcacaaacacacaacagagcatgggagagttcatggcaagcctctggctcctccattaccctcatgtccttttccctgcagtcatttcagaaaaccagatgtttgtttgcaaagtttctctgcagcaaaagggcaggccctctctacattcaaattggctgaagctgtgtttctagctgttgaaacttagacaataatgggggagatgccaaaattaatccaaaaagcagacaggcacactttacagactggagccctgagatggaaaaaggcagcagcatgaacaagtagagggttaatggttttcatattatttaattcaagccgcaacaatgacagattctaaagatataaacttctgagagtgagcattctttcagaattagtatacaggggtcctattagcaatattttatatactccaaatatcttcccaaaggaaatcactgctgaaaaagacaaagttctttgttggtagggctgtgcgtttataccatggacttaaatacttttcttctacagtctcctcattttaaaaaatggcaaaaaatttcaataaaacatggatggagcaataagaagtacactgaagttcttaaatgcccttctttttaaatccccaccccaattacgtccctcccttgaggatatttacagtcctctatgacacatgctctgtaccttcttggttcaaggaaaacacacctacagcatttcaaattaactactgacccttactctcacactataaacaaacccttttcacaatctcaattgcattgtgtccacattgattaaagcttgaagcctggtgacctcatgtggtgttaacttctcccatgcaccaacagcattccgcctttctactcaattaccccctttggtgccagaggatcgctacccaatgaacacatacaatggacttctgcttcattacactaaccaacagcaggatagaaataagcagaagaggaataaacaagctaatttatcatgaggacagagcaagctttcaccagtctcgccatggaaaacttcagtggttaacgggaacatcaatagtctgggggtgatgtttatgatcttacagattatggacaaagccataacagaaccccaaactgactgaagaattctgcagattggcaggtgtgaacacacgcacacaaaacccatgccttaaaactccggggtcctacataaaacctactcagtaattattttgggaagcataaccctgggctttggataacgtgggctgacactctggtaatttgctccaactgttcagcttaactgtggggcccctcttatttatctttgacaaggtggtcaggaggaacccagcccctttgtgagaggggtctggttcccccaccgccccctgcttcattaggcatggcaaggacacagcggttgattaaattaacaactttggagggcttcagtcccagttcccagacattagcaccatcatccagaacaaattaaaagtctcacagcaattaagcagattttgaaaatgaatttcccatggttcaatggctcaaccacaatcttgagttaagtatcagagaagagtattgaaggaagagaagaggaactgactgctgaaattccaaagtaaacatacaactggtagaagcagcatacacaataaacttctgagcctctgctaagtaggcttatacatttcttttatagaaaattggaaatattcagtcacataaggggaaagaataaaacattaacatagaatggttgtatcaaaatggtggatttttttttcttttttctttgtttttaattactttaacatcattttattcttgttcaaaaatataaatagatattgagaggggacaaaaatacctacttccagtcacaggcttttaaattcaaacaagaaatcgtacatccaagtctggaactggaatcatctatatttctctgaaccagtacaactaggttcacagcaggcaaagaccttttatgccagcctccaaagaaccctgggtgggtgatttacctctaagaactcatttctggatcaaaagaataagattaatgataaaatcatacctatcacattctaggtgtgtactctttgccaggcactgccgttttgaggccttgtcatacttgcttccttccctttcagtttacatatgctcctttaatccctgttcccgcctcgcacctctgcctggctctacttgcaagtcacaggcctccgttcctctttgcctgcaggcagacatttggcacagcttgtgtgcaggaacctggaggaatcctgaaggaatgtgcgaatgaattcattcccactcaccagatctataagctgaagacagtggaatgcagaggtagttacttgaatgaactatattttcctgtcaagggcatttataaaagctgacatcataaatacattattggtctctaagtacaactgtaaataaatctacaaaattcttagaaggataactttcaaagatttgtttttcatctttaaaagtttatagaaaattaagcaaactatgtggctcttctaaaagaagccccttcaaaatagccctcacggaacagaagaaacacatttacttcttaaagacagtaaatctcaaaatttgcattacagttcaacagttccatttggatattcaaaatttggaaatatatatacttctgtgtgttcccttcttcccactaaactttaatcaactagtatagacaaccagccacagtcaattatctggctttatggccaagtagggaccaaaatatataacccagacataataacaatcagcataacagtaggcataggtaatgaaactctccgctagtggtcagaaagctcagttcaaaccttatttctcactatgtcttccttggaccttagtttccacaatataatggaaaaacgtccctttccaactccaaaattgtaccattttagaaatgtaagcatgtatattatgaaggtaacacaatcttttatgttcaagtgaataataaaaaccctcctcccatttaaataataatagcctggaatataatgttataaaacttagggaggacctcaaagccttaaagtagaagcattttagttacctccacaataggtccaaaatgcaaggcattcatctattcacctcttcaacagatattattgggtacctacattgcattgatctgtagtaacagccataaaggtgagtatattagaccatcattattctcatacagcttacagtttgacagaggttatattttaatcattattttttgtttaaaatttcttataaactataattctagctaatgtttcagaagtaattaatattttatttttaaaaatcatttttcctcaaagtttgactttaagaagtctttgtcattcacgttattatctagaagcaaaaaaatttcccagtggatgatgactccaattttataatgtaaaacagaagtacaactgggattcacttcgcagcaagcaaagagggaataaatctcttccacataatgagtgatatccatttaaaaaagtcatgctacctgggcttatctatgctctaaagagccatgaatactggcccagaattttaaaagacaaacatttagattcaaattaaatgttggttaaaaagaggaaaaacaacccaagttaattactctaatttaccgaatatatgaatgacctgcttattggactattggctagcatagatcttgcctaataggaaggctatcaagcagggtggctgggtttctaattttatccaatcaattaagaggcagaaataacctgcccattgaccttacgagacacaagttgactccagaataaacaaacaaacagacttgaaaagttaattatgggcaacctctccttcagagaaatggctcacatatattaattgatctaacacctatgtgcaggctcccaagaagatggaactcgttctctcatttaaatcccacaacccccgtgactcagagatttttggttcaggaaactgaggctcacagaatttaaatggttagtctaggttacaaagcaagtttgataacaaagagataaatcagatcactgccatttatcaaccataaaaccacattccatcagttattatagaaatccatcactttgaatggagagatcaagtttctcaaggattaagcttctcatttaacatgaactatcaaatggaaaacctcgagccaacacttatttttatagcgtgactatttctcaagaatcctgtaagaagcccacatcaagaggcaactttcaaaattactaaaatttcaaaaatttcaaaattacaaaagtaacagttctgtcaagtgggaagagttaatgcctttcctttacagagctgctttatgtaactagccgaagttttaacatagaaatattactgtttcatatatacattaatcttgactttgttaaaatcccaaacatactgctcatcgatctcctaaactttctctttttcaagaagtaggtgggggagggaaggaaggtattggaggaattcttctgatatctgtaaaaacagaaacaaatgctaattaaaagatgaccttagtgccctttcagtttaaaaatcttgagcatttacaaattatcttttttttctctttcatcaactattacccagaaataccacattctcatagagcaaagctctgtcctgtttgggcatgttcaaagaatagtgccagggatttaatactggcatgctcatggacctgcaaattctgaaattcagggggaggcatgaataaaaagatagctgaggtcccacagttgcctgtcacagccaagccccaccccacccacatcctcatatgatcctcaagaagcaaaacctttctgagatattctataagtgacagcaaggcccaatgtgcagtcttttcaaagcctcagtaaaaatcttatctatgacttcacttagcccagacacacaggagctaaaaggtaaaagcctggttcacacaagccagaactagctcaacagaaccgaaaaaagaaaggaatgtcttttctatatcttttccatgtctgaggcattctgctctggggcaaattacaacctaaataagaacagataaaatatatgggaactgagtaaaagaaatagaacctcaaaaagggctgctctgcctggaaagaaggctggaattcataaaacatggaacgtaacttttttagtgatcacctgaaggcaagcttgttaaacagagacttaaaagtcaagatttatttcagctaaattagatggtgcagaaaaacatagtgcttcgtgactctgctcagtttcaacaaaatgaaaagacagaggaggaagaatttacagtataatacttgcaccactcaaatcacaaaaatacacttgttagtcacaaaggaggggcccataacattgtaagccttattttggcaatgtgaattttctgcttgcaattaccttcaaagtgaagaaatggcagagacgaagaatgaggaattttgttgctgcttttgtatgtaaattcgaccaaaatatatagtgctatgtgactttaccccaagctcactagaacttcggaattatgcctgccacaaacatcctccgaaagcacaagaattagtcatagatttttttagtcaaggaagcctcagactgataaagtcttaaaactagacgcaaggactgtgctttggattggataagtaatgactatactgcgtggttttggtgtgtgttttttagagttttaaatttacatttccccaagcaggaggaagggaatgtaccacaccctcagcaagcaaggaaggaatttagttgattttttttaaattctgtagtgttccttaaaatccacatagcatagcataacattctatataattctgttgttccataagggattggctaagtatattaaggatacaaagggaagggggagatgacaaagttattgctattttattttcaagtgacagaaaaatcaatcgagctataagaagcaccagttgggaatgttctgcacattaactctttaatagccttagacagaaatcagatgatcttcacactgaaactctgaaggacatatatctttggggcactgagtagcattagaaactgcgtccaagccatggctccacctctaattgcatgaactgaatggcttccctttcctgggactcgaattccttctaaattaaggtagaacaagatagtcttgaaggccctttcatccttacgatttaatactgacaagctcttcagcttctattcaggacaaacaccaccaaagtgtatggatacaatggattcaagtagccacactcatggacagtgacaaaatcccacagctttagggtggaatcaagtatcatattggcctagaatgtattgatgctgccaaggtgtggggtgggggtgggggtgggggtggggggcaggggtgaggtaccactgatgtgtgaaatgacttgcctaatatcccagagacccctgaatcccaggcattcttattctgaatagagacttttaatcaatttcttgtctcatcctatgtcctcatgttaccatacttctacaagtctgtgctgccagtgagggttggcaaatcatcccaactcagaaggacagacttacaaaatggcataatcaagcttcactaacactgtatataaagtaaaagtaatagattgagtaaaagcatgagagattctcttgggagtaaaatgtgcatgctttaggagaagatttggacttgtgttcttatttgttagttttctgcaataacattaatatttatcatttgggggaggttcataatgaaatacttggttatagcacaggaactaatgttagaaagcaggatgacctccttaaactttcaaacccaaaccaagtaaggttttgggtcattcccattccttctgcctcaacagatctacaaatctgtaggtgttgggcaaagtggtggtgactcaaagaaggaaaagaatggataataaacagtgtcgtgtgtaagtttccccagatctaagaacagagagggacaaagaaatgtaggagagatggatttgggattaatcaaatggtttcagtgcaaagtcctctggaaatcacatctctgataggcctggctcaatgagacactccaacaagtgtcaagtcctcaagatagtagattccagtgatattttatgcttgtagcaatccccatgaggaaggagggctctgtttcacatcgcagttgagagagggagtcaatgagattttatgacttttttgggatcattgaggccacaggttgtctgcagagtcctagccaagtttctctccactaaatgacgctgctttgagaccagaagctctctcttttggagggggtcagccaggaccaaggcagcagttaactggcctccaaccaactttcatgaggctggccttattaaactaggtctgaagaaaaactgagtcaaccatttacagacttattatcttctttctaaaggaaaatcataatgccttgccaaaacaaatgtaataacttggccttttctttcaattacctctgctttcttggaaatgtgtatctgtggataaaacctctgagttaacccagggaattaaccagatgtttaagaagaccctgtgattcctgtgggccagcaaagaaagaataccccttggccacattatgagaatggagtactaaggagaaagggggagcagaaaattaaacttgaaggcccaggatttaaataggcatagcagatagaaatgttagctcagttttgggggattgggtgacactggaagcaggttttggaaatccaggcacaagctgtgtccttgaaaagacagtctcatatatttccagagcccttcatttcattttcttcagtctatattctacccccatcttcctattccacatcctcattacactcccatttcttcaacagctaccttcaggacctacgatgtatgctaaatccagggaacattcagagggcccactatctcgacaaatttcctattacaactctaagccatcttttgctgtatgcaataatttcctttggggagtgttggcatgtaatttctgaggttcagccctccctagcatggcccagaaacactgccaatatttacaatggctggtgtaggcagttcttatgtctcaggagttggggatcccttgttaaggaagtaataggccaatgatcagtaaccatgcagtgatatgagtgcatggtttggggaaggggtggaagcaaaacgaaaaggtgggggggattgagctttcatcttctgctctatctgtgtagaatcagtttcaccacactcatccctttgtttcccatagaaatggaaaggacaatgggaggaaggtagcattaagcttaagaatatggcttaggattcaatcaaggactgtgggcttgagtcttagccctctcatttactatctctgcactcttatttactatctctgcaacctcaaaaaaggttcttaaatgagcctcagattcatgtgaaaattgaagaaagtaaagtatttacttctttgggttgatgtgatcattaagtgaatctttacatgtgaaacgctttccatagtcccccagtcttccaatatgattactgcttttgctcccctacaagatttagtcagggatagaatgtggggggtggggggaagaggtggtagtaagaggctatagaaatttagtatttttatattataaattatacatcattattttctttaatttagcaatccttttagattcatcattttatgagaagaaaacttagaaaacactaaagtttgagatcattaagtttgagaattggcatgtctcaagctcctcctctccttcccacatccccatacgggcactttctctagaactgtgcagagctggcacatttattaggccaccatcacaacccttcagagaaaaagtaagacctaaatgaaatagtcgtgatcatttcgtgtcttgatgctccctgtgtctcattacctctcagggtctctatcaaaatcaagggctgcaaatctttcaatagagaaatctattagcatattttccaaagaacaaaatgtacctattcctgctgtcagggctgctgtttgtaggagtctctggtttaaaaggccctcgttattatgcatgggtgtgcatacaaacaaaacttctccgcatgggaaaagaattttcagctttcagtaagaggctcttttctcaattcctccaccatcactaccaacctacaccctctaaaaacctctccaacctccactgattctttctttcctctcctttgaaaaagtccggacttactgtataactacatatatgttaaaatcaccaactagagaaaataaaattgagtaatattcttgcaagtagcagaatctcaaacatttgatggttaacttggctgctttagtcaattggatgattcatacaattatggggactggttagaacttgaatggaattggttggactggcacaggcaaacttctcaagacatgtcctcccctcagccttggcaaggcactttttgggtctgtacagctggactccatttcatttatcatcacatttaatattttcttccttttgatgttacctgattataaaaatgagaaatcagttttagtgctattctcatgtttccctgcattcagatttttattcaggcctaaaagtcaaggttttggggaaagtgggaggatcacctaaagttgataatctaggctctgatgtccgattgactggagttcaatcccagctttgaccacgagtagctaggtaatcttgtgcagttttactagatctttctgcacctcagttcccttacatgtaaaaggggtacaaaaataccaatttgccaaggttttgtacagatgaaattagacaggctttggcacatattgcacattcaatacatgttaaacattttatcattttattaatatatctatttcaagatgaaatattaatataattagttgatggtataattagtaggggttctaatttcatacattctcgaattcccaataaataagtgaaaattatcttgatgctagaaaactacatcctaggaaatcttttgttgtaaacttagatgacgaggggctcttttctacccacagctcccctagtttactcaagctccatgtctcctctttaccaaccccgtgtcggcatgtagccccatcctgagcacacagtacaccctaatagatattttgcaaatcaggcaagtagcacacaggagttttaaggacctttatataatttcaacaaattcaaaattctaaatctccatagaaacacctttatgaggaatataaggtaagaaatatttctgcagtttatatggatttaaacattttaaggtcaaatcattgtaaaatgtcatgtaggaagggaaggcctgaagtctcaatctgggtttcaggcagggaacctgaaaacctcacaaagccacacataacactattagctcaaggaaatgtttctcactgtaacaggaaaagggaaagttcgaatagaagtctagacaggttgtactgaaagaacaatcagatgaaagagcaattcaagccgggcatcttgtgcctgtaatcccagcactttgggaggccgaggcaggtggatctcctgaggccaggagtttgagaccagcccggccaacccggtgaaaccccgcctggccaacctggtgaaaccccgtctctactaaaaatacaacaattagctgggcgtggtagcaggtgcctgtaatcccagctatcgggaggctgaggcaggagaatcacttgaacccgggaggcggaggttgcagtgagccattgcacttcagcctggctgacagaacgagactccgtcacaaaaaaaaaaaaaaaaaaaagagcaattagagattgttagcatgagcatgattacactgcaagaaccaaatagttaagttttttttaagtcaaatattgtaatttcaattactcttttaaaaaagagtaattgaaaactctttttaagagtttacaaaagagtaaattaaaaacatgctcttttaaaaaagattaatttataaggttgcacagtactcctacaaaccacattagatacttctagtagttaacaaagaggaaaacaatgacattttacaaaataaaaagcagaattgaatacagaaaaatatgacttaacatcaaccaaaaaccaattgattaatcttgtcaagattcttgtcaagattctcaccagacacccaaatactgaaggattacaactattgcatcattaagatatattaaaagaaatgcaacaagcttaaaatctaataaattggagagtaaacacatatactctgcataactgtaatttaatttcttaaaattctgcaacttccaaataaacaacagcagcagaaacaaaagctcacataaatgggtcacagtaaagaccagttgcctccacttaaacaatactagcacaatcgtgtgggctacatccttgaaagaagtagataatccatgcacaatttgagaaaattgattacatatgtgtgtatgttatatcttatacagtatacattacatcctcaacattaaaaatttaaaaaggccactcacataagttaccttttggaagaaacaatgatcttttctaaagaaataataattggtgatttgttgatacttacagtttatgtttggaatagtctcatttatgggtatgctgaaaacaatgcaacaattttctattaatccagttctgatcttcatactcttagcagttttagaagagctgagaacagtgacctgctttttcaaccattatatttctgagacatgactaatttgaagctgagcaaattgcacataatgggattcaagttcatgatttttagtctgcactctcttttcagggtacatggtctccttccctccctgcttctaccaccacccccaaagctgccttttcaggagctaaattcacccaacatgaaatcaaaagagaattatttttaagttttctgcaggcttatttttaaggaggataaagttatatttttaaaaatatttatcttttccttcaggtactaccgcatttttaaataatttctaaatatttagaatgtatttagatgtatttagaatagtagatgtatcagatgtatggtttcatagtggctcaaagtttttaaaaaagcattatataaatcagtgaatttataaataccctaagttctactatgtaagatgttgctttcagagcctttttgcaaaatcccattaaaggtttagcttacagacactggtgccaaaaaaaaaaaaaaaaaaaaaaaaaaaagcaagcaaaaaaatgtgtttttttttgtttttttttttttttggtaagaaggatgttgaaataggagaatatttaagctggctaaaccaaagccaattcctggaggctagttgcttttatagtgaatgtttaaattttctccatcaaatctagaaggctacaacgaaacaacagcctaaatgtcatgtacaattctctaagtactgaaagagttacacaattttagaaccgaaagggaccttaaactccttcctctaccaatgaggagcctgaagcctgctagttaactcacttgcctggtcactctggggttcacggattgttattgtttggtggggtggttgtttttgtgctgtatatttgtgtgtgtggtgtatgcagtactcacacccttacaaacaagagctttgccatttatattctccccttcctaagttgctcttcctaagtttactttcatcagcaaaaagagtgatcaaaaagaaaaatatattctggccagttcaaaggggacatttctttttctcacttggcctactgcagatatattagagagacacttcacacccaggacaactgactttttaagtggcaataacaatgagcagcggaggagttctcttctcactcgagagagcagaggaggtttctgaactttaccttgacttccagcctacaaactgttccttcaactactgtctccgcttgcccactttgttgctattctttccttagtttcctttgttttccagcttagggaagtttggtgggaaaatttttcacttacattttgttgatatttatttcccatatttgggtcctacccaaattttagatttaagagcaaaaaaaaattactgtttaagtgaaagaggaaaggctaagtcactgttcaacatgggctagatctgatctgaattggagacacagcctttgcaattgaggaaggagaggtaagcagtaaacttatacagtttcctccaagaagtgttatacatagatatttttcaaggaaattggaataaagcagtttattaattgaggggaagctagttacagttagcacctgccgcggactttttgaggttgtcgtcattaaccaaattcttcgggaaaaacaatctttggcaccacttactccagacaaaccctgtttggaacagacaagtgttctgaccctatagtcgctccaatgtccaccagccactcacgagtgcccttagggcttctccttggtggtagcatcccagaaatcctactagtttcagaagtgccctaggaagcctacttcttggataatgggctctgtctgcaaagctaggagatcagcctagaaaaagaaacacaccaacaaacaccaggaaactatgtgtaatggtttgctgcttgtgcaaaaacctcaaagaggatgaaggtcagacagggataataggccaatttaattctgaaagcacaaggtgcaagaaattttaattatggtctgccactgaaatcacacaagatccaatggcatctaactgcaactgctcatcaagggagacaagaggtgtaattgtaaccgctgcataatcactgtgagggcacagggaaggctgccttcagctcccagcagagaaggtattaagagcctcgaaaaatccaatacggggaaacgagattgcatgtagccaaacagaagctcctaacacaaaagccaacccgtgtgtgtgtgtgcgcgcgtgtgtgtgtgtgtgtgtgtgtgtgttgagggtgagggttccagaaagaaaatgtgaagctgtttggcccacactggggataagagattgtttgaaaactctgaacccttttctgttttgtggataaatgcacacagagaaaagagcactgtctcctttaggtatttctctccttgatgaagcttcacccactctcctttgtttaagacaattggcttggatgttaccgtgatttacagtaccaaactccctttaatttgttcccatcaaacccaagtctggagacaaaacgccaagcacacgactggaggtgcccaagcctgtgcagctctggcagcgacgccgccggcgcccccgggcgttttccccgcaccccacatcgcgtgggcgcccgtaaaggcacgcgcggagaaagcccctccgtggactccccactccgcaaagtttaacaaagccgtgaagtaaggaaaccgaacctcccgtccgcgcccgctgcaaagttggcattgaagtttgtgccgggatgtcccaaatcttgagggggcggggggcgcgagtgtgcagagaggcgggaggatggatgcagatggggagacagtgaggggaagggagtttttccgagtggacggtccgtgaggcggttttcttcacccggaagcctgtttgactcagagaggtccgggaggtgcacgccaggggaggtctcccggggcgggcgctgtcgccgaggaggccggcgagctgtcacctgcggggggctgtggtgggagctgagggcgctctcctaagcgccaaaagaggacggggacattcacagtcaccggctctcggggctctaagtagtgggggaagggatattcacgagtgggcaggaggccaaaagcaacacctttcggatacgcttttcccctccgacctctccaacttcccgcggcgctggtcaaggactccctcccaccccaccccatcccacccaacctcccggccgacaattcggacctgtccacggcagagcgtggggtggagtgcggcgggaaagcagagggcgcgaaggtcgggaccccaaattgcaaaccctcagcccctagcaaagacgaccaaatgcatttacaaccgtgcaagtatctcagccttgtaacagagctccgggtttgcgccgggcacagttccccgactcttctgttgttcctaataaagtcgattacgttgccctcccggagctgattggaagggaaccgagaggaaaagggggggaacgcgggaaaaagcgggggggggggggggcgagcaatcaactttgtaacccagcgcttcctcgcgcgatccgtcgccatgcttaagattcccacccccgccgcccccctcttgcctttcaagtggatactgaaactaggccaaaactttttcccctccttttctcttagccactagactggattgtgccccacggagccccatggagctctgctttcttaagcacaatagccggactaattagatcatagaagcaaggcagtgatactgtaacaagtagcccaagaggcaaagagggaaggggcccgaaaagacagaaagggggaaaagtttgcagctctccgcacttaccaatcaagcctcccaccagaaaggcgatgatttggaacacgagcagaatcccaccaacaatgcacagcttcttggtgctcatgttttctataattgccccagccatttttgcgccccccctttttcttttctccttgaaataaatgttttagggtgagctttttgctccctcctctcacacactccctccttcctcgcctcctttctgggcgctgcaaaacttcagaggtgctggagcgcggcgaggatgggaccgggacggaaggcgcccgcacggattcccccggcgcagccggctcgggttcccccaatgcccggagctgtgattgtggccgctccgccgcctgtggacg

SEQ ID NO: 846 - DNA, 423695 bp, Homo sapiens
taaaggagggctctcctccggtgtggaggcatcatggccgctaaatcagacgggaggctgaaaatgaagaaaagcagcgacgtggcgttcaccccgctgcagaactcggaccactcgggctcggtgcagggattggctccaggcttgccgtcggggtcgggagccgaggacgaggaggcggccgggggcggctgctgcccggacggcggcggctgctcgcgctgctgctgctgctgcgccgggagtggcggctccgcgggctcgggcggctccggcggcgtcgccggcccgggcggcggcggggcgggctcggctgcgctgtgcctgcgcctgggcagggagcagcggcgctactcactgtgggactgcctctggatcctggccgccgtggccgtgtacttcgcggacgtgggcacagacgtctggctcgccgtggactactacctgcgcggccagcgctggtggttcgggctcacgctcttcttcgtggtgctcggctctctgtcggtgcaagtgttcagcttccgctggtttgtgcacgatttcagcaccgaggacagcgccacggccgctgctgcctccagctgcccgcagcctggagccgattgcaagacggtggtcggcggtgggtctgcagccggggaaggcgaggctcgtccttccacgccgcaaaggcaagcatctaacgccagcaagagcaacatcgccgcggccaacagcggcagcaacagcagcggggctacccgggccagtggcaagcacaggtctgcgtcctgctccttctgcatctggctcctgcagtcactcatccacatcttgcagctcgggcaaatctggaggtactgtaatgggtgggggaaaagggaggcttgctgctgctactacatccccactgctttgcttttgcacggaaatctttcagggttgctttggtagtaaccctagtcacactcttccagttttttgggtttcttttgaactggggcttgcatttttaaaatttgcaatctcagtctagggtgggagggaagtgagaagcaagggaaggacagcaaagtggtttcgatcacctcatcccttctgtcttcccactctgccttactggcttcttgctcttggcatgccacaacccccctccccgcttccccatttttagtgatattgtttcagtgagtaggagaggattcctgtcacatcttctaaaattcctttattattatattgaatttgaggtgtgtgttgccatttggatggtttcttttgttccctggggaaaaaaaattgctaattctagtgaaatgggagttgctgctgctcaaaagtacccacatattaatgatcactgctggagaagtgctttactcaaagtaaagatcctaataggcaaatgactttgtatatatatatatatatatatatatatatatatatatatatatccccgagcatgattcagtaagctttatggggcccagatttacttttagagtgccctttctgattatcttgcaatatctccatatctaatttctcatataattacaagcctttggaaaaggggtggggcaccatgttaactttagttgtacttggtatcttcgttggctactttgctgcttgtcatctgatctaccaagtctttttacacagggatcacttcagttataaactggaatacaaggctaaacttgggcagagggaaaccaccacttgaacagtcactgcatggacttaggagcagaatgaaatagtatgctcaggaatacattcttttgacttttatatgctactagcagatttcgaagcaatattttacatctataaaaattacttatatggaagtctatagattctaacatgtcagagcttttttggttttaaaataacttagtaaacaggtggtataagcgaaatgaggacaattcctagaaagtacaccaatatgggactacactctgtggtactggtgctctttttcaattttatttgtggctatttttgtgataaaagatgtgagttcttgactatgccgaagtatcacctgtggaaacaagttagaggatttgtggactagaaccacaaacttctttttatttatgatgaacaaccatatgttcacctgagaagagcaagtgtggtgatttcacaacctttcctgggaccagagctttgtaaagcagactgaacattgccatagatggtgaccttccagattgtgaaacattttttttcaagcacacactttctgaaaaagtgatatttgatatgtagtcagacaaattgatgttggaaccttcatacatattttggactcaaagtaactttttgaaattctagttaaatatgatagctatatttcccatggatgactattgggaagacttatagcttgatgctcttcaagtatgatgaaggacttaagtgcttaatttacttactgaaattactgactggctaggatgcatctgattagcatttctaatctgataatttggtaaattaagcttaacattccatttgttaactttttcaaactttatcaagatttggaaatcacttaattttaaccacctttcaagtttctagacttatgtaaataattcaaatacttctctatcctgttaactgaaaaactgtaattttttttacagattgattctttatgaaaaatctgatattaaattctgtgaaccgaggaagtccttttaattatagttgtgtttactataccttctaaaccaaacatctccccaattgaaaaatgattcttaattttctaggggaataatatacagaatgtgagaaataattaggaaaagatatgagcctaaaaacatgtcagagagaccatagccactgggccaacttatcatacagaaaagttatttcagaggtagggagtgggggcggggagagaagggatggaagggtaaggtttgaatgtagaaagaaaaccgcaggctgtcagacaaatgtattaactgacccagacttggagaaactgtggtcacacatggctccttttagttaagcatttctatagtattttccttagaggctttaaagttaatactgataatgcatgatcatctaggaggaatattgtagttggaaatattatcagatataatattctggaaatatttgtcaacattttcagaataatgtgtgtagtagataagtttgaattatcatctaatctaactattctcagattctgattaaaatatttgggggatgccagagtaatctggtgaaagcgtgatctaagactaatcagcatcattttctgtttatgaagtatatttttcaaaaaaacaaaactttagcctaatgtaggaagttggaaagggataagaaagcttatggaacttaacactcagatgcgctctaatatgtttctatttctctgagtgttgaacattcatgtggaactttgggggagtagacgcatctttgctaataagccgacgaagtgcaactcatctcagatttttctattagactcactatgattccttaaattagaagcatccctgtgcctcttctagcttttcttttcaatacattatacacaaatattgcagaaacaccagagtactgagtggttcaaagcacagaggtcattattcatgttttaacatgctactttctgggatcaataaaatagattttagctaggttggtaactgcttcttgtgtttccatgaaattctaattattttagggaaggaccagattctaaaagctttctctaaatacagtcttttgaaataacatcaaagcatttgcttgtttagaaatagccattgaaacattgtgggtaagatttgcatgtatttatacatatgttacaatgcaactgctaaaagcaatgatacatattcattttaattaaagtttactaatgggaaattaatggcagcttttaaagtcgcaggaggtgagcttgggaaagagctatttgaaataataaagtgaatttttgctaccatgtgaaaagagcaattatgactttaaaggaactgtgcctgtgaatgaatgcgaaagtactttcctttcttatttttctcatatgattccagaaattactaagagtgcagtttagccagtgggaatcacaaattccctaagagaacagtttttagtcctcatgcttttgatcaattgcctccaaatgtctttttccttcagaaattatgaagtttactcttaaaactctacctgaatttctcctatgtatgtatgtacatagttaattattttccagaaaatatgcacattgtaaataatgagtcagtggatggtagagtggggagcattttcactattcttactcttctgggttttgtttttgagtctccatcatgagagtcatctgggaaaaatgtgaggaaaatgcagttttttctgctcttgtcatgcttgctattccagaaggcactgattgtgtcccatgttcaaataagttgggaaaatgacagattaaacaaagttaaacagctctctctacagcaggacttctcagagccttttataagctaaggtacagttatcagttaagtttttaaagtcacatctattaaacattcttataatgatgcatgcaaagcacttggataaatatgccattcttaaaactggccaaacaaaaataataacaattttattggcactttaaaaatatacaaatgtttttttctactttttatgtcatctacattttaaaataacctaaaagaaaattattagtatctgtatatgtgagacaactgtctcagagaggttaagtaagcggcttaacctcttaatagggtcacccaactattatgtagtgtagttaggattaaaaacggggcccattttaccatacagtctatgctttttctggctgaactggctacctccaaatgccaacttggataatgatgacaacaatgtataaaaataacaatttaccttcactgtggatggcaaagtgggaaagggagctgcagtttagatggattaggggatctttccaataacacactggtagttaaacagtaaaacagagacttgagcttagctctttgaactcccagttcattgcctaacttactataccatttggacatactgaggttgttttattaaatcccagctaaggaacatgatctcgtagtagttttaatgattacatggcataatgtatgtgaatatgtgaaaagttaattacaaatgataaagaggttctagagataaagaatgggtagaaaaactaaggaggatataggttacacctttgactattaaaaaaggtggtcttcaattctgagttagtcctgaattctgatatagattaggcaagattggtgccatttgctgagtttatcaaatggttattttctgcatatatgtgtttcctctctatacatataaattaattagtcattcaacacacactgagcacctgctatgtgcaaggcactgtgcttgttactaattattccaagatgaataacatatatatatttcaaggaatctactctctaatagggaagacagaaaagtcagtagaccatctcaatagaagaaaataagcacgatagaaacaggaaacgcaaactgccttgatggttcaggtaagactctctggaagaggggatatctgagcaaaggtttgagggatgagaaaaatctgctttctgagtaaagtgggacattgactttagagccctggatgcaatgtgtaaaggcagagaggcaagaaagaacaaggcaggttaagtgcatgctctacatatggagtgagggagggagagtagctagagatgagatgaagaactagttgggccagataatgaaaggaatttagattgtattttgaaggcatgaaggagtcatgaaggattatagggggtgaggactgttaagaaaagtgttaaaacactgttttattcaaaggaatggcagaaagttgaaagcttcagaggctatgtcattattcatctctgactcagtcatgtctctgtcattcatggaaatctattggcttcacaggctttgagtttggatgtcattgggacatataaatagacccatcataatgggagagtcatttttcagaaaaacaagttggttgaaagttttaattgtatttatattaaaataatattaaagtaaattattggcaaaactttctttggtgttactatttgaagagttattttcttaggatacagtggtttttaccttattgaaagttagttcttctgatccatagaaatatattccttatgtttattagtcacatttaactgtccagagagcttctatgttctatttcttatttgaccctttgaatgatcttggaggtagcacttctattttgcagatgtggaaattgagagagagaattttaattgttttcctccttgggtcatatatttctggacagattttaagctagaactcaatactgatatgggaggggtgaaagcaacatggaaaatggctgatggtactgaggatgatgaggtagaagagaagcccgaaaacttgagagctccatagtaagtgctgaactgttgtaacctggaagaggcattggacttttgtgtaggccccctgggacaaaatgggtgggacctataggaagagattttgaattgatggaaggaagaagttttttagtagtcgaagatatttgcagatcaactgggcttccttagaagcagtgagtttcccatcactggagtgtcgaagcatagtcaggaaaattaggtagagatgtggtagagagactaactctcatacagagggttgtaccagaagatcatcttccagctctgagattttgtgataatctccatcataacatgctgctccaaacatattagactaacctttgcttttttgtggatgaaagaagtagaatgaattttcgtgcaacactataattgtgccactttaaaatctattcgttggtttatagactcagtatcttccctggagcatcacaaatccatatgccacccctgagtgctggctttggcatcaagatctctgagttagctgacaggtataaatccacacacaatcagacagctccttgtgcatttacctgggtttctgtatgaattggaataatttatgtataaatctctgtggtgggtatatctctgtgatgtctttgcaataactagtgcaaagattgtaaattttttccattcacttgaactatgaagtgtttacttcacaagggtaaatatttttatacttattactccccaaccgactaacttaacagaacagttgaatgtgtagcatctgtatacatgtatactatcagttttgaacaatgtccacaaatccttggagcaatagctttgaaagtctttgctcaatctcttacaaaatgtttcttcatgattgagtatccaagcacacaacttgctagtaaatatattttatatgttacagtttgaatgatatagtccacctatgaatttaagtaacacaatcactgtctaacaaataatgtactgattctccttcacatggacttactggctaatctgattagtacatttctttacttactttagaaatttgtatggaacaactaactggacctatggaagcaagaccagagattagagttggatttattattcttatgcattttcacataaaaggctcagtatggtgctagtcaggagggaatgttttatcaggtgtgatcttgcaatgtgtaattgttgttggaatttagggaaaattatatttaataatactctataagaaatattctcttaaatggcattgcatgattctgaccaccataacaagtgacctcatcccaacaacatgatggtgtccttggtaagtgacagcatggctggtcaggaaggaagaccatggcaagttctcatgaagttagtctagtggttgtggaacttaaggtaaaagaatacatactcagtgaatatctgctgatctgtgaatagaacccaggcactattctttcttcttgatgaaggtgtagctaaacttactacttagtggcttctctgagattctaatggtgtggtgaatcagaaaaggtgcaatgtcatctgggaaggataggaaaaattaccccagctctttttttagattactagtgttgggaaaataggggtaaattttgtgaatcgctagttacactctgagaaaaatgcagctggaagcccagctttgtattcctggttttgctgatagaatagtcagggtggagaagctatctgataggtatttttcattgaattcttacctatacttgactatctgaaaatatacttatatatggaagaatttttggtattttttatgcttcagtctactcaaaacgtttgcagcctccactgttactaccaccaccatcatcactgtaattcttatcatcataaaacatcaattctacatctagtatatgtatagaactgatatagattgctgattgtaggagaaactagagaaagattaaaaggaaaatccctgaggtggtctgagtgacaccattaggtcttttttaaccctaaaatagacggagagggtcatagttagaatgtcagtgataaagcttatttaaagaggcatctgtccttttgggaattggactaaatatggggtatcagaagaaatgatttggtctccaatagcagcagattccaggcaggctacctgactgctctgggtcatgtgccattgtgggtgcagatgacacatacggcccagctcctggagcctcatagactagatcttcttttggtttcctccttctgggtcttaattttctatctgtatgatgcgattggttaaaaataatatcctaggttctttccaggtctaaagttctgattctgctcttattatacattcttttcacttgcctagtacctagggtatatgcactagaatgtctacaggtgttctaagaccactgttgtaggctttctctgtttatgtaagtccaaggggatatacaagggactttccagggttgataatattagtgtctaaactcccaggaactggcatggttcatacatagagagtcttaagcgtatttacataatgcaattaaccttatgtcatttccaaattttagctataatcaaataaaacaattttcattaaaaacacatatctacatattcgaaatgatgtcaaaagtcttccgtgtcactgattctaagatatataccatatagactggagaagccaaaattgccatctagatttcatgtggtgaggtatgcatagctggagtgctgtgattaacaaataagaacaacgcttcacaggcttgaaagaactatccattatgtcaatgagaaaaatggttgccagagctagatttgcttttaaattaaaagcttgtcctgggtcacactgtcactgatttaatattctgaaaattggatttaaaattggatttaaaacaaagatatgacatccaggcctatccttgttaaaaataggggtatggtgcactctgctagaagaacagagcattgcattagccttccctgagaactccctggggataggaattccctggattctaggttcttagaaatctgatgtgaagctgaacgatttttaaccccatgccaacatttcagatttaaaatttttaaaaaccttaagcatccgttttaaaattatctgaacaaagtatgtcaaactattttctcatctttatgattcataagtaggctgtttgaatcagttctacttcttttgtttaatttatacacatgccatatttccctgttggggaatccttttatataaacagagcagtgggcattgtgtggggtgagtaacgatgagtcaaatagagaatcatgcacatatagaagtaggatctatagggaacaccacttgaaaaagacttgagatgactggtttgacttcccctcaagtccattctatttaagaaggacagagttgcctttctgaatcaccaatctgacagatttcatccatgtgaaagcagtctgacttcttttatctgcagtacaggtaatagtcatgaataaagatctcagtctggggctgaattctttacttttcaggttttttttttttttttttttttttttagggagcagagagtcaataatcaaagcaaaggtagcaatcgtagcaataacatcaactaaatgattccctataacttctatcattagttcatggcatagtcactgtatcagtgtgacggtaacaatgaggaaatgatcctttagtgaggcaaggaaaggatttgtaaaggctttttttgttttgatagacttccagctcattaattaacttcctgttttgcaagagtaaaattaataacaatccatttttaaaatgtaggctaattccagaagactgtcccaaacagtttataatacctgaatttgttattataacataaattaagaggcatgtctcaataaagttttgtatttccaggaaatctactactcgtaagagtggcagtcacaaatacataccttgtgggattttcttcctgatggggtgatggctaggtttgaaaacttgagttctagaggggtgtgggtttccttacctcatcctaaggaaagcaccaatattagttgagttcttacttctgaaaagtcataaagagttacaattatttaaggatataatatctacctactttgaaataaggttgggatcaaatgagaaagagggaggaagcctgaaggttttatctaacaagcatgtccaaatactctagaaaatatcactgtgttgccttctctaatctgctaataggaaagtagcatgttgtccataaggcatgcatctgttagctagtggaagaaaaatttagccctgagagaaatgaacaaaaagaaataattttattccacaatcagagagcagattttcagttcttagaaggagtaggaaaatcgtactgacctccattatgagatacatcacagctaagcttaaagcagggcttcgccagccaggccaagctcctcttagatgagttttttccaggggcaaagaaagaaaaacttgagttgtgataatggtcaggtttatgaggtcaacttgatatatatttatttaatttttatagattaactgggtgcatgtacagttgttttacatggatacattgtatagtggtgaagtctgggcttttagtgtacctgtcacccaaagagtgaacattgtacccaataggtggcatttcattcctcgtgccccttccaccctcccaccttttggagtctccagtgtctgttattccactctgtatgtccatgtgtacccattgtttagctcctacttagaagtgagaagatgtgttttttgactttctgtttatgtcatttcacttaggataatgacctccagttccatccagttgctgcaaaagtcatgattttactctttttagtggctgtatagtattccatggcatctatgtattacattttctttatccagtctgctactgatgggcatttaggttgattctatacctttgctattgtgaatggtgctgcagtgaacatacacacacatttgtttttatgatagaacgatttatattcctttgggtatatatccagaaatgggattgctggatcaaatggtagttctatttttagctctttgagggattgccacactgctttccacaatgtttgaactaatttagactcctgccagcagtgtatgaaagcgttcccttttctctgcaacctcacaggcgtctgttattttttgactttttgataatagccattctaactggtgtaagatggtactcttgtgattttaatttgcatttctctgatgattagttgtgttgagcatttttttcatatgtctgttggctgcttatatatcttcttttgaaaaatgtattgagagcaccagtggggtcagcagtttgtgcatgtttgactgagaattttatgttatcagaagtgtacaggaagtcagagtccagagggtgaaggccaaagcacatcatcacaaatggggccaaaacacatcatcccaaccctgggaatccaagcaaaggccagaaataagcttactaattgaagaggtgggtgagaatctgaaatcaaggacatcaagacagtaaaccatgcccatgcttcaaaatgtaaaactgaagagaaatttgtttgatttatattcacaatagatctacttctgttccaactgaggggagggcagagagctgggactgcaggcaggttctcactcagggacgtcaactgcctgcaagctcatgagcaactcatctgctaaaccactgcctggtcactaagatcagttgctgagaataaaatgactgaaataagcaaccagtgttagcccctttattcatggactccacaaacatctgcttagggtcatagtaaggaaaatgcattaaaataatatgttttcaaaaagtctactcactaggaaagcagcctagtcatgggcatcccccctaaatctctttgtgatgatgcgccaaggacagagctgtgggcttgttactgaaggtggaatctgcaaacccaaactgtcagcatctcttggaagcttctcagacgtgcagaatctcaggcccaccctagccctgccaaattgccaccagcattgtagcaagatgcccaggtgattagtatgcacattagagtttgaaaagcatggagcaactactgctgctacagaggagggaaatttcagctcaaatggtcagaaaggctaatgtgagctggacatttatgggaaatatggttgctccagatatttgtaactggctttctcaccaaacacctagtatgagctaggttatatagcaagtgtagtatagcaagggttgttgcttggaaacttaacagtgataggtgcatacacacacacacacacacacacaaatgaatctccttatagacaatgctttaagcaaaatgtgaaatgttttgaatggcaaaagaagtgaaagattgaagtctttattgaaagtccattatttgctgggtgtggtggctcacacctgtaatcccagcactttgggaggacacgctgggcggatcatgaggtcaagagatcgagaccatcctggccaacatggtgaaacctcatctctactcaaaatacaagaattagctgggcatggtggtacgcacctgtagtcccagctactctggaggctaaggcaagagaattgcttgaacctgaaggtggaggttgcagtgagccgagatcatgccactgtactccagcctggtgacagagcttcatctcacacacacacacaaaaagtccattattttatggttttatgttgcagaaccaatctctaagaagataattaagcacattgactgcctacctctcacagttttatgcagtactcagaccttatgtcatttgggctttaggactggagtcatcaaagtggacaggaggtggtgagagagggaccaggccttcacaacagtggtggatgctgagggaaccattggcttcagagtaaccagacaccaagaatagagagtgaagagctctgaccaagacatgatagtggttgtctttgctcagagaagtggagtgggctggttctgggcttatttttatatttttctgaaaaagaagtagtgagggtggacaaagtttgtgtatgctggctggatggaagggatagtggagagcgaggctgggtttctgaacattcctctgccttagcttttaatctcctagactgaagagcctctgtatctacacggagaaagaactgagataggaactgaggaaaattgaactgggactccaggtgtgaaggactaatccccagccaggagttagctgcatatttaaataaaacaatacagaaagagttctggtgaacaacctgctccctgcacttcccctcctcacagtgacccctgaggcccacaaggcacaggtttactgtaaggagaaataggatggctcagtttgatggcatgcttcaccatttgtcttcctacgtgagaaatgtaacgttcaacaatatgacaagacatgtcagtgtctatagtttagaataaagggataatgagaatgatgccttataaaatgcatatttgtgtagacatgttattgatttccttatttcacattaaacaagatagaaatggatgaccttcccagaaatgcctcttttcaaagtaatagttttctgatttccctttcatgtaagagctggtgttgctatgctgtcacttttcttgctagggttccctcccccatctatgtgctgggaggtgattttttggttcagtgttcttaaatgtttccatggagagttactaaggtaatttttttaagtctcctctttcagtaggtgtggtcaccccacatggctttccatatgcttgctactacccacctgtgtccgctgagcacttgaaatgggctggtccctattgagatgtgttctaagtgtcaaatacccaagggatcttaaaagacttgatgtgaagaaaaaagataatatctatcgtattatttttattctgatttcacgttgaaccaataatgttttggatataccaggttaaataaaaaatatatgataaaagttaattttactggttgttttttactttataaatatggctaccagaaaattagaattgtgtatgtggcttgcattattctattctattggacattgctgagctagatgatgtcagatctttttgaggagtgagaagagggaaatccaaagtgaaatatttcaaaatactagataagaatttactagaagttaccagggaaagggcagtgagttattttgctgctgaggcaggtttacttaatggattttgcaaataagattagctgctggtaaaaatggactctttaggagacaaaatccctaatatgagtaaagctcattgccttccctgcttcctgccttgcttaaggccgagcaacatgctgtgcttatttggtggattaataaatagtacttgatgatgatgataaggagtaaatctttgtaagtgccattgtagcttgccatgcacattcattctgttaaaccatccgatcttctcatcaggctcccagggtaggtattattgctattctcatctgaggatgaaccagctgaggttcagagagggcaagagacttgctcaagtgcacacagctaccaagtagcaagtacctgggctcactttcatgacttttgtttccgaatctcatgcttttcccactatatcttactattccaaggttaatccaagactcacctggagaagcatttcttgacctttcagactgtgctaaaaatggtaatgagttcaatgttaccataatatcaatgagaactaattaagaccaattatgggattttctgctgaccaccagggtgaccaccagctgttggactcaaatttgagtcttcacttagtgctgttaaattctcagctataaaatgttgggtgggagtgaaatcagatcatttccggatcttttctagttctgcagttctatgaaaactggcacctaaaccgagaatatcaattctttttatataccttattgaatatctgcgtgtggactgatattcacattttattgacctgggctagatttctgataaactattcctgggattgatgtgtcacacagatttcaaacacggagactataggtcagttttatctaaaatgtgtcaaattcatttgatacctactggtaaaatacatattatttccattgggaaatgcgtagtactaaagaatgctaagtatattccattcccatgtgaatagtacatcattagcttgtatttatatcctcattttgtatgtagtcatgctttgcatatactagcagcattctaccccacatatgttcatgaattatgaattctactacaagcattcaaggcaaagctcctctgtcagtcacatctctctctctctgaggccactaggatttatatctatgtgacatacttcaaactgacctcctaagacctatctcagaggaccaactctaacagtccagcataggcaagtgctagaagattcatcactctcaaatgcatgcaattcaaaattttcagtatcagatacagctagtctttgtataaacaatgccaaacgttcatttctaaaaatcaaaagaattcccttgttcccgttcaaaagatgcttctcaaaagtgaatatgacttgcgttgaaagggctcaccaactttattctggtccttattttaatttctttgtagcattccatgaataattgtgcagtatcatttttcttttagttaaatgattttattgcaaagtatgtttttttttggagagactaggtgatttctaaatatgtttttcgaagttcatggcacaaaaatttgttctaatttacttagatttttgatactaatatgctgtaagaaacatgaaaatctatagcacttttttttcatgattttcttccatatatacatgtgatcatgtagttatataggttaggatgtgtgggtaaaagcagacatgatttaattaaactcagatactgtggagtgaaaatgccttcactcattcatttaataaatatttaccaagcattcactctaagcaggctctgagcacgcacacgttattaaaatgtgctctctgacttcaaggaattcactgtcctgcaagagtctgccatttataactgtttatatcccaaaggtgccctgcattatcagcaagggcagagagaatgtagtctgggaagggactcccatactgggaagtccctcccagaagagactctcagactgggaagtccctcccagaagagactcttagactgggaagtccctcccagaagggactcctgctgggaaggtttcacagaggtaggagcttttaagtgggacttaagagaatgttaagcagaaaaaaaaaggaatgggcaaagatatcttctgctgtgttgtgtagagggctgaaatggaaggggagagggagagaaggacagcagatgagaagggggtttggggccaaactaaccagcaacttgggcgctctcttaaggaatccgaagttgactgtgttggggaatgcgcagcaatgagtgtcaggggaggctcacaggccacactcagacatgtattttcaaacagtttccttttcaaagtgggaaagaatcaattgcagtttgaaagtactggagaaagaagtttcctgtactcttcagaggtggggaaaaggaagtgtgagtgaggggtggacttgaaaaatcttctgagctttaaaaggctccataatgagtggagtgaaagcatttaagtgggcttggctgagttcttactaaagattctggtagtgctggttaagaactctacttaatgaattattggaaaaggcataaacataaacagagttgggagcatgttaaataaagatgctctgtaaatgcaggctgggcaattaaaaaagatttaccagagtaaagcttaatacagtatagtggataattaatgagcctgtgacaactcagtaataactaccctgaacttttacaatggtgcatgaacatgtgtgcaagtcagaaggagggtttgttttcacagtcagctccagttagctaggaaatttctcgacagaagttaattagggattcctggtaatggagcctgctgcttaaccaacctcctgtgccaaaggtaactgactttgccattcattcatgggtttcttgttgagcctaaagggagtttggttgtaaatttgattctcccttttctcagttccctaagctctcactgtagcacatgttttgagtttaagtagggcttacctttcttactttaagaaatgaacttctgtttgttttataggcgggtgaactccaccctggaaagacctctgttggtgagctataggtgcctgactggtccaggaaattcaaattattaggatgtggtgaattctctgtctttgatactttgggaacatgggttagaaactgctcagtaaatattcttaagaaaatggtacttttgagacccctgtcaccttttatttcagtatatcttcatttgggaagttttcggtttacagaagaattgaatggaaagtaccgaaagttcccatatgccctcttccccttctcccacccaccatttccagtttcccctattattaacatcttgcattagtatggtacgtttgttacaactgatggaaaatattgatatattatcatgaactaaagtctatagtttacattagggttcatttgttgtgttttaaatacttgtatgatgacatgtatttatcatgacgtatcatacagaatagtttcattgtccgaaaccttccttgtgctctgcctaattcaccttccctccatccccacaaactcctggcaatgactggtgtttttactgtctgaagttgtgccttttctaaaatgtcgtgtagttggaatcatatagtatgtagcctttgcagattgtcttctttcacttagcagtatgcatttaggattcctccatatcttttatggcttgatagctcatttgtttttaatgctgaataatattctgttgtctggatgtactacagtttatttatcacttcacctattgaaggacatcttggttgcttccaaattgtggcaattatgagcaaggctgctataaacatctgtatgcagggttttgtgtggacataagttttcaatttatttgggtagataccaagtagcatgattgctggattatatgggaagagtgcatttagttttgtaagcaactaccaaactgtcttccagagtggctgtaccgtttcacattcccacacttaccaatttctgagcacctaccctgtgccaaatgaccctatgttgggcaacagagtagtgaaccagggcacacgatgttattctagaaagagttaagataccgtgaacttgtccaagttacagacacactaaaattagggagtagtttgctgtttagaatttatgctttatagtacagatcacataattatgcttgatgagaaatggataaaataataaaaatttaaattactgtaaaagattgtatttattctagtgattaggtagttctgtggaattattctgctggacatgtagacattgagttctggtaccaactctctagattcacatgggggaaataaaaaactattggaacaaaacttgtctttgtaccttgggaattagtgatttttgtgggtttttaaacttgctcagtataattattactttacaaatgtaattatgaggtaaataatttttatgttacagaaaaaaggcacggcacaaatacaacattacacacacacacacacacacacacacacacccctttgacatactttggagctctgcctgagagttggacagttgccctggggtggcagcctgattcactcacctctgctccgcttgggctctgcctctaatggacctgaatggagaatgtatgtataaatggcagaaaatcttctttttaaaaaatattttaaaaggccttgccagaatctataaattgttatagtattagctaggattgagctgaattatttttataatttttaaaagcagataatgaattaaaaatttcatcctcatttgtttgactaaagccaacaaataagatggccatgttaataatttttggcctaaattatatagtcagataattttcttgtttactttgtactgtatagaaacaactttggtgtcaaatgtcagtgtcacatgtcaaagtagtagaaatgtcttttcattttgcataaaaatttgtttcatctgtgttcccaaatttgttaatatatcttaaacctttttggttttaaaattttatacaaatatctgtgaaactgaaaattttacatgatgcattatgactattttaataaggctgagaatgacactaaaaccttattaaattaattaaacataatcagtattctatctggttgacgcctcttagctttgaaagggattgagacttttacctctcaggagtgaaaataatttgtaagtctgttgattagaatggaatgacttgtgaatagtcagtatgtgagcatgtctttctgtttttggaattagcacgtgttaaagaatcacgttttcgtgtgcttcaaaggaaaaacaaagttctacctgatttagagatgaatgctctgaaattccactggacaaacgtgagatgcaataacaattgaatgaaatattgttcaaatgaactctattctaaatgctgtgacttgcagcaaagtgcctgcccttttttttttccttctgtttaagaaatgattaattaaacctgtagtcacctgaggagtttactgtggtcacatggagggggtcttccagcgaatgagaggaaagtgaactggaaggatgggtgaagacggaatggcagggtgtggattgagcttcatggggtgtgtgtacaagctcctctctgaacccacttgtacctgacatttatctgttggcttgcacttctttcctaataccttccacttactgtggaacagggttattgattcagattgactcttggttttattagcctcacactggttagtttcttttctaaattctgccactttctgaaatgtgctcctcatggaaagagaaacactttaatttgctcacagtagtatccccagcatgtggtatggtatatggtccatgtcatttaatacatatttattgattgaatgaatgaaatggaaatcagcaaattattagaggactttatattcattcccatgaaaactgagtaaattcctcatttctagatactctgttttacttgtgaacctcatccacagaaatgaaaaggcatatgatgcccaggacgttcccatgaagcatgcccctggcctccttgttgagtttagcagctggcatcaggccagtgggtggaaggagtggatttctgcagtcagcactccctttgagcccagagcataggctcaggaatctcagaacccttcagtccatgatgacactgcattgtctaagtctgcctgttggttcccttcgagaacatctcaggagcagctatccactgagaaaatgggagtaccttccatcccagactcaggacaggcctggcccttaacaagtagctttggtcctgctggtttcactgctccttctcagaagcagcctcggacacgtgcctctatgtaatatcctcctgctgtgtgtgtgtcccacaggggacacccccgcacctccaagtgacagccatgatttattgatttatcagtgtgctgatcccattcttgttttctcttaaggactgagagcaaacaagtgatgaaatttgcaccatttttttagactctgaaactacaatttacagttaacaattctcattggacaaaaatcaatggcaagagtaatcctagcatccccctaatcttgacctgcctgcatgtcaccataaactgtttttaggtatagcaatcccatgagatctacttttttgttttgccactatctttaaaacaaggtgagttttcttgtcttaaatgtggcccataccctctctctgccctcctcaaagctgtcatcttaacaccatgcagatttacaaatgcctcccctaacttcccctgatttctcctgcctgacttggaatgctggctcagactttcccaagctggcgacgctgctcactctccatgtggttccttctgctgtgctccttggccattcatctacttgcttgctcctatcaccacagcctcttctcagctctttgtggaaccttctttagtagagcaaaactacattccttctccccagcctctggttcatacagagtaaacagcattgttccctgaaggcgggacaaaaggagctgtggtggtttcccttttcaaggttccttttagtttgtttctgagcagcagcgctgctgtaagatttaaagctcatgattgtttattattattactgtaatatggtatctcctcgcattcagttggtgtcatttttaatcttttccattaacttttaaagctacatttttaaaatcacaattccttctgtaacatcagagtaagcgttgagcttcagaggagctttcagcatctcaataatttagtgacatttggccatggtttttgctgttttctcagacatacatgccatccaaaccattttcaatatccttttattttattttttattctttttagatacagcattttgctctgtcacccaggctgtagagcagtggcataatcatagctcactgcaaccttgaattcctggcctcaagcaatcctcccaccttagcctcccaaagtcaatatcctcatttttacttggaaagctagatggagatttctaagtgcaatataagataaccatcattttattcaaaggtgattagtctatccatgcttgaaatattacatttgataattcatcagagtatttaataaagttctatcaagtgctaggcagccaattgtggcaacatctagcctctgctaattctatgaaggtattttaaactcataagttttaacatgaagctgttttcctacaaaatgctgttgatggtagaagtaagtataacagatcttacctatttttaaaaaatccattttagcaagtgcttctcatagggttatagatcgtaagaagttctatttgcagttattattattaacttgctggtttttcttttcttttttctttttttcttgagatggagtttcgcccttgtcacccaggctggagtgtagtgacacgatctcagctcaccgcaaactccgcctcctgggttcaagcgattgattctcctgcctcggcctcccgagtagctgggattacaggcatgcgtcaccacacccggctaattttgtatttttagtagagatggggtttctccatgttggtcaggctggtctcaaactcccgacctcaggtgatccgcccgccttggtctcccaaagtcctgggattacaggcatgagccaccatgcccagccttggttttttatttcttcacaaacattgcccattaatatggtaaaatccttttacaaaataagtaaaggaaaagccataaacagtccaaagacatcgcaaactggaaaaatttatttgcaatatattaaacacaaaagcctattttccctagcatcaaatttcttaccaattaataagaaaaaatggccaacaactcgttttaaaaaatgagcaaagaatatgcaaagacaattcccagaaaaaaaaaatcaacatacaaaaagatgaacaagttcatttatgagtaaataaatctgtccttgttttaaaattctgtttgtatctgctcaatatctaaaatctgcctctcttgaaaccaaatacaaggcccttctaagtgtgagccctgtgttactacacaggttgtatgtccttgaattgggccctgtttgtagtcctcacctggagaggtggagaattttgtattccttttttttatgagcagttattatagattggctcactggacacccacaccaactcacttctggtgcatcttatgtgatagaaactgaaagctacagaaataaattaattaataaaagaaagaaggaaggaagagagtgagggaggaggaaagaaaaaaaagtttcagccctttcatgcagctagagaacccatttctaccaaaaacttgtattggtggtaacttggaatgatgaagtgagcaagttaaggtaatggctgtgtgctgggaaatgttttgttcttctggggaaacagtgacggagattctaatgtcttgtccctgttgtcctcctttgagcagcaggtcatagctccagtagagctgctggaagtaaagtctccattgttgttcatcattgtccagctgcattgctcctggccatggggcatcgaggcttggttctgcaatccctccagaaattctttaagtcatataatatcttgtaataaatctttctctacttaaaccagctggagtggatgcaaaaaatacaatttagaaggcaaaattgtgctttggcagtcatagggtagaggtggaatatgatggggagaacagaggtacataaagaaataagcccatcacaacccagagaagttccataaaaagttcccatcagactttcagttctagctacttcactgctgaaaaatacagtttgtcaattacagctaaatttgctttggggtctccctactggaatcccataaaatgctatttttaggcattcactcattcatttagtcaaatagcatgtatcaatcaagtgcttcaccaggttaaccacgattagagaattcaagtgactttgatttatgcaatgtcttttccttaaaatgtacaaaagcccaagtaataacttgctattttcaaaaaatcttaaacaggaatcctttttataaaacaaagagagttcacaggtaaacaggatgtggtttctgaccttcagggaaatttcatccagttggataaacagatcagaaaactaatcatacatagcaagtgatgagtcctgtgctagtgggttgcatggagtactgtgggaagacagtggcatgcaagaaactggttaacaaactcaagatttctccacttttcacctattctcgtatgagccagctaaaatgccccccaaaagaagtgttaaaacctactgaaggctatcatttgctatcatttaagtttaggtgcctaactcttttttttttttttcattttttttaattttgagacagagtctcactctgtcggccagactggagtgcagtggcatgatctcggctcactgcaacctccgcctcctgggcttaagcaattctcctgcctcagcctccagagtagctgagattacaggcatgcaccaccatgcccggctaatatttgtatttttagtagagatggggtttcaccatgttggccaggctggtctcaaactcctgaactcaggtaatctgccctccttggcctcccaaagtgctgggattacaggcgtgagccaccatgcccagcctggtgcctaactcttttttttttttaattttattttattattattatactttaagttttagggtacatgtgcacaacgtgcaggtttgttacatatgtaaacatgtgccatgttggtgtgctgcacccatgaactcgtcatttagcttaggtatatctcctaatgctatccctcccccctcccccaccccacaacagtccccagtgtgtgatgttccccttcctgtgtccatgtgttctcattgttcagttcccacctatgagtgagaacatgtggtgtttggttttctgtccttgcgatagtttgctgagaatgatggtttccagttacaaccatgttcctacaaaggacatgaactcatcattttttatggctgcatagtattccatggtgtatatgtgccacattttcttaatccagtctattattgttggacatttgggttggttccaagtctttgctattgtgaatagtctcgcaatacacatacgtgtgcatgtgtctttatagcagcatgatttataatcccttgggtatatacccagtaatgggatggctgggtcaaatggtatttctagttctagatccctgaggaatcgccacactgacttccacaatggttgaactagtttacagtcccaccaacagtgtaaaagtgttcctatttcttgacatcctctccaggatgtcaagaacaggaaacctgttgtttcctgactttttaatgatcgccattctaactggtgtgagatgatatctcattgtagtgcctaactcttaagcagggccagtgctctactagaacttctgtagtctcagctctcatgcacatagaagtgcaagcatcccactgagaggtaactgaagacactcacaggctgctgagctggccttgacttggcttcagccaagaatggtcattcatgtgtctctggatgaagacacagggatgcagagtgacttagtcaagtctgactttgaggcaagccttcaaagtcagtattcagttacttcatcttgtaaaagcaccacacttcatgtgacaaagtaagtgaaaaagtagctgagtctgtcttggatgactgtttaaactcatttaaacatgtcggaaaaaaacacaaaaaccagcaaaccaaacgtaccatgattgctgacatttcagctctttatgtttgacctgtgcaacaaacagacagattcttgttttctcattctggagaaagcttatgggaggtttctctccaagacaatgaatgacacaggtaatcaaagtgcaaatggcacctgctgtcatccatgcagcagtactgttattcaggatgttgaaatgcagatgcttagtcaggaggtggattgaggattggaatttgggagagatggataccaacattttgtttataggatcgtctaaccaacaatggtgataggctctcaatcttcatcagcacaaccacaggagacctggaagcttctacaaatattctcacatgccagctgaatttagaagacttttgactcagaataaggtaatattaaacttacagtgagaacaatatttttcataaagtttttgagacagcacgaacatctgttgagttttgaaaatggagagagaacccaaagatttcaggttagaggaaaatatagttttttctttctggttacaaggctggttacccatacgatattctgagtcaagaaaagaattttctaagacaaagaaataatgccctcaaaggacttctttcctgtaggcaaattccaatgaaaaaaattctcctatccgttctcactcctgcaggtcgggtgccgggaggtaaaactgccttgcactctgagctgaacctcctgatgaggagaggtggggttacagttacatttcagttttacaaaccattctctttactaacctgcaatagtttgacctcatttgtgtagatcttaactccttgactgtggcttgtttaatggatttagtaacatggaaacccaagtaagagccattttgctgaagtgtggtggcagaggccagatttttgagagtggtggacagactcggggtgagaaagttgaccctgaggaccagaagaggggatggagaggaatataggtccaggaaggtaggagtcttcagtttactttttctttagggccttattgttatattttacatgagagagtctggaacatgtttgaatatagttgaaaagggtgagggaggtggtgggagagggagaggaagattaaaattgacatggatgatactggagactgagttttattctacctgtagggtttctgagacacagagaggagcggtgttaagagcacgtgtggaagaaatggtctgtgttgggtggagaaaggaggagacaggtgcagattcagggattgctgtccatctggtcacttccattatctttgaattaggaggcaaggctatccgcggaggtgtggggtgtgggtagagcaggattacaagtttgaaggaatgatggttgaaatcatcacttaagagaatggaataataagctgactagagaaacttttcagctccaatcagctgttttgatatatcaggtactattattggcatcaaagatatagcaacttacattccagagaggaaatacagatatactcaaaaaagctaataaataggtaatatgtcaggtgttatctgctacaaaaaaagtaataaagcagaaggaaaagagaacagggagaagggttccattttatacagagtgttctgctaaggtgacatttgagcagaaagctgaagcaagtgaggaagtcagctatgcagaaacctgagacaggagcattccaggtagcagtaacacacctggtacagtgacaaaagcaaaggggctgtgtgcctggagcacagggagcaagtggcatcagaggaggaaggagggacaagcagggagccatgccctggaagtcttgtcagccaaggtgaggacttcggattttaatttgggcaattgggaaactcagatttactctatctgcctcataccagcccctttggacagagcctcagtttgcaatgtctgtgcacctggttcctggctttgccttcacagtgttcctagatgccaatctgttaggtcaggttgaccagatgactaggcccccattatctatgagggggttcatgtaagttgtagtgtatatgtgcacgtgtgtgtgtgtgtggacatgacacaagtttctttggtaaaggaagtaaaagccctgacaatctgaacataatctattgacctttcacggccttgctactccaagtttgacctcaccttcttgttagaaatgcagactcttgcggtggctcacgtctgtaatcccagcactttgggaggccaaggtgggcggatcacctgaggtcgggagtttgagaccagcttgaccgacgtggagaaaccccatctctactaaaaacacaaaattagccaggcatgatggtgcacgccggtaatcccagctactcaggaggctgaggcaggagaatcacttgaacccgggaggcggaggttgaggtgagctgagatcacaccattgcactccagcctgggcaacaagagcgaaatggctgtctcaaaaacaacaacaacaacaacaacaaatgcagactcttgagccacgcctcaaatccattacatcacaatcagattttgcattttaatgtgttcctcaggtgattcatatgcactttaaacttgagaagcctgactttagagatcctcaaagaaaacaggaaggttttcctcctgcatttaagttcatttttcagggatccttctcattctaaacacattctaacaggccttctctactttctctgaatgaagtggaaacatttctatgattactttgttacacagtggagcatacatctaattatttgtgtagtgggaaatcattcctttctctcttgcctattctcaagatccagatccttttgtctttctagataagagtcctctcgccttgcagtttgaatctcttcagcacattagatgcctcgcattagcatcccctgaactgagtggagttaaataactcagtgcgcgattgacatgctcatcacaaggcctttgtaaaagatatcccagcatcttcttgatattgagttcagtaaaggaagtaaaagccctgacaatctgaacataacttttttctgtttcttttcttttttttttgagatagagtattgctctaccgtccaggctggagtgcagtggtatgatcacagctcactgcagccaaagctgcatagccaggactgcaggcattgggccaccatgcccagcctccctaatatttgttacagtgagcatgctgtttacacatggcctgtgcacagtcttaatgagagccattctggggataaaatgatcagatgtctgccctagaggagcagtttcatatggcaggtgtagcgcagagcccgaagggtgtggcactaccagatcattggtcaggccatgggaatgtccaggtaaccagcagtcagcagtcattatagatgggcagagtttgggaacatggcctgacaacaatgggttcaatttattgagcttgtatcatgcaccaggcagtgtgcttcacattaacgatctcctttaattctcacagtcactacagaatatgcactgttgttccattttactaagaggttgaaagagaagttaaggggcctgcccactatcatataattaacagggaatgctaattttccaatccatgtgtatagttgtccccccttatccacaaggaatacacttgaagaccccttgaaagtgtggatagtaccaaaccgtatatatactgtttttccctatatgtacatacctatgataaagtttaaattagccactgtaagagattaacaataataactaaaaattaaataaaacatttataacaatatactgtaataaaagttgtgaatgtgatctctctctgtggctctcaaaatatcttactgtactgtaccacaggtaagtgaaaccatgtacagtgaaaccgaagatatggagagactactgtgcctgactccagggccatattattaacctctgcactagaatcccgtgtcagaaattgagctcgtcagaccattaacttcaaggtggtgtggctgctgggtcctaacgtacttgcctggtgaggagttcctaagtgggaaagcctgggtgtaaaggaggagtggtgcatccaggatgttctcagaatagaattctactaaaaggaatgggcgtccgaggcccaggatcaggtgagttactcaaaccagggtgtcccatctgtgctcagctccctgtgccatgtgatggggggccattctccgatttgtgaggacagctggaagcacatgatcatcaggtaagcttagtcctggctagggtgggttgagccagtgggtgacaagtgactatgtgaccaggttggtccttgaaagatgactgaggtttggacacctttgcggggtggagatgagaggaaagagagagaaatgcatttttgcctgagcaaaaaggggccttgtttgtcttgttcatttcatttatctaaattcatgttcaagaaaaatacgaacaattaatggaaaacagccacaaacttatggaaaagcagatagtggaatacacaagaaatttttaagagtctacaataaagggtaagtgtgagtttggaaagaaaactttttaaactgctctggctaaaaactgctgggccaagacctggaaacagcagggatgcatctcatcttgcacaggaatgtggataaataggtttcaatgcataagacatgtgagtctacccaaggcacacacatgcagtttccatcaaattccacacactcggttctgttggaaataagcatgtcatctgtgtgattcagttcaatggttggtctaatggattaggatgaaatgctgcttcatgaataggaattgggtgctgaggtatctcgtgtctgtgaataaggtgagagtgactgattcttgcagtggttgatactggcgattaccaagtaataagttaacactccagagcctagggaatataagtagtgtgaattaatatgacaacaatagtttgcataggaagactgagaatgtgctaactagccaaagttgctgaaatcttaattaggtattttgatacataatgaaggatatttgctcacctcagtaactgtcatcaattaaaagagatggacagggagaattacattgcacttaattttatctgaatatttaatcaccaataatggagatgaaaatttatgagatattttgacattctgggaaatacagcaaagttaatattgttagaagcttctcagctgtgcattgctcagaagtgaaaacgtccataacagctatagagactggggagattcacaaattcaactttttagatcatttggaagaattttctctccagacagattttttttcctaaaacaatttgtcaattgtttttaattactaaatttcaaagtaaagactgtttataacagctaattacagaaaataatcatgtcctcacaatgctaaatttatatctaccatatattaatatttgctcccaaatggcaactgcccaggtcagctgagctcacccgaaattctagaagagaaagcaggtgaagatcagagtagtggatgctatttggagtgggaccttcctttcttttctgtttttcaaagttaatttgatttatcaaaaaatatttatgtgattatgagaagctatttgtgtgtgctcatgtagatgacagtagcctgtatataatttgtgagggtaaagaaagcaaaatgtaaaaagaagagatgtatacattcatgtgccaatgctcctttcatgtaaaacctaggaaaggacaaaaaagaaggcagagaaaaagtcaaaataatgttaactacgttcattcatgcattcactctctctctgttcattcttcccagcatggcaatgagctccattttcctgggtgtctcttacatagtgggaagagagacatggggtggtcagaagacctggcttctgcctttatcactgccatttattagctgcatgactctgaggaagttacaatctctgagttgcagtttcttcatttgtatgtggagtaataatatctgtaaccctgccttggtgggctcttgcaccaaatgaagcaagttgttttgtgaaacttcatttagcttataccctttgttaaaatgcacacatatactgagtgctgttcaccacattgagcagattcagtggatgatgtcatttaattctcgcaacccaagccctaataagcagacagagaatatggggtacagagtactttgagggcacagagctagtaaatggagaagctggatttttttttttttagttttttgacaacatgcatagtaggaaatacattttacagtctgaatcagtagaggtagatatgataaatatatgcatacctgtatctacacatatatgtatgaatggaaaaacaaaaatttcagaaacagtgtaatggcaaaagccgcaattacatttgtaccaacctaatatacatgtaagtctacacacatacatggcttgaaagtaatgccaaaaatcacaattacatttgcaccaccctaatatatacaaatatattctaaattgaatatattctgttctatattatttcttttttatgataacatactaaatggattatacaaatcaattgtgatgcacagtttttaaaacacttatctaaagcctacactctttaaccactatgttgtaatccttctatttagagcagatctttatacatagtagatatgcaatatatatttgttggatgttgtatgaatagggacagaaagaatgaaatctaagggtccccccaaatcatatctgaatcggtggcttcactctttgtccatctgtaatgttaactcttttccctcagttgatgacaaggagcacagtccaacatgtccattgctttctgtattgctttctgctttctctgtcatcggagctgtctactgaggaaaagccaaggacagatggctccctggatagaggagtcttcaaaaaacagggagagtaaagtcaaagctgagattttccagtttatgcccattacaccttgtacacctcctctgggcaccttcctgacccctgacccagcaggccggtgcactcacacccttcctgcatgttgaccacttcctctctctggtctttggaagtggaacagctctgaagaaaacattggatataaatattttctttttctctgagatttcctttcaacatgctcactttttttttttttttgtttttttgagacagagtctcgctctgtccccaggctggagtgcagtggcacgatcttggctcactgcaacctccgcctcccgggttcaagtgatgctcccacctcagtctcccaagtagctgggattacaggtgcacaccaccatacctggctaatttttgtatttttagtagaaacagggtttcaccatgttggccaggctggcctcaatctcctgaccttgtgatccgccccccttcgcctcccaaagtgctgggattacacgtgtgagccactgtgcctggcccatgctcactaatttgtctttactgcaaacaatttacaatatactcaccattattttataatcaagacacattgttggatgtgcctggggtgagcagggaattattttggcagcagcagatgcacttccttcacagagaacagtctcaacttgacaaatacttggggttgaatgaatgactcttcaagtatttcctcagtttcatgactgctttttaagcattttaaacaaagatcatatcctttaatttttttcctcacaccagcaaactgttatgcacatgagagttttgagtaagtagtagtatgtgggtaatagtgtattgaatataatatcaacgctccacgaatagtctaaatgcctttaatgactgtgttatcagaaagcttggccagcagtcaaacaataataattggaagagttaaaacatatagatttcgatcttttttgctccctaataacaaatgaattgtacatcctctttttactgtgggtaaacctgatgtgttttaacaaattggttatgcttctttagtgatggagactttaaaatggtagatataaaaaaagtgagaaagtctgttaaatcattttagcttaagtttaaacaactttagctcttaaaatacttccaaaaaacactcttgggcttcccacatgtattacagttttaaattaacaacaactggcatatccagaaaagaatatgtaaaaaagaaagcattcaaaggcacccatctttgaggcatagagagagagctaattacaatatagcatgaataagtgcctgttatctctgctgaggacagaactggaatgaatatatggccttaactccagaaaaccgataatgttagacatttctgaaaacaatagtttttagattctggagctgaacttatagtgtaagcattttatgtctagtaatctcctagactcccaggtcaactcctgggaagatagcccaataatctgctagaaaaaaggttagaagaccttctacaaagtcaaaagaaagttggaggtgggaatgggttagggatgtgagtagagagaggaggggaaaaaaaaaagaaaacttgtgaaattccttggaggcctttcaacctctccctaaagattttaaaatttacctttaaagtgattacctcaattgtccattatttaccagtcaattattatatattgagcacctgctgtgatcaaggcatttagttaaatccaagaggaatctaaagaatagcaggtttcctcaaggtcttttagggattattatataattggaaaggaaaatataaaaatatctgaaattaataatctgaataacttataacccaaagctaaaaatgttaagaggtttagatgcttcacagaagagaacttttttttttttttttttttgaaataggggcttgctctgttgcccaggctggagtgcagtggcacactgcagtctcaaactcctgggctcaagtgatcttcctgcttcaacctctcaagtagctgggactacaggtgcatgccaccacacctggctaatttttatttatttattttttttgtagaaacaaggtctcattcttctgcccaggctggtctcaaactcctgatctcaagtgatcctcccaccttggccttccaaagtgctaggattacagatgtgagcttgcccttcacagaaaattataaaagacccaaccttggaatgaaagaaaaatttggatagtaacaataataactttattatctagtataaagggcacacccaactgtattatttgtattaaaaagattgttctggtatcttgaaagtgtggctgtttttacatgtctaattaataatctcacacagtgaaggagctgtctcattaccttcttgaagcccgccatgactttggcgttctacaatgtataccaaggagggatgactaattccaaagcaaatgtccgttcatgctcagtccagagggttcctttttttttgttctcaggctgtctcaccagttactcctttattgatatttagctcatttatgtaagtttgccagctcaagagagataataggtgagggagaacttgaagtcaatggaggccacaaggcttttggatcatctgttgataccaaaacccaatttattctacccctccaataacgaaaccaagagcatgtgctctgggaagaggaaagagagaggagctgggcaaagtggagaaatgcgagaagtttttaaagtcagctcacaggaaagtatttagagaatcatctcagaaaaaaatagaatagatacaaatgaagtctttcttagatgctctagaaatatattaatataacagtggttgctaaagagcacttaaatatttctaaagcatgatgtctaaaaattgaagctaagtgccaccaagcaagggatgtgcttctaattaaaggtaactgtcaatttgtgtttctttttatgaaatgaggcctacattcagctcatttatttattcaacaaatattgttgagggtctaccatgcactggtcactgtactaagggaaggtgatagagtttctagatggagatgcagggttgagggaggtggttcttttgcttgcttcattttgctcactttttatttttttggagatgagagtaaattgatgttggttatgaaggaccccatgtaaaaagattaagttgaatatgcagggatgagagaagataactgtctaattaagtcctagaagagagtggagggatcaaggttgagaacacagattcagtgaccacccttaagtaagaaatgacgtggctcgtctgtctgagatctttaaattctgtgcttaatctgtgcacagtaaggagtgaaagtgtacatggtacctgtgtatatttttttcatattgggacaagattctataaactcaaatttgaattctcctacagctgtctggcttcaaactctgtttcatcctattaaaaagggggcagtaatatcagtcccatatttgtcccagggggatcccacgtgctgatgagaagggacttgcaataaggaaatgtaagaagtgctggcttaggccgggtgcagtggctcatgcctctaatcccagcattttgggaggccagggcaggtggatcatgaggtcaggagttcaagaccagcctggccaacatggtaaaaccctatctctactaaaaatacaaaaattatctggatgcggtggcggcaggccccggtaatcccagctacttgggaggctgaggcaggaggattgcttgaaacttttagtgagccactgtactccaggctgggtgacagagcaagactccgtctcaaaaaaaaaaaaaaagagtgctggcttagcacctttggccctaacggaaatagggttctcctaaaacagatgactcagagaacatccttgacatcaatgccgtattcagaatgaagatcttgaaaagcagacatgtaatgttaaaaagagaatagtagctgtttttttttttaacaatgcttaatttctttgagagaatactgaactcctgaaacatccaattcctcatttgcaaaatgggagtaatgatgattgctgcctcaaaaggtttgtgtgagcatttcaccagcagatgtatttaaagtatgcctggcagagagtatttaggaatgcttagctattatttatctcatcctcatcaataaaaaacaatgataaaacctttttacttaattaaatatgtacaccattaagcacatatccttaatttaccaagttttatgtaattaatatatttacaaatcattgcttttccactttaattagctaacagttaatttctaaggtaccaaaaattgagactcttactgagaaagattctcatcctattttatttattaaattagaaaaacagtacctcttaagagtttaccaggtgaatttcttttagatgaaaattctccctcagttattcctgggttggtatcttgactgagtgtcttttcttctttatttatctcaaaggtgagttccatctgcagactctaataaataatgattagtttcaaatcatagattccattttaactcttaggaagggaagtgtgacaattcaggaatgtggtgttcatggaagtctgtgaaaactttgtgtttgggtccattcgtttgttcacacactgtttaagacttttgtctcctgatgccacatgtgacagagaaacttcttcattttgctcatgacaagatgctcctgttgctggggtcccacaggggtctcagtgcctgcagatctcagtttaaggaatggcttcagcccaagagcttagggcacagttccccaggctcttaccaacaccatgatgcagttattcttcgctaataaaaggtgggctagaaaatgcattgctctggggttttcaacttctgagtttgttgttgttcatattggaatggacataagcttatgcctgcagggatgtctggtgtatcagatgtctggagtgttgctccagcagctcccagagcatggcctgagggtgcttggccctgggctggctgtggattcgtgggcccatcctgcgttatgcttgaggcaggacctcagcttggtgatgaagggcgccttgcccatcaactgtggcctatttttagaagagtaatctctgtcaactaagaaaataaaactaggatcattaggctgtctgagagacctttcagatgaactgtagatgttcatttgtccatttttattgtgttgtgacaagcattttttaataaacagttttattgaaatataactcacataccacacaattcaccaatttaaagtgtacatttcagtacttttagtatgtccactgcgtgtgaaaacatcaccacaatcaattttgtaacacttttgtaccccacagaagaaactctgtacccattagcaatcagtccccattcccctcccacccacgccttcccagccctaagcaaccactaatctttctatttctataaattgtgcggcaaacattttattttaaactccgcactgggaccgccctgcctagcagcctggctgtcgcaggaccgcctccctcctcctctgcctccagccccctctccagacgcatctcctggaggtattcttcttctcttcccctgtgtcctgtccctcccgtgcccctcaactgtggccgctctggcatcgctgtgggccacagtggggaggtcggatttctcctctgccctcctcctcctcaccttccgtctctactggggccccaaatcccatcttcctcagggactttagggtcacacgagtcagaaacctatgaaaaccgatgcaatcaaaggagagaagagtgggggaaggccaggggaaccccagtgcagggacttggcagtgggggttgattctcgtcaccctctgcatccgagtgggcctgagctctactttctgtctctcttggtgcttctgcttctctctctctctctctctctctctctgtgtgtgtgtgtgtgtgtctctctctgtggactggcgtcttctggtcctcttcctcccagtccataagtaatagtccctaaaacagcttgacacagattcaaatccctgaatctcaattataagctcccagaaaagaaaatgagttgacttggactgaattggggctttgaatcaagcagctctaaggggcatagaggggtggggggtcccgtgctcactgcatagtccgcaggagctctacctccaagtgggagccacacgcctgcagggttcagagcagacccttccccaggccccgcctctctatttccaggggtgataaagccatctctgggctggcttaagagactgagggctgaactcagagccctgccacccccaacagccttgcagcctccctggtgactttctgggctgctggggagtcttaactattctctcctccctacctccattctttcccccacagggagcccactggcctcactgctgctctcctgagcgctttgtcttctcctgctgatctgctggtcaaacggcagaacttcatgtcattgaaacttgctcttagacctctcctcgtaggagaagttgccattctcctggataaggaaagggtatagtacacactggtctcttcagagtactggctgcctgccctctttcctacttcctcatcctgattaacggtctgtcctgcctcttggcaacccgttggcgctccttaagttgtctgtggcccacttgatcctcccaggtcctcctgaaaagcaggccccagggcctccaaaccacatgcaggccaagaacatgttcaaaatgaagagatttctatattttaaaatataaatgcttactcaattatattttaaaactttttatttcaagtgtaccatagcttagatttggaaagttgacctctagaaatctaaacacaagaaataacaaagtgggaccaaaagtgtattaattcttagtactcaataaactttaaaaaaaaatttccagttttggtaaataaatccagcaatcttctagactttgaagctaaacaattgggactgacattttctgtggctgtcattgttgctgtttagtaagcttttattgcatgtatgcgtgatgtgtaacatacgtgcacaaacaaacacagtgaaatgcagctccaggagcatctacagaatgaaccctctcatatcaccagcatgtggacgaaggagcagcgcctgaaggcccctttgatgcccctgctaggcagcggtcccttgtgggtgaccatgagcatggcttctaatactctgaattcatttgccttttttttttagcttcacatgaatggtattatacaagatatattcatttttgtctgacttctttcactcaaagttgaactgaagagacacattcctgttgtacgttgttatggttcacttattctcattgctgtgtagtattccatcttgcagatttgccaaatcactctattattgcttcatgtttagaaatttatttccaatttgggctgttaaaaacagtgctgctctgatcatttgaatgcatttctttgttgaacacatgcacacatttctctgggtatatacttgggagtggaactgctgggtcctaaagtgtgtatgtgcagacactgcccaataatttttcaagttgttttgccttttaataatgattttaaagtataaaaaattatctcacatctgataaaattttgatttttcccaaaagagctaacataattctttatgttgttttacctcttaataatgatttaaaagtataaaaaattatctaacttctgataaaattttgattttccccaaaagagccaacatctgtgtaatgcaataactacattttttctacttctagaagaaaaggaatcattattcagagaaggaaatggcacagaagagattataatttttcgattaaaaggggccatcaaggtcttataggacactgagatatgaaacacacacacttggtggtgtgcccgtagtcacaacatgaaggacagtcaggaaaggatgtgcctccaagtcccaagaatgacccatgtgcttttctttgttattcaattctacagacaagtgtgggttcttctgcgggcatgtcagtacactaagcaatgtgcgaatttccggtaaatacagcaaagagccttgtggcgtaggagcctccccttagtggaaaaccaaatctctacacacagtaattttgctggagtgaattttggctcttaccagacttctatctctaacaggtaatctatcatttacaacaacttggcccctttctctctgctttttattacttctcccctaattcaaatcctcattacttcagagctgaattatcgcagcagacttttggctaggttcctcatttataacttctgccctctctaatctatctcagcctatttctgatcagattagtctttataaaacaacacattcattttgcatctcttcttgtcaatattatttaacaggagtttcacacccaaatccctaggggacctggtaatgcaaatgtgtaaaggccagataatggcctttgcaatgttaaacatctagagaattatgctttctttaattttcattgaaacccagggatgtcttggtctgggtttcatttcctgatttgacaaagtctgtatggaaaacaaaaaaaatttactttaaaaaaaaaattctataataagaaagccaacagcacaagcccacctagaaatagtgcttgaaacccagggaaaacccatttaaagagagccgtctgcagctattcagctccaggcaaccgttgccatgatggattttggcctagtgctgttagatcttccaatttttcaaaagaaattggaaagccagatttttctgtgaaatttcctgatatttaaattttggcatctaatccaattttttttggataaaacttgtaagtcatagacaaaacaaaacaacataaaaaagaggttcggtatgtgaagtgtggttctcgagctgcctgtttgagctctgccctgtgtaagatgccttaaatgcattcacataatcccaacagtcctgacatgggaagctaggccaccctccctattcacagtattaccactattttattttattttattttattttattttattattattttttgagacagaatttcccattgtcacccaggctggagtgcagtggcgcaatcttggctcactgcaaccaccacctccagggttcaagcgattctcctgcctcagcctcccaagtagctgggattgtgggtgcctgccaccatgcccgactgatttttgtatttttagtagaaacagagtttcatcatgttggccaagctggtctcaaacccccggcctccagggatccgcccgccttgggctctcaaagtgctgggattataggtgtgagccaccacacctggcctagtaccactattttttattctccccaacatgtacttctgcaggcagattggatcaccccttcatagaacacgcctactcattcctgtggtcatcacgttggtcatttaaacattttaatccactcacacgctctgcagacatctactccatgtccttctcttcttgaatgctcctctgacattctactccacctatgaagccattcttaatacttcagtatacattgatttattctttttctgaacagagtgtatttaaaatcactgccactacagttaatacctaaaattttttctcaaaaaaaaaaatgtaatttccctaagaggattgcaatgttttagattcattctgtagtgctcctcctcccagaaatatttggcataatttggggcactggagagagtgtccaatatctggccgatttatacaaaatgtgagatggcatctacagcgcatcaaaatgatccaaatatttttgcaactttttgaatagttgcaatatatacatactttttaactcaagctgttttatttgctattcaagaacctaaaagagatttaaatagtctggattttgaaataaacttctctaattacatgtatgctcatgaaagtacatttctattgtccttaagaacaagagctatctgtttacatcttttcatctcataaattttgtgtgcagtagatgcaaaatgaatgcatagcagcccgccagttcactccagtatctcatggggagatttgagtggtttcatgtttggaaacagatctatctgtgaagtaaagacatatcactcattttgatttggaaaaaatgttttaggttcatgtggtaatgtagacattatctttggcttatgtttattgattgggtgagatgtgaaggaaaactgatgctttgcaaatgggaattatgaaatgacattgtaacctgagtcatcatagaacatgaaatgtgatctaaggccacactatttttgctataccttttatgtttcataatttgacttgactactagtgttctaagaggtctgaaagatgtgttccttacctactttaaaatcaagcttgaaattaccaaagaaaagccgagactgcctgggaaccttcctaaaccgctgacatgagcttggcagagatgactgacgggaaggactgttcagagttggggacaagaagggacctgttttccaagaagttaaggaaagactttctaaaagaatgttcttacatataagtataatgaggtggaaattagtttccaccatgacaaataccattcttttacaaagtaccatattttctagaagagtgctttccactgcagaactttctgcagtgatagaactgatctgtgtctgtgctgtctgacatgtgtctatttgcacacttgaaatgtggcaacgtggcaattgtgattgagaaattgaatttttaattttaactcacttaaatgtaaatagtcacatgtggctagtggctactgtattggacacaacatgctggaggaaactgtatctttttcatgtcttttaaaggggcttaaaataattttttgctctgctgtctgggtcaaagaccccaaatattttcactgagggcatttgctttttaatttctcaaggtgaaacgtttttaggaagaaatagggtgtgggcagtgcaaatgaaaggtgggactggcccagcttcagggatgtaccaccttctgctgtcccttgatacagatgccctttgggtaggggagggggcagctgcttctgcccacgctggagctcccttctggagagatgcacatagcagccgatgttgcagtttagaggtaatcattccacagaagggaagccatgcaatatccaacacaatgaaatgctgtttttgaaaataatttgggcactttattaaagccaaaggccatatgatatgataggtcacagtattcaacatattcatacttatcactaaaataggttctggagatctttaaagtcaagcatttgtttttcagtgtattttattccagtaaatgtgagaaacaggtatataagaaaatcaagcttcaattaacatgtgctgtgactcaaacaaaagaaaggaaagctttacttagaaaaaaaataactcttcagaaaataacagaaaatgtgaactgtcagttaatacaacagccagtagccataagcaagagattgggaaagccttgggccacttaggtggaccagcctcaagagtgagctgagaatgctgaaatcacattaaagagaggaaagtctctcctatttttaaagacacttagggaggagagctaataacctctttcagtaattatgccttttaattatgaagcacaaactattttgtgctgaagctcatgattcagattctagttcacatgcttttgaggggcctccttgcctcctggtggggtagttcctgtccgaggaggcaagaggcttgtggcctgcttgtccctttcccaggcctctaaatctgtctctttggcttgaaatgtagtgcgtattagagcactggcatcgagatttggggagaatttctatgaatggatgcatgtgatggcaggcccataaattaccaatgatgcacgagaagtaaaatctcatctttgaagctttggtcctgtgggcctattttgtccattttatgattgtccatcacaaatatgacattgtgccaaaagagaaaaatgtaaccagatgaatgacataaaccaagaaaaagaaggctatgacatctgtgagccaagatgtctgttctttatggatccatagctgtctctgtctctgggggacaagactcttggactctcagtggggacaggggctgggacttctggtggccttggtctctcattcctcatttctctaacctgtaaaaaaaggaggtggcattgaattacaagtgcactggtccattttacaaaattgcaaaaaatgcatgaacaccgagtgctcaagtggttccataaatacagagctctgatatctgaattttaagatggaaacatttcacaaaggcatatagcttccttttcttaaaaattaccatagctccagcctggacaacatggtgtaaccccgtctctactaaaaatacaaaaattagctgagcgtggtggtgcacacctgtagtcccagctacttgggaggctgaggcacaagaatcacttgaacccaggaggcggaggttgcagtgatcctagatcacaccactgcactccagtgtgggtaacagaggaagaccctgtctaaaaaaaaatatatatatatataccatagcttaggttgaccagtaaatgacaatatgacaatccaatccctatctccttgatgaggactgtgcctcatgttcagacctagaatgcaatgagggctttttcttttcagttattgttaagttatcgggtcaaataatgtaaaatgcatgtcagagcatgaggtatttaaattctggcctctttattttccccagcaaaccatgttatattttatccgatttaattactttaggattataatttattatttgtctttgaaataattaaagatttttttcttttctttatttccttaaacaattaacagccaactctaaacccatgaagtggtcaattagctcaagtggaaattaaaatttggcgcatctattttaaggtcgatgttgttttatttcccagagctggactgcagacttccttggctctgtcacagaaagcgtccttagcagagaatgggtttctcttcctactgaggtgcttccccactatgaattattaaagacttgaggatgaaagtgttattgaagacaaaagtacaaataagccaagtgcacccatgtcttaattagatgacattgaagaaatgctgctcaggaaacacatttacttttttttttcctttacttctaaggtgtagccctatttaatctttgcctagaaacaagtttgtaatgaatgtatttggataacgggcagcatggcttggcctgagccttgcaagcagagctgctggctgtgtctctgccattcgagagtctatggcttctttataacttgctagacccatccagctatcctgattgtccctcatattatctaactaattgtttccatcatttactttagtcaactagttctctctttcagttgactccctttttctaggtgctagggaacatgaaaaaatataatactagagctgccttacgctgtgacgtaggagaatctgaagggaggtcggggtggggacaggagcaggagatgatgcatttgaaaggcttaaaacacacaagtaggagagcaagagaaacaaaagaaaagaagtgggcctggatggggtggtggggagcctttggcatcgagaaaaagtttaaatttatacattacataatgttcatcagagtttcttggcagcacggggatggtttttgataactaacagggtgatcgttctcagaatggttgtcaaatgggaagagcgtttcagaagatgccccaagctctggcctttggagtatttatagcttagctgagcccatagccggacagcagccagcaggctgggattaggaaaaaactagctgatatatttgagtctagttgtttgttaactattgcagaagcaggtgctgccttaagatgtacctcatgagcacctttcctaggagcatgtggtgctggatctaaggaaacttgcctatcaaaaatcatagtgagggccttggctatttatggataaccaatccatacaaggggaaaccatattgacacattctttatattggaaaggcttgccttcaaaggtgcaccacggttcaaggggaaaacctgctcttcaagctcaaagatttagatccaagtactggccattctactcctagatgtatcatcccagacaaatcagcctaaagcttctatttttcatctgtaaaatgtgggacaatattacctggattatgcattactgctctaagattatataaacaccatttcatgggttatttgctaaaattgttgttgatctacataactaggtcttcaagttaatcagagcaatagtttaaacactgaacattgctaggtaactgtaactgtatttctgtgccatttttttctcttcttgttttggttcagtttacattaaaatctgtgcttataagtaaaacacagcagatttattgcaggctgatgctggtatgttttagtatatgggttgctaaagaagaaagtaggaggaagaaagttgttagcagagggttagatttaactattccagactacgtagataaaatataatttgagcatgcaacgattatagtatggttcttgtaaagatatcactcatacttaggaagtcgtgcatgacccttcataactctcccattcctcagctcacccccggaaccctgccagggccctctgctccctataactgcacctgtccgtccttcttccctttttctgctcagcaaactcctcctcaccctggaaaatccagttcagatgttaccagacaattttttttgtgtggacatgcataaccccttctaagcatctcttatataacatttatgacatgtcacagccatttatgtgtttttataccccagtaaagttcaagctccatgggtagatgatggtgtctttctcatggtggtctccacaatactggtgcatagtaagtgccaaaagtcattggaaaaaaagaaggcatatatggaagaatggagagtgaatgaacacatttgtctacatttatgtcagcaagacagctaacatttctccctgcaccattccgtctaacctttttaagaaacagatgctttagccaaggtatgattggttggaaatccatctctaattttggcaattactcaacttgcactcagtatttaaaggaagttgaataacagcagtgtattagtactttttgtcagtgtaagattgtcttttatttatcatctctcaagctataggtaatacacaccccaaatcatctccagacagttaaggcaatattagcaacatacgaatatttaaagaacaagaatagcaccactatcttgttaaatctagaatttatactttcatttctggcctgccaagcaaacttcacaggacattatctgaccttaacaattatctgatctaacactgacagtaaaagaagctgaggctatgggaaaaacagcaggaatacaaggtgaatttctatcaccaacttcatctgaagcataagacatgctgccaattgtaccgcaaacttctgtctctcctcattgtctcatacatgacatgactacaaaatgatcagtgaataagctgcacatagaaattcaagcattatgctgcattcccagcacaaatatctagctatatgacaaaaaatagattatcataatctattatagtagagtgtacttaagaaacatttatatattgttttttataagtataaaagtaatacatatttcttgtaaacactgaaaaatctagaaaggcatgaaaaaagaaatgttaaattgctgtatgcgctcccctcactatcaataattttgtgtatttctattgaaatgcagagacagagacaggtctacagaattgcatgctactattttcactaacacttcattatcctcatatcattaaatagttatcaaaaacattattttaatgccttattaatattccaatgagtgaattcaccaaaatttatttgaccaatttagccatttccctaacatcgtcactatctttactgtcaaaatacaatgaagaatcttgcaagtatttctttcttggtatttttatttcattaaattaaattcctagaaatgtaattgctgggtgacaatatgaggatttttaaggcttctgatttataatggcaaattgcccatcttatctgcgttttctaagagcagcaagatccacttaaatgagaataatttctacccttccaatagaagaaaagtagttttgaaattacccttacctagaaaacttccaaagaaaagggaatattagcaaaataaggtgcttctaacatgaactatgtttatgaaagaggactctagatcagattcaccagaggttaatgaggtactagctttgatagttttattatctttacatttccatactgtttaaagttagatgatagattctatgtaattttaaaggattctccagagagttttaaggcctgatttgaaatccaataagatgttcattatataccatatatctttgctttacagaaaaatggcaggttttatacagaaccattaatgaggtaaaaattaagaaaataatgcacaggttatgaaaatttttttgtcttcaaagaatgataaatgaatggtcagtcatttacattctaaattattaattcttataaagggttgattactttttaattgattctttccaactttcatgtaatttaaattatataccaaatctagcaatggtactcatccaaacaaaaaatgagaaaagctgataatactaatgctttgtgaagctggaaacaccaagataactgattaaaaagtagagggaaaaaaatcaactgatttgttttgctctaatacagttcagtcatttcagtattcagataataggagatgacataacgttttggactgagatactgaaatccaatttaagctcatcccttaactacatttgagcctaggcaagttacttcatggctagcacctcaattactcacctgtgaagtgtgagcattaaatgatgcagtgtagctctagggtctaacttgaagtctggtacctgttctttatagtatgaacccagggctttggggttaaaatggagaagcactagaggccatagcttctattccaggggatgtcattggactagttctttctggagctcccataggaggatccaggctcacgctgggttgaccttagtgtgcttccttgtttgggaatgatccagactcaaggtccacacttgccacacacacactctagcatcaaggtgaccttttttgagggcctcccagttttaaaattggacgagttgtttgtgtttactcaacttacaaacaattcttggtccaactgagttatagaaaagcttttgctggagcaaacatcaaaaaatagacatttttggtgtttttaccttctagtttttctcccgagggaagatataagagagaatgaattagttatttctcaaagcattggactcttaatggaagaaaatattcaaagactattccatgaccttgtgaccttcgaagaacatatacaccaacatttcagcctgccagagaaaagaagaggaggaaattagcattgctgtttctaggagaactaccttcacaaatatgtgtccactacaatgataaaaataaaatcaatgtgggacaagttgaatcacatgtttcttcatactttatgatacgtgatgaaccctgagaatatgccttaagagttccaatacaaaagtaacatgcttggattaagaagaattcctttctctttgaaaggcttactttgatgacaaatcttaactgttaagtgcccagtgctgatatcctcctgggcatggagacagagatcaagtgcttggtacagacaaatcaaagatttcctctgccactagctgatatgctcatgctttcttgatactatgcgaatccacttggaaaaaagaaagcaagacttgttaatgcaggaagatattagacatacaggcaaatcaaagatagaggggaattgataaagcatgttggcttagagtataattttgatgcgatgtattcccaggaaaagtaaacacattgataaactcattgctcttgatcttcctacacagtttctattgacatttctttcagctccaggcacagattagagagtatatggcccattgattgcatttaggactcttaatgacaggaaagaagattgaattcctctccctatatacatagggaagattagtagcatttctgatcttaacacattcttggatttgcaaatctgttttcggaatctgttactaattcaataattatttcaggggatgcttttattgtaatccttaaaaagttgaaaaatgttatgctatatatgacaatttaagttatagttttgagcctctatacaaataaaattttgagaaagctgtttgaaaaaggctcacatcgttcttgtgttgtgatgctttccatataatatcaatcatatgttttacaaacttgaagcctagcgagagttgatattcttatttagagaacattttctatttaaatttaattttctacttttacttagtttttaaaagttaaatattcccaagaaaaatgtacttaatgccagtgacatcagttattagattccaccaaaccatgtccaatgttggataggagacagttaacctgcacccatttgcctttcctgggctttagactttgacaacattctttgtatattcttggtactgggcaaaatcctctgaaaagctttccagggagatatactggggccagagacctatttatcacaaccctgcactttaatagagacaagaagctcattcccatcattaggttattagcagctgcaaatagcctaaattcacttaaaaagtgttcatagaaagtggttataattaattaaaatcagcttgtttattgagaagagaaataagtcaattaaatagagatttgggagtatgtattgactgggaaggatcactataaaatttatattcacacagcccataaaatgtcgctggtgtacgacgtgaggaccaaatcagggaacgtcagtataaacatggcagaatgggcacatgggtctttgtagcagttcaaggagctctttcctccatcccaggaaaacagatgacttctcttcttcaccctttctgcagaccagaagttgattctctagagaaattgattcagaggctttggacatgagtccaaaacagagtagggtttgaggtgtcagtctgaaaacacattgaatataatgctgcgcgctgatctccaagatccctgccctcttcccacattgctgctcccagacagctgcagcagctgtgtacccctcatccttttcagaagaaaatgaacaacgctggtgaaaatacaaccacatactcttcaatgtgagcagacagctaacgatgaccagaaggtagaacatcctcgatgcgaagcacagaccagaacaaattaaaaaatgaaagaattattagaaataacataatatgggagtagaagatttcaaaatagatatacattttaaaagatattacatatgatgtaaaataacaggatgttgtaaaaacaggaacgtcagaaaataataaagtgctcttgggaatttaagataaggtagaagtgtgaaaaaaaaaaaaagaagtcgaggatttggaagaagttaatgaatttcctagaaagtagaacaaaaagataaaggcattaagagagagagagagaaaaaaaaatctaaagttctaaattaaaagggaccatcaaacacccagcctaataaacaaggaagaatgcatatacccacccgaatcaaaaatattagaatatcggggacaaagactaaatacaagtgttgggaaaagatgagtcacccacagtgaatagctttcaaccctggcatcaacagcagataacaggaaacagcagagatatactctaaaattctgaggggaatatgattttcaatatgaaattctatatttagccaatttatccatcaaacataagagcaaaataaagacactttcagacatgcaagaactcacacacaaaaaaatatcactcaaaaacctatcttaagacactgctagagactgtgattctgccaaattaagaatttaactgagagtgagtaagacatatgagatacaagaaaccgcttcaaacccaggaaggtggcctttaggaggagatagtgttgatgggaactgggaagtgtgactgtgggagaggagcttccgcagggaaaacaaggcttagactgtttagtattgtttctgtgtatttggtggggggcggggaggaatcttgctaggtatttggcagatctgttggaacactcagggaaaaaaatagcaataaatgtaagaaaaaaacatgaaaatatgcaataattttgaatccaaatgaccgcgtaaagactcgtaaggacttgcagtcaacagtgagctcaaggtaagacgctgcgcgcatagtcacggcgtaagatggcgaggtgggggtggggagagggaggaagggcgggggtggggtggggtgtgtaagtcagatctttgccttctgtaacaggtgttcactaatagttcattctgtaactgtgtctaagtttcataagacaacaaatagaaacataaagagtttggcgataactgaagaaatgcctaaaaagggttaaaagtgcttggggtatgggattgggcatcctaactagaaaagaatggagtgtgggcttgttttttttcccccattgtaagtctcttaatactatttcattttaaaaaataagtttaaacgttaataaaagttaaaaagttcttaagaaatgaaagatgggaaaagggatgtatgctttaagtgttcagggagccaaaatcctgtgacatgccccctgggccagcatgtaaggttcacctgtaggaagattacaccaacaacacgtttccgtaaactttctgcataaacaagtctctgagaaaattgttaacaattggatgaaactggtatccaaaatacagtaacagtccataaaatatgaagcagaggaacacaccttgtcttctgatttggcgctcagtaaatatgtacataatcacttttcattgtgtttgaagtttcatgctgtatgttagtgtctgctgtgaaagcttctataacaactttccatgacccagttgtcctatggaattgtagaacaaaccaccacctacatgtctgacttaaggcaaatcacgaacctttatgatttttaaaaatctgttgactaacattgattgtatcgtacattatttatagagatatttatgaataggtttaaaaatagaagtggaggaagcttcaaagtggaacttattcagttattgtaaaattggaataatgtgtattgaaggaatctctttttcttaggaataaagaaattatgataaagagatagcatcatctaaataacactagataacatgataagagggagatgtggtctgttttgttatttagaacattatttcaactcttaatgtgtgcttatcttctgcaagatgagaaaagcttataatacctctaaacgtttttggaaatactttttttttttaaagaattttgccttttaaaaaaacttttaggttcaagggtacatgtgcaggtttgtggtacaggtaaattgtgtgtcatgggggttgggtatacagattatttcatcacccaggtaataagcatagtacctgatgggtagttttttttattctcaccctcttcccaccctgcaccctcaagtaggccccaatgtctgttgttgccttccttgtgttcatatgtactcaatgtttagctcccacttacaagtgagaacatgcagtatttggttttctgttcctgcattagtttgcataggataatggcctctagccccatccatgttgctgcaaaggacatgatctctctctcttttttatggctgtgtagtattccatggtgtctatgtacattttctttatccaatccactgttgatgggcattgatttcatgtctttgctattgtgaatagcaatgcaatgaacatacgtgtgcatgtgtctttatggtagaatgatttatattcctttgaaaatatacccagtaatgggattgctgggttgaatggtaattctgttttaagttctttgagaaatcacccaactgctctccacaatggctgaactcctcactggcagtttgtaagccttcccttttctctgcagccttgccagcatctgttagtttttgactttttaatagccattctgactagtgtgagatggtatcccatggtggttttgatttgcatttctctaaagattagtgacgttgaggatttttaaatgtttgttgctagtgtgtatgtcttcttctgaaaagtgtctgttcatgcctttgactactttttaatgaggttattttttgctttttgattagtttaagttccttatagattctggatgttagacctttgctggatgcatagtttgcaaatattttctccattctataggttgtctgtttactctgttggtagtttcttttactgtgcagaagctcgttagtttaattaggtcccatttgtcatgttttgtttttgttgcaattgcttttggcaattttgtcatgaaatctttgccatatcctatgtccagaatagtgttttctaggttattttatagggtttttatagttctgtgttatacatttaagtttttaatccaccttgaggtgatttttgtatatggtacaaggaaggggttccgtttcaatcttcggcatatggctagccagttattccatttacctttccacattgcttgtttttgttaactttgttgaagatcagatggttgtagatgtgtggcattatttctgagctctctattctgttccattggtgtatgtgtctgtttttgtaccaataccatgctgttttggttactgtagccttgtagtgtatgtcgaagtcaggtaatgtgatgtctccagctttgttctttctgcttagaattacctcggacattctggctcttttttggtttcatatgaattttaaacgtttttttccaattctgtgaagagtatcattggtagtttgataggaatagcatggatctgtaagtttctttaggcagtatggccatttaaacaagattgattcattctgttcatgagtatggcatgttttccatttgtttgtgtcacctctgactattttgagcagtattttgtatctccacaattctcattgtagagatatttcaccaccctggttagctatatttataggtattttattcttttattggtagaagtagtcttttaatccacaaacatttattgaatgtcaactctatgccatacatttcaaagcacttgggatatgtcgatgaacaaagcaaacatccctgccctcacagagcttaaattctagcagacaagacaaatactaagcaaaataaatgagtcaagtatacacacacacattttatattacaaggcaatacgtgctataaaaacagaaagatgagtatgacggggttgtagggaacatccaatttgaatattatgaaatggcatctgtatcttttgagcaaaaacttggggtcatgttgccctatataagaacagtttaaagggaatgatgaaaaagtctgaaggcacgtgagtaagtgagaacatgggatgaggaatgacttgtaaacatcaagtacaaatgaccctataaaacaattttcgtgccaacctgaacatcaaaaaaaggcaagataagattccatttgtctgttggtttaagatgggaaaaataatagttggtagaagtaacccatgaagttgaaactgaagaaggaatgagatctagagcacagagaaaaggactagctagagatacatgcgaggctagttcatctgtggtcctggctgcatagcatcgcatatagactcaagtagtgatgtggtaggaaagttgacatgatgctagggatggttcttctctgatcacttcttgtcatgagattattggataaaagtcaggatgtggggaggtgctattgatctgagcaaagaaaagaatgtagaaaagaaatgatgtaggaatgtagaaaagaaatgatgtaggaatgtagagaattgtctaggaaagtagggaattagtgcactaaggaagtatgcatgattggaagcataagggtgtagtcatgagtgggagtcaagggtgtaacatgagaccattggcgtggttgtatttttactccagccatattcagctcatgggtgcagccctgaactaggcagaaagttgagtttatttaagatgtggtgttttcaagtgagaatgcagcattgtgtatgcaaggagtgtttaaattagttgccatgtaatttgcaatataagctggaaaggaggggaggaaaggtgagagacagtgaggagggagtaggatcagtggatcaggagggttagaattagaggtctgtaggcatgaactagaagtaaaagaggcaggggtaatttagtgggatggtgggcctaagatttcagattggttgctaactgcagcttttggcaaggacaaggtctagggtgagtccaaaggccagagtaggcagggtgttataatttcacgaaacacagttcctggcagagccttccttactccctcagagggattcacatgcctcactctgtttccgtaattccctatgagtatgcattgtatttcattttcattgttgttatattcggttgaaccacacaaaatggccaatgtttgactgttttgcctgtaaaaagggcagattcatgtggctcaacctaatgtttgtactagtctgagctgcttaagaatagggactgttacatttctctatttctagcccttatcacagtgtctctggtataactggaattcattaaatatttgctgaataaataaataaatgcaattccattaataaaattcacacaaaaaagtttgaaggcaacatctggtgtatttcggtgggtggagtttttcaaagcatactggagatttaaaggaaagacaagggtgctttctggagacattggtgattgttgagtaggtgtgatggcttctttaatccaaatcagacctgtgttctgagcttcggctttggtggttatctcttccattgagtattgccagcacctggacctgcacaggaagtgcttcccatggtggctctgaatgtgggctgggggttccatccttcacagcacgtggccatgcacaggagcagcagccatctttctacacagtcatagataccacacaggtgcaataaaaccggaagctctcctttctgctttaacagacacagttatttcactcgcagacatctttcccagaaaaaaaagagatgcagatttagacttattcaaatgtgttcatagcatttttctgtgtaatgggattggttggtcccctccttacatcacagtgactgtcataattccctgcttctctctgaggtcccaagggaaactagagtctttgagcacctgctgggctgggcagtgatgggtcctttatagccaccatctgaaaaaacagaaaagggcaggatgagcagcgctcaaaacctcccactactgctgctgtctgtccggtcctagacaagttgtctgcatttgttagatgtggacgaatagtagtaccaacttctaatgttgcagtggggattgggtaagtgaatacttggacggtgtttagaagtacctggtacctgcctactggtcactgagcaattcctccaggcaggtgccacccatggccacttactgcacatacattcatcactaaattcttttctccacttcacaggttacaaaactgtgcttagcaaagttaagtatctgaggtcttaaaaaccagtgcatttctgtcagctcctctttaaaatcctgtagtgcttcctgtatttttgatcaattctttcacaaactggcctgtgcattttctgcaatctctgtttgctaccaccacaggcctttgatttgcagaagagctggtggtgccatattatttcaaggctttagatagaagtgtattcatgatctcacctttatctattggtcatccttgtctaaataattcctacctgtctttcaaagctcaccttgatcaccaccttctccaggaagcccttcctaacctaactccatgtctgactgtgactcttttcctctccactcctggagaaccttgttcattttctcctcatgatgttcatcacagtctactgtggtccctagagtacacaccgagtgcctccgacaggctgtaagggcttcaagaatacaacccacaccttatttgtctctgtgtccttgacatccagcactgtccagcactgtgcagagtagcagcaataagcgtcttttaaaataagtgagttaatggtgaagcctactgatctttgccatgagatagacctaaatgttactatctcctgcacaacttgtaactgaatgaactatgtttcttaaattcttaagaccacaacttcttcatttgcaaaatgaaataataatatcttctttataaaagtgttgtgaggattaaataagacaatgtatctaagtgctttactcaaagcatggtacatactagtcgttgaataaatgatattattgttaatgattgttacttttaaagccagggttccaaaatccctgttctttccactacaattgaaagtccctccttgaaaacaaggtaagcacacagaaagcatagtcagtgttgtggtctcaatagtacaatttagggtattactgtgtgaaattgaactaccctttcaatatttaaactacttggttagaaatgtccaaagtctatgctaggttcttttttctaatgaaaaaaactgtactatatatgcacatatgaaatagttattcttagctgaattctacagaatatctgaatagtatgtatccctgaacatatatatggggcataattttaaaaatataatagcctaaagtgttacaaaatacatattatacaaatatataatattgtaaaatgctttacattttttattaatgtcaccatgcagagaaagatcagagttcacatcatttctagtcttggccttgcctgtcacgaggcaaaattctttatgttgtaatttcagtgacagtagaatgtctctctccctaaaataaatccactcccctcctgttacatacacatacctgctgggacatctaaagcttaattctttgaacttaagcctctgatctctgttaacatgaagataaccctggaaagagaaggcttttacttattattagctacttgcttttaagtgtgagtggctttcagatccttctattaaaatagatcgcatttaggtaagggctgcaggaagagaggatgaggccctgtgggcctgagagaaaatacagaagcaagtaaatggcaaaagaggcagctccagttttgttggtgagctgcgtggttccatatagaatttcacttcaatgtagacttctaaatattcccagtttattcctgtggactctgtgtttttttgttccatagctcagataaacatgttacataatttgcattattttaaataattataaatattagaatgggcatggtggctcacacctgtaatcccagcactttgggaggctggggtgggctgatcacctgagttcaggagttcaagaccagactggccaacatgatgaaaccctgtctctacaaaaatacaaaaattagccaagcatgatggcaggtgcccataatcccagctacttgggaggctgaggcaggagaatcggttgaactcaggaggcataggttgcagtgagctgcgatcgtgccactgcactccagcctgggcaatagaacaagactccgtctcaaaaataaatcaataaatgaaatataaataaataaatattatataaagaatgttaattagtaccaataatgatcatgtgtgctctttaaactagaatgggaaaacatacttagaagtgctcagttcattaatgcctgcgtgcatatgctagcatggaagcagaaaaaatatttgcacacacatccctcgcacacatgcacacaactgtttcaggaggctcctttgcccttatctgtgacccacattaagacctccaccttctcttttcagcagaccacagccccagaccagccctacaggagtttgctccaagcgccactggcctggcccagcacacaggttgcctcgtccgccgcctccccacagcacctttcctgaattctgtcggcattgagacccatctcctctttctctgtctctctttgcctgaccctcgtccattctcctagtgggcaggatgctgtcagctattgctatttggagggtgagatgacccctgagtagaaataactcctataagttcagaggttcagcctttaacaaactcacattcctgtttgactgacagatctcccagaaaggaaaataaaagcaccttgaggacagagctggaagtagtctacctgggtattctccacagctgcaagctcaatgtcctgagcttgctggtactcagaaaatgtttaggaacttctttttacattgagggtagtgcttatgggcaaaatgaatgcccatgggcctagccctgagatggctggacagcaagaaaggagaaaggacagcatgggcaattttccacacatgttttaagtttacagggggaaagagaccaagagaataagatcaagtcaaatcaaacccatgtataataataccattaccaattgttttcttattttatgttttattctgattccttctaacaaaagttcacacacacatacacacacacacacacacacacacacgttcagcagagctcaggttgaaaataagtgccagtccttataccaaaaagtagtatgctgtgctttgaaattcctgaaagctcatttgctgcctcaccctccctctccccatgtcctatagaccctgtgttccggatccatcctttgaattcactcggaggcaaggtggtcatttcttatcaaaaggcgaaatctacaaaattatggcccagtggcagaaaggaagtagaatgggcagccctaggaagtaggatgggcaggtcccatagaacatgggacaatgaaaattcagtatgcttgttcctcccaatagttcctttttgaatgcagagacaaagttaactcaactggtctttactggaattagaatgctgattggtgagtctctcaatgtgagactaatgacatgttagaggtgtgttaatgaatttatgtaaagggagacaaaagaggaaccagggctaatcaaaatgccagctattttaagatctttgaccatgtaatgaccttcatacatattatgcaccattagtattcatgacaattatagctttttaattttctcggtgttataaaacattaatcatctgtaccagcaaataagatatttttgcctgaatagttcatataaaattttggcaatgctaaacttgcaaagtatcatgaaatatatttcaaaaagggccgcaaactgaaactaatccacaaaactctcactaaattctaatcattgacaatttgtggtgtcataatcaacatcagcgaagaggggtttcaaactcttagtgacttaaaatcttcatctcttcatctgaaaattcatgaaataaatacaaaaaattagctgggtgtggtggcgggtgcctgtagtcccagctatgtgggaggctgagggaggagaatggtgtgaatccgggaggcggagcttgcagtgagccgagattgtgccactgcactccagcctgggcgacagagcaagactccgtctcaaaaaaaaaaaaaagaaaaaaaaagaaaaagaaaattcatgaaatatggtatttgaaggtcaaagaggtttatgggaaaataggatgtcaatgcttatatatcctgagaaaaagtaaccacttgcctacaaataaaatgaatccagatactttctacctttgctgtgtgtgtatctttgctactcagggtcaagtgtgatgttgtcagaaatgactttggcattactctgaacaagcttaatgggagcaggaaaacatacatgtagtgaggcctgtggatctggctgcctctcacatgcaaatgaggtgggggagggaggaagtaatgatactggggtttcccaaattgtggcccaataaatattaaatcagcaataaaaaattgctcaattcaactgtatctattatatttggttatagaaggtatattcttttcttttgccatgatgcacagcgactctgataatcctgagggataactgaactctgaatctacagagaagttccagcaccatccttctgctgacagagcacaaggagacagtctggttggaaggggaacagtcatctctgctgagtctttaaagggaaatattttatctgttcatttaaaaaatatgtgttaagcacctactatgtgtcacacagtatcctagcactgtggatacagcagcaaaagcaaacaaacaatagacaaaagtgtctgccttaatggagctcacattctaatggaaggaaacagaatgaaacaccttaatagaaaagcacatagtatgtatgatgatgatatgcactctgaagaaaaaataaagcagagagtggcatgaggagttttgggtatgctgttggaataatttaaatctccctgagaacatgatggtagtgaattatgtgatatgtgggaatatgcaggcagggggatctcagacagataacatcgcatgttcaagggcagcaagaaggtcaatgtgtctggagtgagcagtgggtgaagagaaggagataaggatgggaccaaacccagtaccatctggtggactagagcacagattatcttttgctttgaatgatatatgaagccattggagacttttgagcagattcatgatcagatttagattttaaaaggctcatttgggctaagtgttgagaacagacttcaagaaggtgagacatttaaagctttcaagggagagaggatggaaacttagactaggatggaaggggcaaaagtggtggaaggtgacctaattctggatatattctgaaggtagtagcatcagcagatttcttactggactggatgtgggaagtggaaggaagacagttgaattgggatgatgccatggcttgagcaaatggcagaattgagtagttacttaatgtgaaggggaagactctggaaaggatgagttttttggagaggtatattataagttctgtacttgggtatactaagactgagatgtttgtcacacttctttcatgagattcagcgaagctgtgtgtcctggcctccttgcagtgagtctgggtttgtgactgagctctagccaataaaaagtgagcacaagtattatgtgtcacatccaggctcagctgtgaagacctcatgagtatgatgctccaagctctttccccatccttagaggattgctgaaaggagaaggcagaaccgtaggacgaaaagaacccaggaccccaaataaccaggtgcaaagccacctgccaacaaggaatgattgcgatagacttcggaagcaagacatgaatttttgttgcatatgaccactgagattcagtagtttatctgcatataaccactgagattcagtagtttatctgagacagaaattagtgttgcactaactagtacagtgtccagattggacatatacttttgggagtcaccaactaacagatgagtgttagagtcatacaaatggatgtaatccccaaggtaatgaacactgattgaaaagaaaagaggtgcaatgattgagcttgggggactccaacatttagagaccaaagagatggggctgaaccagcatagaagccagaggagtggccagggaagtagggcaaccaggcaagtgtgatatccagaaaaccacttaaagcaagaatttcaaggagtaaccaactgtaaaatgaagctgatgggtcaaatcaggtaataaattggtcatttcattatgagaaatataggtacttttgggagatgattttatggtagaataaaatacaaccatgaaaattgggaaactcttagattctttaaaaataataatcattgtttaagaagagaatcgtacagaaagtctgttgttctaaatgatagtccagtgaaatatttatcattcactctctgaatctggaactcttctattggccaaacattccctttttcttcatttctggacaagtgggaccctgagtagaagagctgtttccatttcccttgctgtttttggtttgtgtgtggtggtgtttttcatcaaaaacgtagaggacagaatggatgttttaagttggggagcaggagatgagtgaatccaatatcatctgtcaaatccttcatcctgttttgtttcattctaaagtacatgagaggctgaaggattattaccttataataattttaaaatgcatcctatgttcccacttctgtgcacttttctctgttcctgtgctttgagtatcgggtaagtcactctggaaatgtcactcgcattaaaatgaatggttttgatcctcaccttggaaagaacagatgtctacttcccctgcctcatttcatctgtttgctttagtttttcactctcttgttgtttttaattctgaagcctatccaatgtatcttcttctatcaaaactgtggtaaaaattctatcagctcatccttatacttttagagatgtttcaaatctcctgctcagcttctccttgctggtcagactctctcccttcattatgagcaagaaatgccgggactgtctgcctttatgttacaaatgcaggtatggtaattcactccaagtgtatatgctgaatattctgaatctaccagcttgtctgtgtcctgttaactgattaaccagtcatgtggaatagtcctagcaaactgcaggcctatgaaaaatccacttcacatttgatagatcacgtcttgatgaacatttcagaaattgataggtttatttgtttcaaatcatgttcttttaaaaatactttctggtccaatttttatctttctagacatgttgcatactaaattctgaaagggtaagcaatcaggtttttaacacgtgccctttaaaatattgacatgattcaatactttcatatttcgtattcaattgttcttagccatttgcaagtgtcttcatatgtagtttgaaacattagaaaacttgtctatcttatttcccttacctctgtgctgggtggctcgtagttctttaagcctttctgccagtggtggtttctaactagactgttgccactgaacgctgcagggaggaaggtgggaagggcaggtaaaatggcagtaatgcccatccgtggtttcatcccttttcaaagattgaatctgaacagtaaatgccaaacccaatatgaaagtcatcagtttagagttacagaagggtatcgactcaatgttttctccaggtcctgtgtgtttttacctctcacttccaacataatgccaggtgggcaaggacccagcatcttatcctggattatgtaggggtaccaggttggcccttccacaaaaccatcatgacagcatggacacctggatcaggacagtcctttctctcttgttgtcagaaacacagtagtgtgcaaaaagatttcattttttccccacgttccatctaactgtattttattatttcaaagaaagtggtattaaactctttcgttaattaaatcaaaattgaaagttgtaaagccacagtggaactatctcctattcagaatttaagtgtacaactttgaataaggatatttgtatagataagaaatcccaactagaaaggagtcatcgtgtgcaaggaattcctactctgctcctaaacagcattgattcttgtaagaataaccagaatttgctaacacttcttgagcctagtttaacttttattaatctgccattttataatgttgcatatatcttgagttattaaaataacttagttatttcatagttcaacaaaacaggcaatagttctccttcctgcttcaaatttgtattcatattcatattctttatgtacttcaaccaaaagttcacagcatgttctaaacataccacttttggattatgcatgatgagctagtcaagtttgtaagagagtgtgatgggcagaataacgggccccccaaatatattcgtatcctaatgcctggaacctgtgaacacgttagcttataaagcaaaggggactccatgatgcagatgaaaataaggttgtgaatcaactgactttcgatcagggagattatcctggattatgtaggggtgtgttgtcatcataatagtcctaaaagtgcaagagggaggcaggaatggggagtcacaggcatgctgtggagatggaggtatggggacatgagccaaggaatgtggtggccccaggcagcaggcaaggacaagaagacagattctccccagagcctgcagaaggaacatagacccgctgcttgattttagcccagtgagacctgtgtctgagaactgacctacagagctgtaagcaaagtaaattgtagggctttaagtccctaaatttgtggtagcttgttacagcaccaataagaaattaatgcagatatgcatgagacatatgtattcatcaccttctctgattattgattacacccattttaacctggcaggcataacgactgtcatgatgggcttgactgaaacatttcagtcagcaaaccaaagatggatcacttaggccccacagtttgagtttctgggataaagttttcctctgactttccggacacgggcgggagcttggaacttggcaaggggtgagctgcacggctcctagtctgcccgtccaacctcagaaggtcaaagtctctccccctcccttcttctttaacatggaactttctgcttcctgtcagtattatctgataatttcctgccaactcccctgtggtatttttggtatcagattattacataccttctggaaattaatatttcctgggaatagccaatatacttacttcctagatttatattgctttctacagataagagcagaaaatgggtcaaaatacttacacatacacactgtaccgtgaagaagagctcaggaaatagtgaagatgattttcagtacctacaatcgagaaaataaaaatacatttctgagtaattaagaaatatttgtgaggtgttaatgctgacattgtatttaatggtgaggcgtttgatagaaaatgtgtccttaccatcatctgttacagcgtctggtgggagacacaatggagagaagggaagagatgaggcttggggacaggcaagctggtgcttgaaccccacatctagcactcagccatagacttttggaaagcttctcaccagctcagggcctctgtgggctcacctacaacatggatatggcaggtcttcatacgtctccgtgtcattttacctggtgaccagcttaggtctccctggcctttattttgagccttatacctctggagagttgcctaatgggacttggttcctcgtctgtatgttcttagcacctaaaacacatttccaagatgaatcccttcacccttcctcccacaagttgtcttttgctttgttttccctatctctgttgggcagcctgccaacactgacagcctacactgtcagccacagacccaggcattgccctgcatttttcctccccttcgcctgacagcctggtcataagccaagtttatgtcgccttccagtatccccgagctacattccctgttctccatctgtgcctcccgagtccagatccccatcgtccatcacctgcactatggccactgcttcccggctgtccttcttgccccactgccaggctttgcaatccattcctccagaggggtctttctgatagacgtgttctatcattaaaattcttccctggccgaggcaggcagatcacttaaggtcaggagtttgagaccagcctggccaacatggtgaaacctcatctctactaaaaatacaaaaattagctgggcgtggtgccgcattcctgtaatcctagctactcacaaggctgaggcatgagaatcacttgaacccaggttgtcgggggtggctgcagtgagccaagatcatgccactgcactggtcgacagagcaagactctctctcaaaaaaaaaaaaaagtccccgttttccttcacttacaggatataggccttaggaagctactcaccttttctctgcctcagtttcctcatctctgaaatggagatcatcatgctttatttttaagtaggtaatatatctcatggtacaaaaatccatccagtgtgaaaaattttgcacctactcttgccccacccatccaattgctcccctgctccaaattggtaaaaaatgttatattttcttctacatcctttcaaaattaataaaatatatgcatatacacacccatatgcatataaatacatatatacaattttctaaaattccccctttcctatagtataaaacaaagacagagtgaaaagcatttagaaaaagaagcaaacttgtgcctaagtataaggtggatagccaaattgaaaacagcacaggtatttaaaaaacacatgtatgacattaccaaatttatcaggtttacagtctgtctgttcatacagacaaaaaagaaatgttcttgcatgattatcatagccacaaagaccatgacacattttcagatgtctgcaatggaaaatctgggagtaaaatggcttttgttagggtatcagtgatttacgggaaatgctcaaggtttcatttatcttgggaatgagagctagacgtatgaccccttgagtttctattggttggttgatctggtttcgtttcagtgttccatgtgatagtgttttcttttcctctgactgtagaacatgcttgctcatcatggtagcagggaaaaatgtcagtgttgcttgcacacaaattttgtagctggagtgagtattgttgttatttgtgttataggaaatgctcacttcttaacctcttttgtcctggagcatagaattactgcaaatgctcacccctgggagctgtcctgcccccgatctcccacacaaacactcagctgataggcagacacattagcacttaagagtccccttggcaggccccctttccagcattgtgctgacaattggatgggtactgcacgcacactaaagtccgctcccagcatggcacaggggctcccatcaacacttttttttttttaattattgttggtatgaccttattccttcctacttctttaacctactttccaaatactccccttcctccattgtcttgcacttcatgcaacatcaatacaaaaatatatatagtttattttaaaaatgtttctttagcattctgtttctgaaagaacgtatagctttagaacacatgatactgtttcatgctttacacctttgattgtgttgtcctctattctccacccttcctccaacaccttttctggtctccttatggaggagctgatttttattctgacagtgttttcctcatctctgaaaccccactgcctagcacagtgccaggcacattgtgaaaaaagtgttgaactcacataggtcaattacaaggctagacacaatagcctttcccaagtatacttggcttgtcggcagtaccaccaattaagaatgcaaatgctgtcctacactgcatttcttacttatctccagcatcaaaggaatttgaacaatttggctggtgggcacaagggaaggttatgcctcactgtatatataatcatttacacacttagtgctctcaaaaatgtgtcattctttcacaactcaaattttgcatgaagtatttataaaagataaagaaattgacatattttaagaaaatattgcaagaattacggatgtgagcatttgaagcatcattatacattaaaaatccataaagttttcagagatactgctattttggtgtagcatcaaatcattgttctaataaggaacacttttgaactatgaaatattattggtatctagagttcggtgcagataatacaattaaaatgtttttatatgatcatttaaaaaaaaagaatgcaaatgcttagtttaatgacaagtttcctgtttcatggcagactttttttttaaacaatgggaacactgaaaaaatatcttctaaatttctcgcataaatccatcatcctaagatgtcaagagatctggcttttgtaggtcagtttctatttagagtaaaagcagttgtttaaatggaccttgactccacctaaaagaagagtatagctgttttttctgcatcctgcattgcacatctcacaaagaactaaaggatgttgcttggactagaggaaaaggatggggactacatcttctgtattttggagcatccggggcttcacaaagtgcttgtcataaggcatttaacagtgcttgatgaatatctaattgaacatttctattataaaaaaaaaatacagcaaccacctggtgatgttaggttaattcctactacccttcgtccatagctgaatggctctttgttgtaatgtgttggatggtacgtaggtaaagatgggaaggcctggggctttgacttttttcagtcctactttttgggtggttgaagtagtaactgtcactagtctctcccagttgacaggataatcctgcaccacttagagacaattcagggatggtttgtcattcaagaggcttaaggtgggactgattcggtggcaccagaaacatctcatggagcagcgtgtgtcacagcatgactgtctcagccaacgatcccatatcatggcctgtttgtctcaggttgctctctaggatctcattagggatctcaagttcctctccagatgagaagacaatcaaaggagatgtgatggaggtcagctaccactgaaagaaaggaattccactggtagatttcagaattttacacatgtacacacactataatgttaaatggtataattcaaaataagacctcataagatgctgttgcatttggctcagagtacacccaaagacagcattttgaaacttatcatcattcacgtgagatttgtcaggaaactcagggaatattgtgccactgtgaataagtagagatttagaaccaaagtttcacctaatggctaaagaggtttcaaagatattttaatgagaagcttaggttttgtaactgaaagattcaacagaaattggctttgacagaaagcagttttatattcaatattctggttgctatggagtccatttgggcagattatgagtaatataagaataatataaacttcagcttccaaagacctgatgccctggttaagagatgcagtcacttgacaagtgaatgttgactaaatttttaaatgcccagttttataattgaatattcctgctgaaataatcaagatttatgcttggtcattcagtgactgaagaaaccttatttaggcactttactacatgtctagaattatgtcaaatgttagttccacaaagaattgcatccattcagagtctgagctttcttaatggctaggccagtgtcatggaaatagaggcaccaaaaaacatgagcaccgtcagaataaaaataaaatgcactaagcttgattatgctctattttaggttttgtctgtaaagaagtgatctgcttttgtgttatttatagagaagaccatatcagtgtgtaataatacttaaaataaatagtaaataaataaaataatcatgtatccactatgtgagtggtgcataaagttctagggaaagtgcacatttagatgtttgggatgtaagacccatcagactagttattgttgttagaagaaatatgttaagtcatataatggtcagtttgcactctatagaatgaaaatattaatatccataaaaatatgacacttttttctctatttggcagatagagagttgaggctgtcttctaaagcttgagataaacacacatcctctttctaggttacctactgaaataaatcatagatacgcaggtgacctgtgacaaagtgcagatctatattgtcagaatgaaagaacaatttgtgcacaatcactaatatttatatctggcatgtggaacttacattgcatcatttttcaaggtgttgagaagtatgtattctataaatgcagcatccagggttggggctgagcactgcgacatggattagatccacttgtcactgaaagagttcactgtggggttcgctctgctagccttgcaccctgtgcacggtccccagccgctgcctccagagacatgttgaaaggtagagtgctccactccattgtgcacatcctactcacatggctgggcactggggtgtgagtgtgtgtgcgtgtgtgtgtgtgtgcatatgtaggaaaactttccagttaaatcttaatgtccggtctttggaacacagaataaagtcgctctttctaaaagcaattcattttatttatagtaggcaccagacacgcacaagacattgttactctagaccttcataaatgtccagtttctcaaatgtggacagggttctgacttcgaccttatttctgttgagaatcatgtgtttcttgttcagattcctcatggtacaccttggtatactttttacatctattaaaatttctcccacaaaatagctaatttttttctcatacataaataatgaactaatgattgcatgagaatcatgtgcccaggatgatggtgatagggtgagctgtggaagtgttgatcagttatcttactccgtggctcattcgcttttacacaccaatatctatctccagcaaatgaccacgaggcaaatttgtgcgcagccaaatcacaaaagtaccccatataatttgcctagtaattttcagataaacacaagcagaagtgttaaatccataaatgtgagtggtctacccttcttcttcttctttttttttttttccagacagagtcttgctctgttacccaggctggagtgtagtggcacgatctaagctcactgcaacctccgcctcccaggttcaagcaattctcccacctcagcttcccaagtagctgggattacaggtgtgtgccaccatacctggctaacttttgtatttttagtagaaacagggtttcaccatgttggccaggctggtctcaaactcctgacctcaggccatctgcccacctcggcctcccaaagtgctgggattacaggcgtgagccaccatgcctgaccacttcttaactataagacaatttgactctagggactcctaataacacagttaagtactgggctcccacccaggggacatctcaggcacagctgagttttggggaagaatctgagtgtagcagcacataagaatatcaggaagaggattgtgtgcccaccttttaatctcttcatagggctgacccatgcacagttctcctgtgggctttgaaagtttgttccccaacttgagttagctgtgtgtgtcacagagtgagcaggcctgtgagccctggcagacatactcctgctgggaggaaacatgttctctttgtcattcctcgtaggcagccttcactaacaccaactagggagatgtcattgttctgaagttataaatgtcacattgcttctttcccagaggatttgattttatagcatggctattgtggactttgagatggttccaatttgtttggcatttgtcatggttgttcttcatctcctgaaagctatttttttttaaagtgtgatgtccttactttccctgctcaactccagtcccctttcctcaaatgccactggccagagctgtgtaggcagccaaggatcaatgtcctgccaggaccagccttgactcacttaaggacacctcagtgccctgtggaggtgctccaaaatttatattattaaggattgaaacaaacccctttaataatggtgatttctcaggagagaagccactgtcagcaatttctgcattgccctctggtttttccaaggtcgctcacattcttgtgcttgtgtgcatacaaatggacaaagcgataagaagcattagaagccttctaggaaaattgctacaaagcagagaatgttattccttacacttaattgtagaagtggacagtcatatagtttaatcctctcattgtcttggtgaagtaatcgctgagatacattaaataacctagttgagtgagctttgaagaccagctataccagctattgtgtgatcttgggctgacagcttaaactgtgccagactctccccgtctgtaaaatgaaaatggtgatatcacctaattcactgagctgttatgaaggttaaaagggttactgaacgtcaaacgttcagtacaatgcctatcatattttaaaaagtgttttctataataactattattactaaaacagatctcctgaccccacccagcagagggcttcttctatcattctatcatgtgttctcctggcaaaataaaaccaaaacctgtctttgtactgtggtggaagagagacccctgagctgaccatcagaactagaccccatggtttctagtcctagctcgacactaactagttgtgtgacctcagaaaattaacccaacttcttttgacctccatttcctcatttgcaacataaaaaccagagttggaaaaaccttttggaactcttccatctctaacagttctggtctgcatagacaaaaatggccccgcttatacgtcctatcttgcttcctactgttggttgtcaccatggccccaactaccttggtgttccccaaagaataatccaagacactcctctcagtagcagagaattcagaatgtttactttttggcatcttgttggtggggtatggcatagttaagtggatttatctgaggactagggaaatatgaatgatagtgagaacctgttctttgtgttcccagaaaaaattagacaagaggaagagggcttaaatatggcaggaggagctagacatcatgaaatcagagattgattggtatggagtcataaaatatcaaagtttactagtagaaaaaaatcctgacaataaaaactgaattgaattaccaaacaatatttggaatatctaccttagaaactttaaaataaagcaggctaatttttctgagatggtttaactacaactctgtccaatgacaggagcatgacaacattccacctattcattcactcactcatcctgcattgagtgagtgactgctgtatgccagtgccgacatgcaagacttctcaaaatttctttcagttctaacgttctcaggttttagcaagaggggtattgttttgccccaaaacaggccatctctcacattttcagactggtatccatttgtggcttttgtgctgggccgttgatcattagaaagtaatctgtagcctgaaaatgattgatttttaaatagccgaagtgtattaatcagctttttgtacagattgaaggagtatgtttcagctttgcatccttatctgtaaatgccaaaagcacaactagcttgaggtagagtatttattctctatgttctcgctgagaaattgtctaagtcgatttttgttgcctagataataatacagctttactttggtttcttggagtgcagcaatagtacagaatggattataagaaacagtgcactgtgactggcataatggaatattgtcagaagactatcagttttacccttttttatttatcttctgtgttattcccactaatatcacattataataaaattacatatttgaatataatcatattttcttttcaatgaaagctggaaaatttagagaagtatttatagaagagtttcttcctctagcagaacctagaataacaagctctcctagaagaccttaattatactcattctttttgtgcagtgacatttaaacacaatgttattataattatatgcataataagctatatcttgatgtcaacacatggattataaacccttctatttgaattaaatactggttcaaattaactaaatcatcttaggttagatagttgaaaagattcatgagtcggaggtagtttataatgaccatcaatagcagcacacatttcagcatttgttgaccattaatcagtcagggattatctgtaaaggcacagctgcatggagtggtgtgtgaatatacctttacatgaatgagcataaattggatggatatgcagctgctgtatccaagtcttcgtcaaggaaaatgaatatgcaatgttgatagctctaatgaattttattttagagaggtaaaacaccaactttatttgagagataactcattccctatgtatcttctctgctaatatagctcaggggtgtcagtgtggcgaaaggaacttgggagacatttttctagcgtcaccaggtatattcatacaaaaatacgtattctttttttttctttgagacgaagtctcactctgtcacccaggctggagtgcaatggtgcgatcttggttcactgcaacctccgcctcctggttcaaatgattctcctgcctcagcctcccgagcagctgggattacaggcacccgccaccacacttggctaattttttgtatttttagtagagacggggtttcaccatgttagccaggctggccttgaactcctgacctcgagtgttccacccgccttggcctcccaaagtgctgggattacaggtataagccaccgcacctggccccaaaataggtattttttaaaaattatttctttctcactaggctttcttgtctaacaaaagagattcacttttctctcaaatacggaggagttacttgacacagatcacaacagacttgctaatgagtagtatgaatgaatgatgccaatgatggtatcaatgcaaattgattgaggaatccattgaattaaaacattaaagttagacttaaagtcctattggcagatcttctatgaatagatccaagctcctactatgtctcgagagtaaatttgcaattacaagaaaatgaaccaagtcttatttaggacacctactctggtttctgatgttgttttggtacttaagcttaaatgtcaaataagcatctagattctccagctcatcctttgtgagaattaattggttgggtctaatatcatcgtttctttctctgtgtgtgtctcattctgaccctaacaacagtgtcatctccttgcatcccacaggtgttctctatgtgtcactctgataactattccacaaacttttctacatcctcccctcatatctctacattttacactcctcccttctctcttttctcctcagccccttcccttctttactgtcctccttcctttcatccttccagaaacatgtattatttttattgaaatatcttagccaagctgagggaccactacggatatgcagtaggcatttgatagacattcgtggagcaggtaagtgaataatttgtatgcattttagaagggtcatgtggacagcagcatgaaggttgaggcagtaatcctattagaagcctgctgcatccctgcaggcaggagatgatgacagtgactttggggatagaggaaaggaaaaaggtgaaagaagaggaagtcagctggtagaatgaagaggacttcgaggttgacttcatgaaggtcagctgtaaaatacagctatggagcaccgagaagataagcatttttgtgctgggaaatttaagaccaatcagcttaaaaatcttctcccatgtgaatcctttttgaactccctcagactgaattaattgctcccttatcttgatttccataatgctatatgttattaaaatatttgtttttgttgattttcagcatctaaaagttatgatctcccaaaggccaaggctgtacctgactctgtgttgttccctcctcatgtattccatgacttacttgctatccattattcttttttgaagtgtctactcagatcttttgctatcttttatcaaatttttcgttttcttattgttctagtttaaaaattcattatgaattttgaaagttagttgtttttttttaattgaatatgtggcttataaatgttaccttccagcctgtggcttgccttctcattcccataacattctctttcacagaggaaaagttttaaattttggtaaagtccagtttatcaatttttttcttttatggatcacactttgggtgcatttcttttatggattacactttggtgcatttcttttatggatcacacttggtgcatttgcaaaaataaagataatacagatttttctactatattttcttctaaaagtttcatagttttatgttttagatttagtctataatctttattgttagtgtttgtacatgaggtgaggtaagtgtcaaggtttatgtttttacatttggatgtctagggtttctttttgttgaaaaggcttccatttcttaattgaattgctactttacctttgtcaaaaattgattgactatatttgtgcacatctatttttgggatctctgttctgttttacagctctatgtgtctatggctttaccaataccacatagttttgattactgtagattaatagtatgttataaaattgtgtaatatgaatctttcaactttgttattttgaaatattggcttgactatgctagaccttttgcctttcatataaagtttacaatcaacttaacatatacaaaaaattatcctgagatttgattggaattgtgtagatctgtagatgagtttgggaaaaattgaggtcctaattatatctccctaattgtgtctcccaatccatgaacatggtatctctctccatttatttgtcttaaaacgtttgtaatgagcattttggtagtttatgtctttcaggaattgattgattttatctgcattgtcaaatttatgaggagagaattgttcctagtatcccattattatccttttaatgtctatggggttaatattgattttctttttttatccccaagattagtaatttctgattagagtttatcaattttattgatctaagaatcagctttagcttcatagatttaaaaatacatatctttctattttcaatttcattgatttctgctctaatatgtattattgcctttcttctgcttgctttggattggaattgatcttttttcctctggtttcctatggtaaaagcttaggttaatggttcaagacttttcttcttttgaaaatgtaatcatcaatgctacttttctcttatcacttttctctaatgctgctttagctgtgcccataaatttttatgatgtatgttcattgttcattttcattcaattcaaaatattttaaagtttattttgacacttcctcattgatccatgggttatttacaagtatactgcttaattttcaaattcttaggaatttttcttatatctctctgttactgatttagagtttaatcccattatgacctgagaacatgctttgtatgatttctattattttaaatgtgtcaagatttgttttatgccacaggatgtggtttattagggtgaatggtcccagtgcacttgagaatgtctattctgctgctattgggtggaatgagccataaaggtcagttagatcaaattggcagttagtgttgttcaaatcatctatatccttacttattctctgcctacttactgtattaattactgggagaggagtgttgaagtctcttaagtacagctgggatttgcctatttctcttttcagtcctattagtgttctctttatgtaatttgaatctctattaggtgtgtacacattgaggatggctacctttcccctccccctgccagctccatcaaggatgctttctcaggattcttatcaaactttcccgaatgcctaatagggttcatggagagaaagctgaccagagtgtgaacacgtttattctgcatctacagggcttctccctttttgatagcccatatttagcctatagcaatatattaaaaaaaaatttagctgaatcttcttaacagcttacatggagtgtttgcaatgctgggttttgttggtccctgtagatacctttctgaccccagatgcatcttggttggttgctgtccatccttagtgttctcatgggattaagaaaagttgttaatatactgtttatttacccttttccttattgtaagggtgggagtgatactttcaacatctctaagctgaaactagatgtctcgcagataattttgagatttgaaaatctctgtgtttttcttgttgccaccatattactcagcgcaacttgtgctttttgcccttttgcttctcttgttgtaggaatcagagtcccctgaagccctttgctgggagaattttacttacatctttctggacattaccaagccttgacttttcacaatggaagttgtgtatttttctgctgttttctttcatgtgtatctgctctgtgtgtctgcacaattacattggctcttctttggaaacaaacttcgtatacatctctgtgccacgctgggtttcactgttaagtacgtgttaaataagggtggtgatgatctcagtgataattttggtaaacattagtcacctttacaacctccaaaaaattacttctccaatgtcaaccttaactcttatgtcttctaatcaggatgtctgttgtgtttaggtaatataaattattattctcgggtgtagatctatttttttcttttttaaggctaaataattattagtcacagcatagtaatatgcaaccaaagggttatttaattcccaaaagttatgaatatcaatatcttaatattcaatagtgaacatgcccaacaatgaatgccaatcattaattacagttcgtctaaccttataccatttgaggttcagtttaaaattattaaataaaaaatgcacacagccaaacaatagtttctgcacataaactgatctgagccattgtatttttaagcagtaacacaaagtaaatttattttttaatagcttggtttgatgaaaagggatcagagaaatatggcaattctgtttttattgcttgaggcaatctcatttgcaaaatcatttcaaatcaaagttcatctatcactatgtaaacgacatggaataattttttcagtattgatatgtttcagttgagaaatcccacttcaaccactggcattgaggcaataattcctgttgaaaggtcaccttctcatgctttatttcttcttaacttctttacactactgatgtgcatgtattccttttcaataaactatttttcttatcagctggattttctgatggacagaaacagaaaataaccataatttgaacgctcttttaataattgagagacaatccaggagctaataaaaggccttcttgctagcatacctgttaatataatatttagactaatagtaatgaaacaagcttgaactttttatgaaaagcagttgtaaatattcaagtattatttggaattctggaacatttgggctccagggcttgccatcactttctatagctaggtaaaaggtacctgttttaaatacttagttctgggaagagaactatgtgcctcatggctctagctgaaattgcagattattcactcattaatggacagtgggaatttctcagaagagagtataagagagtttgattccacctagattgcctagttggccctcaactaccctaccacttttgatcattctggggacttcatgcagtcaaattattgttaatttcatgtgaccctcttagactcaaaaaaggccagtggtgttgttgatataccaaaacctaaaattgatcataaaaaatcatttgtaattgccaaactatattttggggaaagaaaatacttcatatttacattgaaataagggtcattctaaggttttagacattcaaagtctaaaacagtgtggtacaggcaagctgcaaacacagtcattcagttttcccacccttctggctgcaaaccaattcatctcccagaataatgtgaaagatcaacaagtttgaccctcgtatcaaaactgctaatttgtatttttcctaaagggcagagaaataatagtttagatttaaaaggtcttctcttctgattcttgcacatacataggccccatttattttaacaaaatgcttaattaagccaaaaagatgaccatatcagtaaaaatttgaaaacaatatttgcctttaaaaattcaaatagaggccgggcgctgtggctcatgcctgtaattgcagcactttgggaggccaaggagggcggatcacgaggtcaggagatcgagaccatcctggctaacatggtgaaaccccgtctctactaaaaataaaaaaaaaatagccgggcatggtggcaggcgcttgtagccccagctactcaggaggctgaggcaagagaatggcatgaacccaggaggcagagtttgcagtgagccgagacggtgccactgcactccagcctgggggacagagtgagactccgtctcaaaaataaataaataaataaataattaaaaaattcaaatagagatgaacccctgacataatcaactgtgtattcttttatatagaatatatacttttttttccacactcagatgtgcttaataatatatcctgtttttcttgaaggaaaatatgatcccccagattaagtaataatagtaatgaaataaaagattgttatatttgtaatcagtaattatgcaatcaccaaataagtggctggtatctagggaacaagcaattatatgagctatgattactaaagaagtaattatgatggaagataaacctctcttagttgcgctattttttttttctgaagactggcatttacataatggttcctaatccacagagaatatttgtttaggtctgagagaatgtgtatctgtcatgcacagtttagtacaggaacccttgcctttcacagccttgacattctcaatttcagctcttcattagtggtttgaaggacagtggcttcctgtaacttttctatggcatgaatttgaatcacttgctgtagtgtttctgcgggggaatctagactgccaggcaccacactccagtgttactcaggtccgacatgtagagtctcttctctagtgggaaaatctctgtttccaggaccaaaaaaaaaaaaaaaaaaaagaagaagaatacctgctattgatagtgacacaattaaggaaatatagtgaacacatagatacactaaaaagtggggagaattatagactgaagttgttgtaatgaatttggaaattcttaagattctgagatcatgatgtcgtaattaggaaggggctttaatgaacttggttgacaggtgagtcaagtcgaccagtgtccccttctcaggaatctgaccatcaagacttggttttaactggcacaatgtgacataagaactttactttagaaataatagcacttaaaaaattatatttggcaaaaataccttcatttcaggttattgttattgttttctatttgtctctgtttggggatgttttatgttttcttagctcattggtaattctatgtgtttattcatgctgcacatatagagaataagagctatggtaggcagagaaattgagataagacaagatcaccaatcgctgaaaacatatgatagatcaaaagttgcaagcaggtctcatgaaacatgtccaggagttaatttattttttgtaagcaatttcttgcatttaaagtgacgattaattatataaaccatttcttttgcaaacatttaaagattgagttttctctatgtacttggaaatttaagtgctttttttcagaatgtgcatccttttttgccttttccaatgaagacaaaaatcaaaataacttttgcctagtgccggtatcattttttaacctgttaaagtaatgctgttaattctgttttataatataagacatatttttaagtagacacttgggtttgaattcataggaacttagaggagtatatagttgagttacaactagaattaaatctatgaaacacctcttgcaactaatcttttaaagttgtttagtagtgtttcatgagtaatagtcatgtttattgtcttactcttctaagtcttaaccatgaaatgaagtcgatttgatttattcttaattttcctttataatggtgggaattgaatttaccaaattcagagtaattacttatttctcctaaaaagacaaaacaacctctcaactttgaggtcttataataatccacaatttgtccaaagtaatccttagtcattaaaagaagccaaatagtaagaataagacctcaagttgagactataccctcttccaagacagtcgttcaacagctcctgtctcgtgcatcctcttaagtttaaagacaggaacgttttctgaagtgtctcctttgaaaacagaaacctgaattcctgatattaaccaagtaagttgatacctatacaagagtaaagtgaaatactcaagagtttttgggtctagggtcaaactgctagggtttaaattcctgttccagcactttcaagatgggtgacaaaatcatgaagatgcttagtaattgtgtgagttgggcatgttacttaaccctgctaagcctcagttcccccatctataaaatggcaataataatcaaaatacctactaatagagttgttgggaggataagcaagataatgcaagttaaagtccttaatacagaatctatccataacaagtgttcagttaaagtcggttattattatttattcagctggaagatatggaatgcctgctctgtggtaggtgataggattcacaaatctcttctgtcatctagatcgggaactagaatctaaacacacaagtgtaatttgaggtccaagctgagataaacaggattggagtcttgaacttctctctctgccctactacatcctgggctcctaagttgaagagttaattgtgatttcgataggtttagggtgcctgttaaatttattttcatttatttccattttttttcctgaggataagcataccttgttatatagtaaaagagcctagcatactctgaaaaaggtagaactttgcctgtcagctgacaatctttttaaaacttcctttcaaagatgtagttctgaaacttcttaagaaacgtctgccgaggcacagctaatgtatgagtacgatcatgcctcaatgaacggcggggatacattctgagaaatgcatcggtaagcggtttcatcactgggaatgtcacagagtgcactttcacaaacctggatggtagcacctcctacacgcctaggctatgtgatagaacctgttgctcctaggctacaaacctgtatcatgtgttattgtactgaatactgtaggcagttgtaacgctgtggtacttgagcatctaaacatagaaaaggtaatatgttgtgctataacatcacaatggctagactgtcactaggtgacaggaattttttagcttccactataatcttatgggaccactatggtaagtgaggtctgctgttgaccaaaacatcgttatgctgcacattactgtatttgtatttgtcagcacttttgtttcctgttctttataaagtctcctttctgccaccatttgttctatgctgagttggtatcagtgtgaatctcatattaggaaaaggagagggaattagaaagaggtgttcacatagcctaaaaactcacacgacaggcacttctgtcacatttcaactaagccatatgctttattccttaaagaactttggttctgttagtcagaaaggtattcctgaattgaaataaaaattctgaatcaccaactcacttgcccggagacaaacctaccgggagtatattgctagactgaatccacctgaaacattggctttaatctgcgtgtgtgtttaaaccattttgagatgactttttactggagcatgtctatgaatggagcctgtgaaggtttgtcctctgtttgtgcagtttcttttcctaagcatgtgggagcagaagtggggctggaatggctgggcttggaggaggaaggaccatcaagccctgtgcttcaccaagtaaaattgtctgtgcctaacgatacagggcaaacaattactaggcttcagtgacttatagtaagacaagggcaataagggcaattccttgccagtggtcatagctctatgattagaaaaagaaatatttcttttcagaaagtgtgaggtagagaaagaggccttggtttaattcaacagttctttatcacagtttttcaaaaaatttccctcactagacccagccactctttacaaatgtacattcctgggccaactacaaaagtagggaatcagactgcctgagagatggtcctctgaatttctatgtttaagaagaactcagttgattctatgatcacttaactttaggagacactgctatgtgggcttagataaaaataagggaataaaaatgtatttgaaaaggcataataattttagaaaggtaacgtgtggtatgctgaacagacaggggccatcacttgttttaaagtatgttgcgttctggaccagcagcaaaaagagaggaatgccagggtccagagggcctccgctttatggaaactcgtacatgacgtgcagccttgaaaatccgaaaatggttatttttgaaaatattgaaaacagtgtgttttcagtctttgaaaccatatagtataggattagccttttccttctctcacttcgtcttatgtggactaggcttgctgataatgccaaccttttcgttttagcaaagggcttccatggataactaaaatgagccagaaccagttggatccacagggcttcccatctttcctaggatttggtgatggagtttgccttagtctgtagctctgtggaaaaactcccttctgtgctttagagcctgggtgaataggaggacttctgagggatccttctccaagctattcatgagtctggagagtcttccatgcacaggataaagaccacctccacctcctcctccagccatccaaaccctcctggctttgccacctgcttggactgctcctctctcctcccaaatcgtgcaaccatcttgaaatgcattctacagcagggattgcagagtggccagccttctctatggtaataatatgtgttcaatttatatttactggtttagtctttcgattttatctgaaaccagatctatggcattagacttttagaccttcatttgtccactttggccagtagagctcttctgtgcccagggcctgacttttactaaagatcatgatctgctctctaatgatcttcccactcttcacaagtgttcactgaaatggtctgatggatatggctttaatgtctatgtaaatagtcattaagtcgttcagccattatgtaaagacacactgtgacatttagactaggacacgcttccatttcccagtttctttctctccttctctttttttcttttagtacaattcttttttttttttttgggagtttcagaaagtgtttttaatagtaaaattttagaatagtctgaagattttttcctttaattttacaattttactattacattcttgacaaagaatcagaagaacattcccactttttgactttaatatccacagctgccattcctaaaagtatcactctatggccttcaaaaatgccagctacttttctccctcctggaatctttaatacatcttgaaactctagtcactttcttatcgtttgtgatgacgtaatgacttgctcagcagatgtataatttattaactttgagagagttctgccttaaaagtgttacttttgtggttctgctgctgtgtctatgtacttgttgacaatttacaactaatgaatttatttaggaagcaataaatctcaaaaatgattacttttcactactatatacttttgtttttatgctccaagtcacttctgactataatggtttgtggaatggctagcacaggatttcaacaaagttaagggacttaatacaattcttacaaagtcccttaactttgttgaaatcctgtgctagccattccacaaaccattatagtcagaagtgacttggagcataaaactactaagatagaagggatattttccccctcaaatattaaaaaaatggccacactgatgtttatataacaaaatttggggctattttgaatgattgggagttgcaccaattattgaaagtgaatgttttgtttatgcaatttttttatacctacttattttgcagttaggcagaaaaataaagcctaatggcttgaaaagaaagtccaactttttccgtactggatcaaaattaatctgaaatacagagccatgtgaataacaggagactcgggttattgaggcagaccctgagggagaattccagatttttcctgttgtcaggtgcagaccaacacagcagctgggactgtatgggtacattgtgcacatgtaaaataaagcagtgattcctctgtccatctttaatctcggggtcattattctggttagatttgtggggcaaatgggggtgagaacacatgaaaatgaacaaacttgtatgtaggaagctccatttgattgaggaaaactatggaattacagtgaggctgggcctttatgggagcgttgtagggtggaagaggctgtgggggctttccatccccgtgtgggagtgggaactccactgagtgaggctgtgtggatgtgtgaccagcagggccacagtgtcatggctgtccccaccccaccccaagggcctttttttgtttctcctccttcattcttcccttcccctcctttcctctttgtgagatgacagaaggcagtggtgatgggagtgtccgtatcacaggagaccttaggtcttcggatgaaaaaaattcaattatatcggactgggttagaactgcacttcccattttccccccattacccgtcgaactgtgtgttgcctgagaagaatgatttgctttctctgtgcccctttcttctttttaaccttcgtgcttgcatgaggattgatcagtagatgttttttctgtttctacacttctcagtccctttcatgccttctctctgtggttcccttgtttttcgcttgctccagtccttcttccctccccaggtctctccgccaccccactgcatgcatctttccttcactgctcacttacagagctgctgggatgtttcccacctgtcgtcagtccctccctgccctgacctctctctatccggctgaggctgggtctctcactgccacacatctttagagctgctgtgctagggtggctggggcccccttctgggcctacagctgctctctggggtccatgcgcctgtgctcaccttcctgatagatcccttcgggagcaagttatttgagttgtccccactgtcggggttaacaaatgctgctcatctgcagaaatgagagtccccatgctaaaaataatctgaagcaatacaggagagattgaagcctggctgtgtggtttgcttaggaccccgtggggtgaagccccctcaggtccccagatcccctgccacagtcacacaggctggtgctgaatggtgcctccaccagtgtttgggagctctgggtatgagatggctgaggatcagaggctgtgcttgtgaccatttggccagctaccaggccactctgccctcctgcctcatagccgaccttgcagagtggctgggaatgtgaggcctcttcactggccttgttttcctgtcccctggggccctgccgtagccttccctagcacttagcctgaaaccacagagctccctgcctgggtccccctcctgtccacctttcagtctgtgccccaggcagtggtcagggcctgctccatcagtgagccactctctttgagtacctaagtaactaaatgccaggttggatttctctgatgagtcagagaaagagtggtttcttagcccacagggcatggtctagctgtcctgcaaattgagagtgtggcgctgccagcaaccactgaaatgatatgtcttttagccatggagacgttcctgaaatatttttgtcagctcccatgaaccctgactacgactggccaggcctccctctctggctgcttcagggagatctcaaggctgacccacttagaggacctcacagccaaggcaagtaaggctcccttctctccagccaggattcaggcttaggtgccttctacccatataccacgattgcaggacattattcttgccttagctactctgtgggtgccaatcaaagttacagaaagagactcgtagcacactttaaggcagcggtcttcaaacaggtataaatataccgttggaaaaaaatgatggctctcaacaggatatgtgggctcagacttttcagatcatttgcttccttatatattgtgctaaaattaatctccacagtgctcccttcctgctaaggctttcacagtcagtctttctcactttatgagaaagagatgcacccatttggagccctctaatagccctggggtagcaaaaacctctcaggtgtcaaacaaaggaatgattcaaatattgatgaaagaagtcagtggtattagtgagtgggaggcaatctgtggctaacaaatccttttacaagctagctggtttctaattctttgcttttcataaaattaaaggagggcctaatcaagttgccaggtgatagatgagtaaaaaaattatattccatgatagatgtctacgtgactgggaacgtataatttggaaagagtacagtgaattgaatagatctctaaaaagaaactgcttctgttcccatctatttatgcgaacaagattttttagtatttaattctaaaaataaaaagggagggaagaaatagagtcgatactgtcccttgtttatttcagcaacaaataattttcaccgacaagtccatgaactaactggaaaaaaagcagtatctatctcatattagattcatttaccatcagattttactattaatgttaataattatctatcaaaaatataacgtttatgtttttgatgaattgtacactaataataatataacaaaaataaaatttaacactgagagttctatgatcatctcttttacattttcattttagtttgtatacataccttttatttcaggcaagtataattgcatgatcaattagttttttaaataaaatatactattatatataacatatattttagtataatatatagcctaaatataaataatttattattagcctgaaatacagtataggaagtacaatggaaataaaaactcaaggagaaaatggagttataaaaaatatctagttttttaaaaaccgtttacatatttttaaaatgaacaatttaaactcccaaattgctcagatatttggaaaccattgcaaaattaaaattgtagaagttaaaattgaaaatgatgtcaattatatgtcctttacaatttttaaaacttaagcacttttaggtttctactttaaatatcagaggaggtgtttagttttgcatatacaaacaaatatttgaagactgctatttatgttagccgccatggtttctaaacaaggctgcccatcaaagcacctagaggtattttcacattttaccaataccacagctcaggccacgccccaaacctgccaaatcagtctctcaccagatggcttaggaatttatggttttatagatgtctccgggaaagtcagtgccatctgctgctttatggcaccagagggacacagcatgctcctgtcggaaactgttgcagagggactcttctctagctctcagagctgagggtggtgtcctcatgctgcaggtcaggcagagagaagccactcagtcaagagacagtttccctctacttctttatagtaaatatagcaaatcccacaggaacatgtgggtggttgtgcttccttttttttttttttttttttgttgagatggagtttcgctcttgttgcccaggctggagtgcaatggtgcgatcttggctaaccataacctccacctcccaggttcaagcaattctcctgtctcagcctcctgagtagctgggattacaggcattcaccaccatgcgcagctaattttttgtatttttagtagagatggggtttctccatgtcggtcaggctggtcttgaactcctggcctcaggtgatctgcccgcctcagcctcccaaagtgctgggattacaggcatgagccacagcacctggcctgttgtactttcactaaggattttgaatccagatttggaaagtttgtaatggaatatctttaaaacattgcattattatctaacaaactaagaaaatcagattgtaggtttgcaagagaaaatgtcatatggggattaagacatggtttgcttaaataatgttaagtgctggggaaatttaggaaacaattgaattagctgaataaaggaaagaatccaaaaaaagcaccagtgctattaatatttagattttcattctattaaaagaataagaatgaattagaaagagggagagtgaattagaatcttttaggacagcataaaatggataaaatggacgaaatgaaggatgaccctctttttggtgctctctgggtgtctgcctctgcttgcacacagtgaatgttatgtgattggacggacgctagaagaagaaaggtagcgttggctcaacagaggacttccggctccttcacctatagccatttctggtatgaatgatgatgcaagctcagtaactagtaacacagcccataatggagacaagtggggagagaaaaacaattcatattcccttacaataatctgctagttatggatgtcaggagggagaattgaggacctgatggtttacactgcagtttgaggggctatgataatgccactgatgctttggggtaataccataaaagctgtaacaactcttgatgattcagctcaacaatcgtctcagccatttccatatatctataatctgattctctcctgctttgtgattctttgaatgggttgtctccacacacctctatattaggtgatacattgctggtatattaataccatttagtaggatgcgtccttaaccacatcagctgttaatgagctgcttgttaaggaactgcttgcgaaaagtggatttttgctacttcatggacaaaaagtattcactttgtgatatctttaatgtgattacatgaatggataaaataagctccatatgagctttctattttaaactttaaaatgaaatctgtctaacaccaaagcgctgggttcagctaaattttttttttttttttgagacagagtctcgctctgtcacccaggctggagtgcagtggcacaatctcggctcactgcaacctccgcctcctgggttcacgccattctcctgcctcagcctcccaagtagctgggactacaggcacccgccaccacgcctggctagttttttgtatttttagtagagacagggtttcattgtgttagccaggatggtcttgatctcctgacctcgtgatccacctgcctcagcctccgaaagtgctgggattacaggcgtgagccaccacacccaaccgggttcagcttatttttaaaaacaaagtttcatgactaaaattcctgattaaaattacagtaaaaaattttcactgaagttgtgcctaattgtatgttgggcctgagaattgtggtaccataaataaataaataaatgcccagactgaaggcctctacactggccaagtaaaatgttttaatgaaaatcaaaggtcttgcttacttggcaatgtcaggccctgatgctctggatctgttcttcatgaagcgcaggaacatctctatcacggctgccattgattccaatttggcagccaacaaattcagggcagaattcctctgcctgtgcagatcaaccaggttgggtctccgtggcctgagaccaaataatataatatctgcgctaccctgatggggattttatcaaagtaatgactggttgtgacaatgacatctactcaacctgggtaacttgtagtgtgacgccaaatctaaaacataccttcctgaatgtcaatagccttttttatggaatatggtatggatgatcaaaaaccagtataaacagtaaaagagcaactttaaactgataataaggcattaattattgatggtctaagtcaagaaaagttataaatataatgttataaataggtgcatatttttatatgttataataaaatgtatatataaatatatgttaatatatttatttgtataactgtaactcatatgggtgctttcatataagttgggaaatggattcttacttttggatacacttgtcatcagttagaaaattatagtaaaatactgattttgctagaaaaattatgttcatatcttagaaaatgttagaagaaatactagtatctgccagaaatttgttataataaataacaatcattacaatgtgaatggcattcttatagctgtataatatacaaccctgtaatagtgggtgatagccagaatccttttatgacattaggacaagcataacaaacacacactgaccccccactttgttatagtgagagatgctattatcttgatgtctacagaaaatataatttagccttaactttagcaaactgacaatctaagtttgaaccagctataaaccccccatcttcctgcatttggaaaggatatgcaaaacaattttttaaaagattcagctcacgtataaggaagtgattaaaaacttatctcaatgtggacaacaaggttaaggcaataaatgcacttgtagtacttacagtttgtatttaggaagttcttacatattaacgcagcattgtaaagtggctcattacagagctagaggtgatgtacagtgatagaaggtcaaaggcacttcccaaaacaacagtggactgggtcagactttgtttacaaaaaagaaaaaaaaatggtaaaactagagaggggaatatcagaattcagctatccctagattgctaaactgcataatttcctttctgtgatatcagattacagttagggacaggagataatgaatcaagtgcttagcattgtgtgtagttcatagataattgttagtttttgtcatcatttccttttatttaaagcacccattaataacttacatcatttaggtactgtgcgctttctaaaataattctgcatatggttattttagttcatctttaccacagacctatctgtaagttatctttaggtccccattgtgcagatgagggggaacagaggctcagggatattaaccacctgcgcagagtttcagagttcataagtaacaggatctgagcactgagtctttggactgttaatttgactctctctaccacatgccaactcttctgatcacagctatggatcactaacattagagaaaataaacaaacaactcctctagcttgatcagtggtccctttagtgttgtactgtaagatagccacataatagtagcagctaacatttatccaaggcttattacgtgacagatactgtgttatgcactttatttgcattgttttttaattttctcagtatcctgttgggtaggtactattattttctccatttttcagatgaagaaaccaaagcttaaaaaggttaaatttcttgcctgaggtcaggtagctggcaaggtgtagaaccttgtagcagttataacctctgattccaaagccctcaactccaaactgcatcactatgtcatccacatcagacagtaccatgtgggtaaatctgtatccttttttcttttttgagacggagtctggttctgtcacctaggctggagtgtagtggcacaatctcggctcacagctgcaacctctgcctcctgggttcaagtgaatcccctgcctcagcctcctaagtaaatgggattacaggcgcccaccacaacgcccagctaatttttgtatttttagtagagacggggtttcaccatgttggccaggctgtccttgaactcctgacttcacgtgatccacctgcctcggcctcccaaagtgctgggattacaggcgtgagccactgcgcccggccagtctatatccttttacagttccaataaaacatggtgagggtaaaggtagccagacatgtgattacaaatacagttacatattcagaacttttggtggataatttaggcaatcctacaatttatacttcatctatttgctaagaaaattaagtataaacataatattagtaaaatgtttatggaaatagaagtgaccatagcttttccaagcacttaagacatatgagttaaaaaatcactgtatccaataagtcaggttattctctaattcagatttgcaataatatgttgacacagtagtatgatgtagtgtgatttttactgttacaaaaagaaagccttgctatgaaagtcttacgggagagaggtatctgtggctgcttgactatacatgagataattaccttctggacttctgtagcatatgccagcagaaacagtaatgttttaatattttaataatggctaaacaggttacacatttggtaataaactaagaactttatgtttgtagacagttgctattagctgtattagtattgaatcatagttaacaatgggctaactgaatcatactaaaatatcctttctatttatattaactaataatgtaggtactacttatttgagaagcatttcctgccagtggaaacatcatattaatttcttggggattttgttattgttgtggttatctgttgtttttttaaggatatgtattggctccagcacagataattaaacaaatgtgaatttaaaaataaatcaagtttataaaattgactttatgtctgctagttgaaagccttgaagaaatcaagattaatcagtactctgtcttttcaatatatatctgcagagcctagaataaggcaggcaaataaagaggtactgaaaaatattgtggctgcagttgaattgagaagacaatgcatctgaaaaattgtcatgtcactgggacatttctatgccaacaataggtatggtgacagcccatgctgtgataatgcaagcttagtttaacctgcacagtaaggagactactctgttatatttatatatccctgtcctctctagactggagagtaatttaaaatttgtcatttttctcgtagcatttctgggaaaattgagacccagagaatgtctggaattcatcagggaggacacaggtgctatgtggtgggcagccccctcctgtctccactttgacctcttaccctgtctctagaatgcttgctatttctatggctaaaatttgtgacttaagtggggagctttgtaaccataagctataagaactgaagttttagacctgtttctggaattttccagtgttctgtgtgaagtgagggatggctgcatggcccaattgaaagccaatgttctgatggccctggataagtactgaaatcgcatgcacattcctgctgaattggtacagcctcttgttgcctacaaagttgagcatttataggaaaggatggtttccaatcaatatcttgtgtccatatagggcatctatttgtgttgtttgagaaatgtgttattaaatcaggtgtcctctattaaaaaggagtgtctttcttcggttgctaaaactgagatatggtttatttatttacaaaatggaggccatgatattagctttattacccgcattaaagaagagtaactgctcaagaattttcccactcaggcaaatggtgtgaagaggaaagaactggtgccaacaactgctcagattctaataaggacaaaatcctaacaaggaagttggctccaaatttgaagggcacttgatagcttggacctgccttttaaaagttggtgaatacatcatcagtcgggggtatgagggacctgagggttcgatatgtcattacagccagttggctcgtggccttaccagaagtgaaatgatttatggaaccagagtgggataactaccgagggaggctgggagttgcctcgggaggtttataaaaagggcgaagcaacgtagtttctaggctggagtcatgccctgaaaggatgccctcaccaaggggcccctccacaaacgtggaattcatcttcagtgccttccagacaattccaggccaacaattaacatttcagggtttgccaaggagcgttagtttcctgctcagcatttggcttactataaggctctttaggtgtgttttccaaagttttgtcatcgtggctcacctggaaatgatgaccagcacttacagctgaaggtctggggtttgctgggctccatgccctgtgctgggatctcagcatacttgtgacttgtaactttcgagatattggagtactttcatttggctaagatttaagtctgcttctaagcaaaggccaggcagactaaaatgaatcatcgttgatgaagatttgaaaaacaaaatgagaccatttctaaagtcaaaggctcaaaggcaaacttatttttcaaggtccaaaagagcaacctttagacatggagatttccaagctcattgcaaagtctgcagagcagccctgctggctcgtacaccctgacctttagggagagcctgtggatccagccacagctggagggttggttacacttcactgaacgaagttgcaggcatttgaaagaccgaggagactgcttcactgagtgcttgttccctgtgtagcaaggtacaaacaatttcaggcttggtaaaatgtggggtaaggagcttggcacagaatagctaccagggtgtcggataaaatgacagacatgtgtgcccagcacaactggcaccagctgtgattcattgtctgtaataataaagcactggcccgccaagcacggcgcctgtaacttggctttgcactattgcgcctgccatgctgtcctcgcttctctgcccttccctgccaacccagtccccaactgcatcttcacacacctcacagctgcatctgctggggaagggttcgcaaaggtgggcacgaagacgacatggcacagatgaataagagttggctttattgcacctagttactttcaggggagccatgagctatccctgtgtttcccaagttccctgaagataaagattactgcaggggtggttagatttcataagagagacctcatctcagacctattgaatgaggatgatgtaagataggcttggtagcctgtgtgtacgataagcttccaggtccttcttactggggaggtttgaagaagattgtggcaggggcagcagtgctcagcctgggctggagttagaaccacctggggaacctgactcagcaccacgtccaggccatactcagacaagttaactcacaggctttggtaatggggtcccagcactgctatcttttaaactccccaggtcactggaggaatgtgtagccaacactgaaaaccactaagctgcagaaaatgactcataaaggggtttctggctctcgggaaaatctgggtcttaacaagcactcacgtaacttttgtgtccagagcactttgcagggcactatggagatatgtggccttattttaagtaacagaaagaacctcacctttctggagcctttgattcactggaagagatgtgtacataaagtgaatccatagtagttttgggtgtttgttttgctttttgttttttgtttgttcgtttttagacagggtcttgctctgtcccctaggctggagtacagtggtgtaatcatagctcactgcagcctcaacctcccggactcaagcagccctcccaccgcagtctctggagtagctgggactataccaagtgccaacataccctgctaatttattgttttgtagagacagttctcgcaacgttgcccaggctggtcttgaactcctggcttcaagtaatcctcccacctcagcctcctaaaataaatccaaagttattgaccaacaaatcacaacgacaagcagcattaaaaatggaattaaatggaatggaccaaactttatgtcgccatttagccaccgaaatacttacattatatataattttttcttttaaataattgtgataaaaatcttcacacatctatatgtaattctctgatattttggataaattctgaagcacaaaagttccttgacaaagagtataaatatttgtgagtgttgataaatattgccagatgtcacccacaaaggctgtgccagtttatacccacgtagcccatgtctgcaactcttttctacacaagaggtcgtcaataaaaaatgaaacacatgaacaaaaaacctggataatgtaaatctgaggatacagagagtagagaaagattggaatttggagtgggttaaggaagggaaaattcttggaaagaatattttgagctggaatttcaaacatataacttctcatccctgagaataatttataaaaaatgtaaaagtacattttctatactttttttagtttctggtaataatagaaatgacaaaatggaagagaataagaatgactcggtgatacattttcacattttgatagtagatacaaaaagctctgagacactcccaacaggggcactgttagatgacatggaaggcagctgggtgggcccttggtgcctggctaggcactgactcagatcatgtgtcaggcgtaattcgtgttcctaattgctgccgacgaactgtgaagacagttccccaggaggctttccagaagtgctgtgattaatgctagcacagctggaaaagtgaaaaacacccatttgattttgtgctttcttatatttactaaaacataaacagcaaaataaaattttccttattttgagtaaaggagatggttattaggccagccttttctaagaagcaaaaatctttcttgcctagctgatcatgttttacaattttcatgtcatacaacatgcacattgtactttctgacattttattttgttttgtacttaaactatttgacatgtatttgttgtcataaaattagactcaaatttgttgtcataaaattagactcaaatttagaggcagagactgttccttctattctgtttttataacgagaggctgcataaagacttgggaaataaatgaacaaatgtacttaggatgacaacaaaccggaaacagcaaattcagaaaaaaaagaagtgcagcattattttcttggggatactggccaaagaatgtttcctataacatctttttaaaaaactaattattagtgaaaaatgtgacctagaaaaatcaacattgtttaatttccattcttttgcagtatcatttactcaataattttaagaaggtagtaaagccacagtaaagttttatatttgataaaacattagatgtgggaattcaagtaagtcatttttctctggagcatctcatgatgagaaaatgtacgtcccatatggtcttactgtgtccggaattggttccctccggtgggttcttggtctcactgacttcaagaatgaagtcgcggaccctcgtggtgagtgttagggttcttaaagatggtgtgtccagagtttgttccttcagatgttcagatgtgtccggagtttcttccttctggtgggttcgtggtctcgctgacttcaggagtcaagccacagacctttgcagtgagtgttacagctcttaaaggtggcgcgtctggagttgtttgttcctaccggtgggttcgtagtctctctggcttcaggagtgaagctgcagaccttcgcagttgagtgtcacagctcataaaggcagtgcggacccaaagcgtgagcagcagcaagatttattgcgaagagcaaaagaacaaaccttccacaccatggaagggggccggagcgggttgccactggggctgggtggccagcttttattcccttatttggccccacccacgtcctgctgattggtccattttacagagtgctgattggtccgtttttacagagggctgattggtgcatttacaaactgttagctggacacagagtgctgattggtgtgcttacaatcctctagctaaacagaaaagttctcccagtccccacccacccaggagcccacctggcttcacctctcattagggcatatattaataaaaataacttatgaagcatgtaaaatttccttcatccacagcacacacaaaatgaaaaacattctttttccttttgctcatctacatttattgaatatctgctctgagccagagatgaaaaaaaataaacctacaattatgataaagaaaaccccaacttctcaaaaagagaaactatcagataaatcacaaatattgcccctgaaaaagttagactgttcaccttagcaggcatttgatttttgacatacttacgattttgcagaaacattaatttttggttaaaaatatgcagttttgaagaccattttttttcgtggtcaggagtaaagatttagatttgaactggtgaaagaaatcccatatagttattgcagaaagaatgtaaattttactaaagatgccaaggcttagaattacagagcattcttgcaggaatgggaattggaaaccctctcattcagctgaataactgacacatattagaagaccaccctgccccgcggcatagtctgcttaatcagggagaatccagctgagtcctgtgatccacttggcatttctactagcaatagaggcttggaagagaaatttcactctccccaaattcccaaactgaaagcacgctgagcagggaaggagaggtcctgccccagatggcatggtgctctgctgtcccgttctcgtctcccctgcctcactggtaaggactgtacttctttgcagcttccaagctagctagctggaatttatcatctagcatgcatgggtcctgggggcagggtggggcagtggctgaccggtgacctgcccaacacccctgttcctcccacagtgggacatttgtgtccagagcctatctacaaatagagattcaggatgctgtgtcaatctcacattctctgtgaccatgcctttcctcaagcatctccccaaccctaattattccattcattccctgcacaggagattgtatcatactgtacatgtgtgtactgggctttcttttatgtgtgacacacttgtcagccccattacattttcagttctgtcatagcagggatctttattaccttgtcattatcatccctagccccaatccttcctcaattactgtccattctcttgcaaaatgtgaatgtcacaccttatacacacacacacatgcgcgcgcacacacacacacgcgcacacacacacacgtcttttgctcctattgaattttagtaaatgggacaccaatccttgttcatcttctcataaagaagaggaggaagaggaagaaaaagaggaatacagggggagggggagagggagtggggagggagaatcaatttgggccatgtgattaaatctaagaaaccagagaggttgattttagggtgtctagacctcacctccagcacgttccccaggccctctcttcttcctcaactccccttgttacaactgcttcaggaaaccatgtcataaatgtttggagacgacatttgacccacaaacttccagctaccttgttttagcagaatgatagtagcctgtgggctatagtgatcctctggtctaatgtgggatgttttttattattatgtttattgtgtatatttaaggtgcacatcatgatgttttgacagacatattcataaatgactactacagtcaaataattaacatattcttcatctcacagagttacctttttgtatgtggtcagagcacctaaaatctattcttgttagcaaatttccagtatgtaatattattaactagagtcctagtgctgtattttagttaaagaaactcaagtccataaaacccaattcgcttgttctgtgacatgcctagtagcagagatatgatgaaaattcctcacatttagtattttttcccaatacacctcttagccataagagaaaatacctttaagtgaagggggtttctaattgtgttattttagatccagtgattaagtgggaataaagtttctcattgttatagtttgttttcttttttcttttcttttttttttgagactgagtcttgctgtatcacccaggcagtggtgcgatctccgttcactgcaacctctgcctcccgggttcaagtgattctcctgcctcagcctcccaagtagctaggagtacaggcgcccaccaccacacccagctaatttttgtatttttagtagagacgggatttcaccatattggccaggctgatcttgaactcctgactctgtgatctgcctgcctcagcctcccaaagtgctaggattacaggcatgagccaccacacccagcctagtttgttttcttttgtgagagaaaccttaaaaccctaccgtgtggacccccgcagtttgtcccctgcaagcctggcctgtgctgatgcatgtgaatggacaagctgctcttggatcagtcccaagctaataagtaaaaagatccttccagtggatggacacatatcaaaggttgtatgtagaggatgaagagaagttttgccttatttgataaactgtaattcaacactgtcattggttttcttggtctttttttctctcatgtttcaaattaatatcttcccaaaagatctcctgtggctcataggcaaccaggtttgcgctgaataaccggctgagtagctgcagaaagccatcccaagccagtaaattccagctctgacctcactcaattccacacaatgaacgtggccccaaagagggagagcagtgtgtttatgtgtgtgtgtgtgtgtgtgtgtgttattcttctctcacctgctcagcccccacttgctagaggcatgcactgagctcagtgctttacacatgggctcccacacttgctgtcctcgttcccattttgcagacgaggagactcagcacagagataaatcaattaatctgctcgtcacttagagtctcaccctagctagtgatgggtctggaatttaaacacagacagtctgactccagagcccgtgcgcttaattccacgctgtgcatcctccacctgattttattaagacacgttttttaaggtagagagtattgtggggagggcagggttaaggatagcaatcataactggtgttggcagagttcttccacacactgctgtggtgtgctccgcggacgtgccgtggggaagccaactttctcaggaggtcccattgtggtccatgtcccacacatggtttgtgaggttgatgtggctgtgaggccaggtgcgtgttgctgcaaggagctgctcatctgctctgccggccaggaggcccatcctcttcttttcacatcacaacacacatcccatccctttccagagagagaccagaagaggcttgagtgcctgctggccttctaagtaagatttaaatggacagaccagtatgagaacccatgcctttttctgattttgaacgtatattttttcctctagacatgagtccaagtatttggggcccaagaagacagaatctttgggagtacttgttttttgcagacctagttatggaaagatcctaaaattttcccaaagattgaatgatgaactcatattggtgtccaggccaggaaacacagacttcatcttttctagagttttatgccttcatcctctccatttttttttttttttttgagacagtttcgcttttgttgcccaggctgaagtgcagtggcgtgatcttggctcactgtaacctccgcctactgggttcaaatgattctcctgcctcagcctcctgagaagctgggattacaggtgctcgccaccacgcctggctaattttgtatttttagtagagatggggtttcatcatgttgcccaggctggtctcgaactcctgacctcaaatgatccacctgcctcagcctcccaaagttctggaattacaggcatgaaccaccacatccagcccatcctctccaatctttaattctggtcttgtaatttgcatttgtctaggtagttaccacacctatgtgtgatcaagattaactgctgtggtaaatgtaaatattttttatgacagttttcagatctttttcatagttttcatctttctcccatgaataaaatggcaggtttgtaaatgattataaaaagaagaaaaactattttgtttttccgtattgttgagggatttgaagaagccccattttctggggtgacacccaagttttgttgtctcatggccacagagatcaaggacgtggacacacacagggtgaggtttagagcagaaatgtaataagtgaaagaaagacaatagctctttgctacagagaggggtgggtcccagaaaaatgggttgccaattcacagtttggatacagaggcttttataagaaattgacagggggcagggtgtctcatttgcataaggtgtgcatttctggtagttccaccctttcctcctagtgcacacataggttcttagcttgagttactccatgctactttgttcccctgactgcacatatgtcaggggatgaaattttccattgtgggcttgtctgggcaagtatcctgtgtagtctttcttagctatgcagctgtggggatatcttaatcaaggccctggtcatgttcccttatctgtgcctgcaacttgatttttcaggctgttcttttgtttgaaagaatttaaccaaggacccaccttaactgcctgcctgattggtttcttcctttctcctctctcacattcaaattgtgttcttaaactattagtcagttagagacaatttagatagaaggtcctaaagcattcaaatatcatttatagtacatctacatttatttactcagaagctttaagtattgccattttgttctttatatttcaaagaagaggaaaatttcattgtcccccctttaatcagattcagacttggagattaagtcaagcactttgtcaaaatgaccattgcacacatcaagatttgaaatacaacttctttgacaggtgtctgccaggaatgtcctacgttaggaagggagtactcaatatttccaactcaaattaggtctttactatggtatgtcactatatgaatttcactttttaaaattactgtttctctgtcttttaataattaccataagacagttttatttaattactccatgggaaagaatgtgggcatgggttttcaatttttaagaatttgtgcttcctttttcactcgggtaaaataaagccatttagagttacgtttaaagtatatcctgcccaaatactaacctactggtttcagttatagacatgaaaaaatagttttccacaagtattcttcattgtctttgtcattgaaaaagagttaaactctgtaaaatatttgaagagatttattctcaagcaaatatgaggaccatggcccatgacagagccccagaggatcctgagaacatgtgcccaaggtggtcagggtacatcttggttttatacattttagggagacataagacatcagtcaatacatgtaagatgtgcatgggtttggtctaacttggaatgaggtggtggaggccccaagggggtggaggggcagggagcttccaggtcataggtggattcaaagactttctgattggcaattggtgtttatctaaagacctggaatcaatagaagggagtgtctgggtgaaaaaaaaaaaaggcagaggggtggggttgcagagaccaaggttcttattatgcagatgaagcctccaggtggcaggcttcagaggcaatagattgtaaatgtttcttattagactttaaaaggtaccatacacttagttaattctctcctggatcaggaaaaagacatggaaaatgaagaagattctctgtggaatgtagattttccccacaggagatagctttgcagggccatttcaaagtaggtcaaagaaatacattttggagtaaaatactttgattttattcaagatctgctctctgtcatgttggtatcttattgctggaaagagtctgtttggtcagtcttaaggtgtctgtgttaatgttaatgctggtcagctgtgcctaaattccaagcggagggaggtataatgaggcatatcctaccatctattcccatcatggcctaaactagtacttcaggtttactttaaaatgccattggctgaggagagggccaaaggcatttaaaggcagctggttgggaagcttagaattttatttttggtttacacctttttgttttgtccttaaaaattcagaggctactactatgagtgctattcatggaattcagacagaagcaaatctcgttacagcaaaactctgcaaaggatgatgcattcctgggttttctccattctgagcaccagccttgaccaaatcgttgggtggtgttcatccagtttttgtaacagaatagctatacattaaagagtataggaattattttaaaatattagaattatttattaaagaatattggaataccaacataaaatttattgaaaaggattgattgcacactgtgagataaaggtattattatctttaaagcaaaattaggaatgcttctgttctcaagatattggaatatcaggacactcgtaagtctgggtctgtttagtaaatgctaccagtctgttcctttaaccataaacgtctagaagctaggaatgcctaactttctgagaatgcagctaagcaagtcccagcctcattttcctaaccctcagttaagatggagttgctttggctcgaacacctctgacaaaatcagtctccctgaaaattcagagactggggttttcgaagcataatttggtgggtaggggtcagagggtgaggagtgttgattgttgggtcggagatgaaattatagggagtcgaagctgtcctcttgcactaagtcagttcctaggttggagctgcaagaccagatgagccagtttatcaatctgggtggcatcagctgatccatggagtgcagggtctgaaaagtatctcgagtaccaatcttaggttttacaatagtgatgtaacctctaggagcaattgggaaagtttagaatcttgcagtctctagctgcataactcctaaatcataatttctaatgttgtgactaatttgttagttagactatctttaaaggtagtctggctcccaggcaagaagggggtttgttttgggaaagggctgctgtcatctttgtttcaaaattaaacgataaactaagttcctcccaaggtagttcagcctatgcccaggaatgaacaaggacattttggaggttagaagtaagatggactcaggtcagatctctttcactatcgtaattttctgttataatttttgcaaaggcagtttcaatagagtcaataacagtttactattaatacttctttttttctttctttctttttttttttttttttttttttttttgagacgagtctcctgttgcccaggctggagtgcagtggtgcaatctccgcccactgcaagctccgcctcccgggctcaagcaattctcctgtttgagtctccagagtagttgggattacaggcgtgcgccaccacacctggctaatttttgtattttcagtagagacagggtttcaccatgttggcctggctggtctcgaattcctgccctctagtgatttgcctgtctcagcctcctaaagttgccaggattgcaggcatgagccaccgcacccagctgtttagtacttattatttactttgtcagttcagacaaagtaaaataaaaatttaagtaactaaagcacaattcagtaaatttaaaaagccctggtacctgtatgcatattgtgaataaaaatgctagatcgtaaacatgctgagggcaataccatttctaagctcatccaagtcaatcatgctgccttatttaactttgtaattttcacagtgcttaacttagtgtctagtactattttattttctgttttttacataattcttagctcaataccctactatagtgagtattgtacatatggtgataaagaaggaataaatgaatgagaagattaatttgtcctgaatgtccagctatcactgatcacatttatacaggtacatggacatcaccaaaatatattgagtagtgatggtttttcattttaaaacaccacagattcatttaggaaagcccctcaatctcattgaaattgaagttttgcatccctgtaatgaccgtggtaatctagagtttaattctctggcccaggggtggagtgggcagggttgcactgaccccaaagtcccctgtttacctgtgggtacctaaggggaggggtgaaaggaggaggaactaccctccactttgctgtgtgaaggagctttttgcttgtctctgggaccagtaataaaacaaaacaaagcatcatttttttatgtctttcttgatgtatgagagaattttcatttatgaaatacacatataaaagaagaaaatatgccagaaattattctttctccagggtatgtgtctttagcaacatagaatagtaaattgtgattctaccatcagttcatatttcctatattgtgaatttttaacatctttatcatttgccttttaaacttacttgggtttagagtatggttaaaaaaaaaaaaaaatcctaaagcccagaccaagtttgttattttttcccttactcttcatttagctgctgagtattatcacatgtgatagatcataactcgtcattcatcccctgtgacattagggggaaccctgtagggcttactactgaggtcataacttgcccaaacatgtataggttgtatgcctaaactagtccagcaaagctccttgggtgcatatagcataataaagctttttctggaataagtagttaagaattatttcaatcttaaaatatttttcccaaggaatagaaaaaagacagcacaccttacagacaattcattatatggtaagaaactacacaacatcagtatgagaaagaaaaatttcagaccaattgcactcatggatacagaagttaaattgccagacaaaatactagcaaactgaatccaactaggatcaaattggattcatctttagaacacaagaataatttaatgttagaaaacctataaatgtatttcaccataacaatagacaaaaatgttaaaaaatctgatttttagatttttaggttaaaagcctttgtttaataatcgtcttatttgatgcaggaaaaaaataataaaattcaacaactaattataattaaactttctcagaaactaggacaagaacatatttctttaaactgagaaaggacctctacctataacaaacattattcttagtagtaagacattagaaatatttcctttaaaatcaacagcaagacaaaaatgcccactagtgctgattttgttttgaggtattgaatgatgcaagaacacaaaataaataatgatggcgattgaaaagaaactgttttcttgtagatggcatgattgtctacatagaaaactgccctctccccacaaaaacatagcacttaccactttattagaatctaaacacataagttactaaagaaaaatacatatgatgaaaataaaccagacaattgtggaaaaatcttataagtcattgaacatttttatagaggaattaattaagtggatatatactatattcatggataggaaaattaaaaatcatgcattatcaattctctacaaattgatcaaggaaaatgtaatccagatccatagagtactttcacaggaatgtgacaaattgattctaaaatgtatatggaagggaaatgggggcaaaaaagcaagtattgccaaaactctcctggagaagcaaatgaggtggcacatgccctgcttgctatcaagccctagtgaccaaggaattaaaattgagcaatatagagtaatatttttatgaacttagggtagagaaggatttttaaaatataataaaaattgttagccacagaccgggcatggtggctcacgcctgtaatcccagcactttgagaggccaaggcgggctgatcacctgaggtcaggagttcgagaccagcctgtccaacatggagaaaccccatctctactaaaaatacaaaattagctgggtgtggtggcacatgcctgtaatcccagctactcgggaggctgaggcagaagaatagcttgaacctgggaggcagaggttgcagtgagctgagattgtaccattgcactccagcctgggtgataagagcgaaattgcatctcaaaaaaaaaaaaaaaattattagccacaaaacgttgatgagttcaacagcattaaaattaagaagttctatttataaaaaaaaaaactataaagataatggaaaagcaagtcatgagctggagtaagatatttgccatatatataaataagaaagcattagaattgcaaataaataaatatttttgacaaaaaatactgaaaagaaatatgcaaaaaagacatggatagtccttgccaggcgcagtggcttacgcctataatctcagcactttgggagggtgaggtgggtggatcacgaggtcaggagatcgagaccatcctggccaacatggtgaaacactgtctctattgaaaatacaaaaacttagccgggcgtggtggcgggcacctgtagtcccagctactcgggaggctgagccaggagaatggcatgaacccgggaggcagagcttgcagtgagccaagatcgcgccactgcactccagcctgggcaacagagcgagactctgtctcaaaaaaaaaaaaaaaaaagacatggatagtcctttcactgaaaaaataaataaatggctggtaaacatatgaaaatatgctaaactacattagtaatctgagaaattcaaatttaaactacaaagtgacaccactttatatcctccggattggcaaaaactaagaagtctgataatactgagcactggaggagattggaagccataagatctcctacatactgccagtaagagtgtgaattggtacaccatgttagaaaataatctggctttatctcatgaagttgaacatgtgacctagccaatgcattcctgagggaatatatagcccagagatactcttgcactgatgtggtatattcaaagcatggactattactcaaaagaaaaaatgagtcattgacaactaaaaagagttgtggatacaggctcgttgctgaagttcaggtaagtataatatccttttttacagagttcaaaatacataggaagacagattagatagatagatagatagatagatagatagatagatagatagatagatacacacagataaatgcattctcagaagactgctttgcaatggcaataaaatcataaatatgaatcaggatggtagttacttctaatgggggaaaaagtaagaagagcaaaggtaaacatataagaagactttgttctatccagtacttcaatggcaaaaacaaacaacaatgatagtagaaggtcttttataattcttctctgtgcctctctcctttcctttttgactggatgtttcaaagctgtttgtctcaaaaaaataataggagatggagaaagggaactgtgggccagcattcaacaaatgttatctcatttactcttcacaagaaccagtaagctacatattactttacttactgcaaagatacaaaaactaaagccaaaaacgaataattatctgcacaatgtcttacagctataaaagctgaggtttgaattcacatcagtattataaaagtccacttttgtaacaagtgatataattatgtcatgtgatatgtggttattatcctttaaaaccaaaggacattttttccctagaaaaaggaagcatttcagtttgcacttagcaagaaactcaattctttatgaaacatagtatgaggctaaatgctctaaaatttaagtgagggttatccacatatcagaagagactgagatactgtctaatatacatttgtcctgcacaggttttgagtgataaaaataaacaaaaattaccaccagaattaaatttaaaggttaaaaactggtctccaaatcattgcaaacaatcccttttaagttataagaaataggaagatttttacatctattgtgaaaatggattttaaaatagttccaatgtgtatgggcccataggccttgtttttccttatgatataaactttcatacagaacatttcagtgttcagtcacaaggcacctttatagcaagctatcatattctttgaagtaagtataaatttgaacaaacagtagataatgattctacagttttggagatgttgttacatttctccaaaaaagagcattcctctcatctgctcagaatcattactcggcttatgaagagctgttagtgttctgtaggaattgttctcacatctgagacgcacacaagagcaggcatttgaaacacctccaaggttcagatagatatttgtctcgaaggcccacccagcaaaattttagatcctcaaatcaaattctagaagcagtctttttttttttttgtaagatagaagggcctttattctttattctggcataaacgtctgaaaaaaaggatagtcatgaatcccttgttagagttgggtttctgtgagccattctccaagcaatcaggtgctcagttctcatcatctctcagtaattacaggaaatggcagtaatgcctaaggtacctgtcaaaagcattgttgtttgccgggcccttaagtagtaaatgaaagctgattcattcatggacctgcgatggatctttgttcctttcccattcagaatctgctcttcccacttcactctggatgtttgcagttcatgctgagagtagcaattcattcttggcaaaggctcccctatggcttggattacacagctcttgtgtaactgagctctgcacaggagcatggcaggttggggtggggcgggggaagtgagtcgtactggttttcagtctgtgccagttctcttaaaattgatctgcttaccaaggggctccaaaaactaaaatacctcagttattttgtctggactctgagaaggatgtctctgcataatgaatgatatgctctcttcagtcaatttctgatgaatcagaaatggacctcaagtcttgcaaaccaacaacctctccccatcccttcttagagcaaaccagtgttgactcccagtgaaataaattttttttaaaaatccaaatctgaggctcatataaatgtaagctattgtatagatgtttgcttttttataatctttactcttccctttgctttggtgacaagggctcagaaataaagttaaactttttacatatcttctgttttatgggagctttaaggaaagagaaaaactggaaatttctcctatgcatttgtttcacatatatatactccaaaaattttctaggattccatgtttaggcaatggattttttatgggcactaatctggaattttgtaagaataagatttcgtgatctattgcactgtgataaccatagttaaaaataatatattgtatgtttcaaaattgctaacgaatagatttttaatattctcactgcaaaaacaatgagaaattggtgaggtgatagatatgtcaattaggtttactgaatctttctataatgtatgcatagataaaaatatcactttgcatcccccataaatatacataattattatttatcaattaaaaataaataattttttaaatgtatgatagcatcgaaaactacagatttcattttttggcctgtgtaatcaaatgaatagaataaacaaatgattaagtgtaacgaatgtaaatgctctgaaaatgggcaattatattccacaagggaaaggaagcaagtcagtcttttttggacactaaacatcttatataaatgctgcaacgccaatgaaagtgaacataaatatttaattttcttgaaatataaaacaaatttcaaaatgtttaaaaggatatagcattgtctgttctagcaccaactaggcttcatgactaaagcccacagctcctgagcctgtagtcatcaagcctggctctagaggaagtggggcaggtcccagtgtgactgaaatggactccatagactctcaaagctctcccactggggccttcccactgaactgcacacatttttgctctcaaacccagccagtttggtttgaactccgaccaccttctaggtcttactgtctcctttttccccagaagctgagccctccattctcttcccccagtatctggttctagcattaccacttactgagtaggtgatcttgaaatagttaatctccattttaatctttaatcataatcttttaaatgaggacattaatatataggattgttataaggattaaatctaaagtacttaatacagtgacttgcatatagcaggctccacgttcgtggtagatactatgctaatggttcaatgtggccagacctttccttacctgcaatccatgtccaatgattatctctttcaagagatacttattgttcctcccatctcctcattggcttatatgttttgagaatcattgccagccaagatttgatttgagtggccttggaacactagaatttgcaaggctggccggccaatgtggagcccagccctgctggttggagtagtccttctggaagagtcttctaggttttttcttacttttattgcctgtcaacctatggataaaacaatacaaaaattatataagataagccgacaatgtgttttatgaacctgggacacagatgaattatgtcaacctaatctctaaagaggtgtggtaaaatagaaaaggataaagcaacaataatgacagtctttgtcgctaagaaagtcaatgagactgtctcattttatgctgtaaggtccccacaggcttcatttgctctcctgagcagcccctcccttgagagcagggtgtggcggtttcctggcccacacactgaaggccctggtttgcaccctgatgtttctgatggtcaaagccaaggtgatcatcaccttagggctcagatgtccttgggggaactttgtggtgctcagactacacgttggtgaccctctttgcattggcactatcgttctttggctgagctcaggaagttccctctcccacccccatcgctctcttcagcaacctccccagtgcagtgatggggagggagacacaagctcttccagggtgctctagtgccacagtgcctcactggactcgctcgctgtcttacagccccttctccagagggtctcaccggacaagctttcctctgtcagctgggatttgggtgacaccaatggttggacactggcccactccagccaccaaccccagctgtcagttcatgaggaaagaggagggtgaatccacctgtctcaccagaggtaggactagacacagagtagattctctactctatatttgttgaattggaatgagtgaattcttccttacaactaatctgtcccaggagactgagtccatgggccctgcatatttcctgtcccagagagtgccccctgcccacttagtaaccctgagatgtgggtgcatcctcttctccaccttcccgtccttgcttaagacttttgtcctggtactgttagttgtagcatgtgtagtctctgtcttctcagatgttttcttagatcatgtttttcaaactcatttaaaccatgacccagggaaacaaaaatttaatgaaatactcacctttcctgtgggcgatgttctctaatatttctgcattctgctctgctctacttttctagtctattttattctgtcctattgcacttttaaaacactggccacagctcactgaattgatttttaaactcctgaataggtcactgttcacagttttaaaaaaatactatatgaagaccatattccaataaagccactgacattcagccatgacatgccacagtctccttagtgaggaagcttttgtccacctcacagtcttctcagttactgaatctaaagtagatcattactatgattctttgttaattcccttcataacattaacagcaatccacacgtattttattcatttgtctatgtccttatttctgcctcttcaaaatgaaagatccataaaggtagaactttgtcttattcacgattgtgttcccagcacaaattctctggtacatccatgttgaatgatggaatgagtgaatgaaacccttactacacatgtatatacaaggaagtttggttctctgaggacattttgattctctgtcaattttgtgtaaatgattatagctaatatatttaaaggaggggattttttttttaaagaatataaggtcattcacaccacagaaagggcaggagtcaggcagcttccagagtcaaagtggtagatgtaggggactatgtcattagggcaacatcatgaggttgagttggctccagtcactgttcagattcccagaaaagagcatctgactggctgctctttatctcatggccctctcttgtccaggagaggaaagagcacctgactgaggtcaagactgcaagcatgaggaggcaaagttaggtcctcaaagaaaaaccctgatgctatcagcacaggtaaggctgcacaggcagaaccaatgggtgtcaactacgcatgtctttatgtctgtcattcttgcaacagttaaattatagcccgggtctgatgttcgcataactgacataagatttcttagtcttctaacccttcccttctccagatctatagatgcctcccatggaagacctctctagtactctggttttgtattagaattattctgaatctatttatccaaaaattagttaatatcctgttttgtgttcagtaatatatgggacactgtggaaacttacaagataaaaatgtgacttcgtaccctactccagtttacagtccacatggagttcagacatttgacactttaagaaagtgatataaaataggattgtatcaaaatttgtaaagtaaataattgcatttctttcattctgcatttctagaaagtagctaaaatttttccaatgcatttctagaaagtagttgaaattcctctaaatgtttggagtagttataatgaaaaatatgattgctcaccttcactgtaaacatccttaaacaactgcttgagttgttagttgattgaatatagggataaaagaaataaaaatgtttagagtgaaggctagatttttgtcatgggtacttaagcagaaagatattgttacctttcgccggagggcaacagatttttggggctgaagagagatagttgggttttggacatggtaggattaagctgagtgattcttcaccaaacttctctttattctttctgctagtgagcagaaagaatagacctagtagaaagaatagacttgctcacaagcagaaaagaaaaggaatcagaggagagaaagacagctctaaaataaattactgcatttgcagaaaaatatttaaacctatttgtcttacatttagtgagatggaaagaacattgcataactaaatgtgcataaatatatacatctgctttttctacattttctttttccctcctctctcccttttcatttttgcctccttcctctaagaattatattcttttattctgtcaggtactgattatcctatttctttttatttcacactggttctcattttccctgagatattaaatttctaccttttaaaattagttccaattaatcgagtccagtttagcaaatcttagaattaagaatatggataattgtcaaacaatatagataattgcggttgtgtcttgaaaggaagtttacctttcattgaagcaattttagaatttgcaaacggatatattaagatagaaaattaaatgatgtttggctcttgtgtagtctacagaacagactcaatgattttgtcataagacttagttcactctcaactttgtcacttacttttaattattcttgactctccacaattgactgaagctataaactcctttaaaaatagaacttccaaaagtgtgctgtatggaactttaatttcatgagaatttgatgttcaatatttcgggataaaaaagaatggcctaatgaagtactgggttaaacaaatttggcaaatttcatttctcaagtgtgttgagggttactgagagatgtgttatgtagaacttcctaaactcatttaactttacattcttttttcctacaaagaatcctaaatgtttattatcccatggtaaacattttggaaaatgctagattatattatctaaatgttgctttatggcatttcttgttctatagaaacattggtttcaaataatggcatttactgtgcgtgatttcagaagcactaaaggggttaaaagacgttaagaataagaattaggtgttttctgttactaattaatgaacgatacatatgttgatttgggtatatggcattgtgaattaagtaaaataattttaaagcttattagtacattataaatacttagaataaaacataatataaaacttacattccctgtgctttccttaagctattcaagtaaatacctgtgtctcacttcgtatttatgcaacataacgtcacacagtatgactatgcataatcccgattttacaaacttgagtgactcttttactgcttcatgtggctatttttaattttggtaggatataatgtttcaattcacaatgtacatttttaaaagatgatgactaactctacaagataaacagttacttacagataaatatatgcattgtatggcacaattgtaatatttagaaattacgctttaggtgggatagattatataaagagttaacatggtgttctttgcctattagccattttgcattgcccacagtctaaatgggctatataatagaatcattgctatcattgaccccatcatggtgctcagcgaccaatggtcctattaatgacattccatgcctggaaatatctatggaaccattctcctcctatggagacagatggtgggtttaacagtgacccacaaggccagcctagtcgtctgttttcattttagtcataattcatccagagccagatgcagaactatgcatgaaaccatcacattcttagtgaatgcccacatgaacgtatgcacatcaagtttgtttgaatgcaatgagtggttgttttgaataagatgacattgccctgcatggtgctgacgattgtttcctagagaattttagagacaggcgccaaccagtgagtgaaactagatactccacataaaatgtactattataatgtctcaagtgttttagtttgtttgcttttgttgagtaggaaagtttgttttgttctgtaagaagtgaagagtataggaggcatttggtgaccagatttggccaggatcatgaaggccaaagttttaggacccttgcctctgtctggcccagacaacaccgtccctgaccagggtgcccactttgcatccacagcgactgtggtccacatgaatgcctgggccaaaatgatcaatgagtcagcatttaaaaagaaaaaatccttcaaaatgtgaccaagaacctcaaagtccatactctgatgagctaagtcaatcatatctttaaatacaaagattaacaaaacagaatttatttgaagattcatgaaaggaaacaggaaatgccggaaatgtggtttaatgaacttcaaaataaaagcaagagtataaatcttttctcaggtctataagaattgtgtgcattaattcatggaggaaagaaaatgcactctcagtaggtgattgaacatataaattaggctgaaggagaaactttgctatgcgtgaagttaaaggcatggtaaaagaggtctttcacactgcctgtgacctatgacatgattgctgactcagagaacaaagcatttttacactcaatgtccaggagaatggtggtggggctggaggtagggacaagacgtatccatcctgttaagtgaaaaaatctatcttcccaacccattttttagaaatccctccgagattcctccttcctccttagaactcctgaggtccaacaagccatccagtgtgacctgtcctactttctaaacacctcccaactctacctttcctcctcatccccactgtcactaaactagttcatgccttcattgttcttgcccagactgctgaaatcaccttctaacagatcttaccctcccaccttcctttaatacctcttgtttgaagaatcttaccactgacagcagagtatcttcctcaaacacgagtcttatcccattatcctgttacccaggagcctttaccagctatccatcactgttgagatgaaagtcaggagcctgagcaaaatatgcgaggaccttgatcagcttgcccttcctatctggctgcttcccaaaaggcacccacaacctggctcactcttacttacctgtgtactcccaggcatgctctcattcaagaagtcctctggaatactgcaacaccacccccacccccttgtgtgtggtggcaacccccaccttctgccagtgcaccctgagcacagagtcctcgtggcgtttagcacatgccattgtggctgttggttttctcatctgcgttgttccctaccctatgagcaactctgccatttggcaggcctcaactaattatagatgttattatcatagctgaaagatgtgatgatcccactacattgtgcacaaagactcaaaaagacttgaaaatctttacttagtcaacagatacaatttccagatcatggtttcattctataaagaaccactgagggaccaaggcaggcccaagactgagggtggtaccaacacttgctcactaccctcccaatgacgttgcttggtaagagttgccattactttctcagatgaggaggaggaggtgctcatccagcctgaggttgaatcaatgcaccaaccagttgtgtctgagtccaagcccaggcgctctccacttccattcaaagataatcactgtctcttccttaaaatgtggcagtaaaattaattgcttgaactaataagacttgaaagggccctggctgagctgcctgactcatggttacattgggacagttgggtgacacttctgcagagacagcctgagaccaggtggagacagatagaggaaaggggtgcaagtgctgagagcacagatccgccacagccacccctgtgtgagtgggacattcaatgcagcccagggactgctccctgctgtgcatgggcatgaccaagaatgtgcagctcaggctgttctatgaatccatggcttttgttggttctctgtatgccacataatatcattaccgttttttgttttttgtgtttttttgagatagagtcttgctatgtcatccaggacggagggcagtggtgtgatcttggctcactgcagcctctgcctcctgggctccagcaattctcctgcctcagcctccagagaagctgggattacggacacgcaccaccacgcccagctaatttttgtatttttagtagagacggggtttcatcatgttggccaggctggtctcaaactcctgacctcagtccaggtgatccacccaccttggcctcacaaagtgctgggattacaagcgtgagccagtgcacccggccatgtcattactgtttttagcagagctgccacgtgggaactgagaccatcacaatagagacagaggcatgcatagctttgaatatggcatatttcacgatgcagtccttaagtacgatttgctaaacatattagatatcaaaaagaaccacttaataaaaaataactactattcatctaaagaggatgaatctacaagaaatcatttttaaggaaagtcagattttaacttagaatccttgaagaatgtcttttatttattatgtattatttatttgacttattacaagttctcattctcagaagccttaggcacgtatgtgaaatataaatggaataattaaatccaatagctaaaatccccacaaagaaaaaaaaaatcaatgtaatgttactatttgcaatttaattgaagaaatcacttaaaacatgtagcaatttaaggaatttaataagaccttcacccgcttctacaaaatgaggaggcaatctactgctggcctccttctgttcttctttatgtagtagcgccatgtctatattcttcatagctcaccacagttgtaattactttgttttccttttgcatggttcattaaatatgtgttgaaatgtatgtatatgtgtgtatgtacacacacacacacacacacacacacacattctctcttctatttctatctctaaaatatgattctggattagggaatttattaaaagaaaagcctctgaaaaactctgatcacggggttcccttccattcaactgatgtttttctaaagaacttgaaaaacaaacaaacaaaacaaaacaaaacaacaacaacaaaaatactcctttgcaaagggagctgctgtccctgactggagcatgttgtcatatgtccgtgaccaggttcccaaacccagcctacctgctctagcaggcttctagtggggctgcttaaatccatcctgtttgtaaggcaggcagcaggcagccatggagcctgcccactctctgaaaggggccggctgacagcactacccatccgccctgtgtcgatttccacacggcacctcagaccaatgctcctggacaggaccagaggttgtggagcaaaagaggatagtgaaggaaagagacagctgggagacgcagagctgacgcaggtgaggcacatccctcagctggcgctcccttcccggaaacctgattgtctccgtcagtcgtttcaggcttcgtggtatctagagcagcactggactattccgtgcagggctcagggcctggaacacaggaagtgctccatgcgcagttgtatggctggatggatggaggatgaatagtgcatgggtggatataattaagaaaggaaagaattgaacattatttctttcatgtaaaaacttctgattcctcctgagtttctccactttcacttgtctccttcactgtctgcttccttcccttctgtcacggatgtattactgtctccagtccttggtcccttgtgtgtctctcttcttgcgtctactacatttatgtgggttttcccataggatcaccttggcccccctacagaagcttagtcctgcattgccaactccagctggacattctcacttatgcatctaccatatcctcaaagccggtataactattgttaagttaattagctttttttttttttttttctaattccttctccagattttcctggtgcctgtgtaactcatgccccttttgagcacctggctcgaggccttggcatcgtctttgctctgctcctccgttgcctggtgtcctttgttgcgggccttcctgccatttctctcactctatgtgggttgtgttgcaatcattttctaagcacacttcctgactccattttcttcccactgaagttgatactatccactaaagaacaattaattttctcagattacttctctgttcatgttactccctgatttaaaaatctccagtgactcgttatggcttaaggcagtggtttcccagaatgttagatatgatagagcagtaaataaaacaattagaaaaaaaatcaaaactagaaaaaactagggaggggaatcacttttatttctcctactacagacatgttttaaattaccatctatggtggcaatgattatgtttagaaagagacacttttttttttttttttgagacagggtttctctcccatcacccagccttgagtgcagtggtgcaagctcagctcactacaacctctgcctcctgggcacaagcaatcctcctgcctctgcctcagcctcccgagtagctgggactatggcatgtgccaccatgcctggctaattttcatatttttagtagagacagggtttcaccatgttggccaggctggtctcgaactcctgtcctcaagtgatccgcccacctcggcctcccaaagtgctgggattataggcatgagccaccgtgcccagctggatgagacattttaatcttgaaaagtaggaatgaaaatctcataatagaggaaaaactggaaataatagaataataataataactggaaataatgcttttatgaaaagctcaaaccactggtcacctttatctccttgttctggttccttgactggtgacaacatctctgtgctacacagagatcccgccaagccactggtgctcggagtaggagagagcttcaacaagcactcacggtcctttcatccatccatccttccacactcatctctcctcctgccttcagctgctcagtctgattgtgtctgagctctggggattttgcttaagaggcatgtgacacattgcctggtctctttgggcctttccttcctgctctttaaaatgaagagttcgaaactgacgttaatgaggtttcttccgttgctaaagtctgtattcaaattgattgattcgtttatctaattaaaggtggtatctatatgtgcacttaaatctagctttctgtctcataaactcaaaattaaaatattgaggcttataggcaagcatttatcatctgaatatgaggaatgaactgaagtacgtacgcaattgaaacctttccttatttacatgtagttagcttgacatcagggaacaccctgagtaaagtaggaaaatactcatttcatacatattgctttagtgtatgtgtgtggaacatattataatagaatatctgcccttccatttcacttagctatgaaggcaccagtgatttaacgtatactgttgtttttgcttttatcttattttattttgatacagggtctcactcaattgcccaggctgggcagtgatcatggctcactgcttgtttttatccccagcctgccccatccttcccacacaactaagatggggttcaaattgaagtagcacagacaaaaaaaggggaaagggatgatcgatcatattttttttttcaaaggaattaccaggcttgggatgtttaatcttggcagatggatgcagtctcatgagcctgttttgcagatttccagtgctatctgggcagagccaaatgaaaaataaatgcaggggaacatggacacaggttctagagtgggcaatccctcctgcagagtggaagtccttacaaatcctgtaaactccactccagtctcttaaattggagagattccctaccactctgtgtacatgaagagcagagagtttagagagcttgagatgcttggctgtaatctattcatgtgcacatttcccacctgagggccaattatcatctcagattcatttagttgtgactgagagcttcataaacacttctttgatattgacatcatatgaaactgatagatgggctcctaaaagaaagacatgggtggttcaaaatggaatcttatctcaatcctgtcattctgaccacagatcacatcttgcccctcaggagtcattttccgttgggttgtacatccaagtcccctggctcttgtggccaaggggagggacctctggatagctctcttcaaataggaaagtggaattctcacttttggggtgggcaggcaacttgccggacattagtgatgcttgaccaagtgccaggaagaggccattagctgggtgcactgctgagaagagcccattagcacccagctgccaggccacagtttggaacttggagcaagctatatattcacagcttagaaattgtgattctctcagtgtcctacagatggcttggaaagcgtgcaaagatgaatcatactctataatcattttgaaactttttccccaagatatcaaagagacagaagaaaaattaaaattgtggtcagtttcctggacattttatacacttgcggctgctttggaaacatcaaattttttaaatttttatgaacatacaaaaaatcatgtagaacttgaaaattgcctgaatttttcccacagtggcactttgttaaatgcaaaacccatttttcaaaaattactcatgagctaaataaaaaataacaattataatgtatcaaactctcaggatgattttcctccctattcttaagacagcatctgttttgccctccaagtcttaggtattcccacatttccaatgaggagatcagggaccaaccagggtgtgtttatgagctctctgcagcctggcccaccttcattgtctgattctttctgctgtgcattttggtctcttccactctctctgttctggctctgtgtgacccttgctctcttaatagcctctgttcttgcctcctttgcaagctatgttaatctatgtatttgctgcccactgtaagtgggcatggactagaatgaaggatggtgtatctgcgtgggaggaagtaggtatctggagggctggatgactggtttgaggtcactttacactctgtgttttgatccaggcaactgattgtaaattaaagtcactcaattgaaagggggaattcattataaggacacagagctgcctcacagaaatccagggaaagctacaacgcctggcttcagaaagggaggaactggagcatttttgttgatctctgcagcaataattcagagtttcaccccagttttctacaatgaataaaatttatctatactcctcatgtcttctggtttttgtcctttgtccttttactaacatagtctcttatgtcattctaaattcccactggggccatctgatctttttttttttttaaaccaggtcaaagttatggtcaggccagagatagctacctttcaggtcagggaacagcacttggtcccatcacctggaagggcatggcctcatgcctgcacaggcttgcaaaggaagtgggttcattgcaaaggtgtgggcatgccaggcacacagagcatgtcttatcacatggccaggggccatgaggcctgccacactgaggtggacctgattgttcagtcacactgcatatttgtcatgggggatggggacacccccaaagtatgcaaatgcctgaactgtgattttaaggaaaatgcaaaatcatgaagtctgacattttcgggaacttttcccacatttgctttagcctttcatttccttaaacccattgaaacaccctcctttaatattggattaagaaaatgcagcaagcacatacctgttgctaacacactgaataaagcatgaaaaaaagcagaagcagaagattatatttcagagattgtgattattacatttatggacttagagatgaaagataacaatcagataataaaatttgtcctaaataggaaccccagaatacatgtgtcagagccagaaggagctcatgggtcagtaccaaagccaataccattatcgattccctgaagtccgaattaatagcacacaggatttaggaaactgtggtcaagatagatattagcaaaatgtgattcctgtggaccagggagacagaagcctttattacccacagagatgcagctttcaatttcacactgctgtaattttaacagcctggagctgctcagacctgaaaatactgtcagccttatacccaccctatagatttggatattctcctccaaaaagaaattgttccttttgtacttaaagtagtgcaaaatcagatttttgcaaaaatacattgttttccatccttgttcatttatggctacctcgaacatatttttcactaaaaataaacttgaattttgaactaaaattgttaatagaaatagaaaatgcatagctttttagatcaccccaaattgagtatctttgggggccgagtctgaaggctgcttctgaatttaaacatctcctgtctgaagcagacattactaaatgtctcatactgaaatcactctacattacacctctcacaaaaccttattacttccaaattcaaactcttgttaaaatttgcatcactccagtagttatatatcagtaggaacactggcaatgttgagtgattttaaggtaattgaagcatatttattttaataggcattgtaatctggcaggcagtgaagcaaacacaggaatattgtagcaaatagggatactgaatggctcatcatcaagaatacaataatcaaacgcattaaagacacacagtgaaaaccaggtgtgaggctctagggaagcctctcaggacatagcgcagacccctatggctgtggaggcttcagagcagggtgaccgggaacatgagctctgcatcccggctccttggccctgcctttaatacctgtgtgttcaatgggcaagggcatcagctgccacactagtttcctgtggccgccataacaaattatacaaactgggtggcttgaaacaataacaacttattctttcacagctcaggaggccagaagtataaaatgaaggattggcagggttggttgctggagcctctgagggagaatctgttccatgctttgctcccaccttctaaggctgctggcagtcctggtgctcgttggcatcacccagtctctgtctccatcctcacatggccttctcctctgtacctgtgttctctcctcttcgaataatgattctggccattggatttagggcccaccctgatccagcgtgatctcagcttcatcctgacactaattacatctgcaaaaaccctattttcaaataaggttactttctaaggttcctggtggacatgaattttgagaggatcatgattcaaaccactacagttgcctcaaatgtaaaatatggatgcaaaaaatatctgcctcgtaggttgttgaaatgtagcacttaatgaaaataaagtgcttagaacagtatttggtatgttgtaagcagtgtatgtgttttaactattgtattagtaagttaaaagatcacactacataaatatgtttgtttttatttggcaaagaatcatttgcaggtatgtttacaagaacattacctttccccaccacaccaactgtctccctacctccctctccttgacctacaaactatccacctttaacaaaaaagagagttcagacctgaaggcaaagcttggcatgaaatgacgctgcagcaatagaaaggaaaatgtaagccaaaccagtgcccagcctgatcctgggtgatagaggacagagaatctgtcaaaaaagcccatgactgctgggtgccaagttacaaattggcaagctttgttgggcctagataaccaactcactttaattaaattgcctctgattgagctttgggccatgatttttcatactgagtttggctctgtggtgagccagctcaggcctctctgcattaaattgttcagaggtgtctttatctgaccatatttagaaccccaaagcttgccttgttccaggcctgcttggctggtgtagtcatcacacctggtttgcactgatcctaaagtgtaacatgttcccagcctacaggctcagggtggcccttgcaggacacagtgagtcagggcaggtggagaaaaataaacaccagtgtggaactaatgaggttcaggtgggagccaaagaagcccagatcctggcaaaacaaagagaggtgagtgatgctttgctgccttttttcttctccttacctttgaatggaaaatggtattaaagggaggcctcatgaggctgcatacagtccagccctggcctggatctccagtggttcctggccttgtacctcctggtctgcatgaaggagcatttcatgcctcagagataatcgattcaacctgactccagtgcaatccaggtgaggctgagacctttccaaatgcaggtgtgaagggaatcacctgtgcttgcttcccagaggaaaaacagtcaagaggctggcccacagagctgtccttagtggactccctgccatcaaatgctgcatgaccgataaacctccccctgaagccatgggtgaccagactcaattgtctaaagtcaattcagcacccttgatagacctctgtcatcacacctgccccagtcaggccctctaccctcctgcatctctcgccccagctcctccccatttcctgagcaacaggcccttttctcctgtttctctttgaatgtgtcttccccacatctcacctgaaatattgctatttgtcttctgagaagccaggccacgttttcatgccttggagagggagccaaggaaaaggctggagggaaaccaagccactttgacccaccttgtctggactctctctccctctttctggtgttttcagtcactattcctaccatctcatttaattatcatggtcttcaaaaccttctggcaagctatcatctatttattgttgaaaagcgggaaatgaatttctcccatgtcccctctggttgtgcttcttcttcaaggtctagttcaattgttcctctgatttgaagtcgacttccactctctaaggcagaggtagttttagtttcctcctctgagtccacataactttatagaaaactttgtgatcatatatcactctccttcgcggagatgaattccttggggaggtgagtgggtgcaacagagaatacagttgacctttaaaaaacatgagggttaggggcatcaaccccccacaaagtcaaaaattcacatgtatcatttgcctccccaaaaacttaaatagcttactgttgattagaagccttaccaataacataaacagtggattaacatataatttgtacattgtatgtattatatactgtattcttacaataaagtcagttagagaaaagataatgttactaagaaaatcatacagaagagaaaatatacttgctattcattgagtggaagtggattatcataaagttcttcatgctcattatcttatcttgagaaggtgaaggaagaggagggtctcaggggtggcagaggcagaagaaatccacatataaattgacccatgcagttcaagcacatgttgttcaaggatcaacttctgcatatctccactactttcacatcttgattatgagcagagggtctaatgtatagtagaagaactaatacaaggactaaaggggatgaacactgtgtgatgaacatgatatttgttaattgattttatcctgatgtagtatgtgaaaatccatcaagtataaaagacataatcatttcattttctgttacttcacctgatttatgactgactccttgtgcttctagactggtggaaaattagcctgtcaccatctgtcttctcccctcctccatccccagggtagtgcctagctgaagagcttaggtaagaaaaaaaaggaagagggaaagagacagaaagagagagaaagaaggaaggaaggaaggaaaaaaagaaaagaaacaaacagaagtcttggtcacacatttcctctgagacagtgatataaaaaaaataagatttgaaggagctggagatgaaaatgagaattaatttgtaggcaaagcaaccccaaagtacaatagcataaatagacatttatctctctctctctctctcataacacaatccaaaagtagataggccacccagccacatgtacagctatgcgccaagaggccaatgataccattctaagcatgcagctttcatctctaggcccaaggctgctggtttagctgcaccatcttccagccagcagggagagggaagcagaattcaggaaaagcatggctaagtggaagtggatcatcataaaggtgttcatccttatcctcttgtttgagtaggctgaggaggaggaggaaaaggaaggttggtcttgctgtcttaggtggcagaggcagaagaaaatccagatataattgacctatatagttcaaacccttgttgttcaagggtcacctatatatgccaggaggggtcaaagcccctgacctggagttacacataccctaaacctgatctggagttacacataccatttttgcccacttccctgtgccctcatctaaatatggccacacctagctgcaagagaggctgggatgtagggacaggagccagccaccaactgcccagcgaaaacccaggaggaagtgcagttctgttattaaaaggagaaggagagaattaaaagtgggtcccagtcagcagtctgccacatacagagaaaaattaaaacaacataaattaaaacctcaaatttcatccatccatgttagcaacaaagtgattcttattttaataagtgaggttcagaaacatgaataatttatctaggttcatataggtagtaaataagtaaatggtggagttacaactcagttctctatctatctgactttaaaacctatgcatttcccctaaactccactagttgctgacacattttattcacacatgagtgaataaaatttaagttcatctttccatttccctggttaactggcaggttttattttttcatattaacccatataaaaaactgtaataatttgggctctgttttaacatcctttgttctccacaatgatttaatttattgttgcagtgatgtttgagatatcaataaatttttaggatattggaacctggaaaacactattagcttcaccattctgtgttaggtagagatgtcatgaatttgtgtcactttatacatgaagtatcttgttgtttggtcacgggtgatagctcaaattgtgttcagatagaaaaggaaggcaacagatcaatatcaataaagcctgtgctcaaccatatgatacttttttatatgcaaaagacatactgcctgcagcccagagcaatttagaaatgcctcttgctcactgaaaaccaagtagcatctttgcactgacttttaagctctggagaataggaacatgtctttgtctgcataacttactgcactaccttttgtctctgtgccactctccttctgctgccccacctggcttctgttgaattgattgtgttcctcttcccctctcagcctttctatatagacattcttctaatattctgccctgtaactgttctcatgtgaggtgttcccattcactcccatttctacaataatttggaaaaataaccaagtttatacatctggtcatgacccttcttggtatattataatcatctcttgacatcccttcttcaattattcaacccaaattcccattccatcccgcagctttcaaaagtggcctcctacacaccagttgcatggtagttgatacttcaaggcagctcttgagaaggagaactcttgcaaaccatttcctcaaagtgcttcttattcacacttgacctaatggtctctccccagacctcagcaccctctgccaccaccaggctgaactaagtaccctgcttctgtgagtgtgtatatctacctatatctgtatcagtgaacctagagtatatcactgtgtgcatgtttctgtctacctgctaaactgttaagatttttaaggcaggggtcatgttcttgtccccagcatctggcacagtgcctgaaacatagttgatgtgcaggcaactttgaactgaattaatcatatccttttctaacaatgaattctcacaagccagccaattagaatacatttatgaaatgccccaaatagtaaaaggatatatttatttaaaaaaatataaaaacacagatcaaatacataagaagctaaatgaaagatattagacatcaaagctaacattcaagtactaaacaacctatatgttctaagatatatagtccatgtgtttttaaaaaaatacatttacagacataatgctgaaggactttgtcacttatattgatgaattacgggacagtttaactagcatctgaaggagtatctgaacctgacatggcagagagataggaaaggctcaagagccagagagaacatgatcaagtggaatgggagattaaaactttagttttccaggaatcatttgagcctcattatcctacagaggacaatacggaaaataaaccttattttccccacaaggagcatgagcctataaggaatattagtagattccagggcacacaggcaagggaatagcctcacatctctggaagtccattgctaaaaaaagagagagaaagagcttttcataagtaaattatcatttcacaagataacatactaactttatggccgtgacattttccaagatacatgtgactcatgtgactcagaaatgaagaaatgattgagttgcacatggtgaggaaagcaactccaatatgagagaccgtccttatttccagtgttatactctggtttgtaggaaaggtaaggtattctggaaaccatctgaagaggactacttggccctgtcttataacagatgacttcacatggtaatcagactgagtcttcagccagcagggccaagcagcctgtctattttaagaataaaggcttcaaactttctgtgctcacatctactttaaaaaaagaaaccttcaaaactagtgtatttgactttgcttaacctcagacatttgagtgcacagtagattttttattcctagcccatcaagtgtttgttattggaactttcaacccgtgcattcatggactcagtcatttattctttcaacaataatttattgagcaacttgtatattcctgtttctcttccctcatagatccctatcctcatgaaacactcagtgttttttctgccctacagcaacctttgtggtcctggcattgcagctgttctcacttttctttaagttgcaggagcattttaatcattaaagtgaataagagttattttttaagccctgaaaagctagactttctctgtcttcactgcagtccatcagcccaggcacatgaccaatccctggggtattggcctagggactcctgggacagcagtaagtgatgcaaggagccttcagtgtacctggcactgatatgtatgttgtttcctgcctaaaggaggatttctggccttctgataagccaaatttggcttcatacctttttctttccaaatctcaatactagaatttcagggtttcaatcattcccctaggtctccttcattatttctcatatatggcttaaggaatgtgatgtgaatacctttccttcctgcctaccttgatgtttcagatttccagaggtggattttaatctgatgagataatgttcataaagtgcttaacatctaacaggtagtgatactcagtgaatgatatctattagacctagactataataatgatgacaagtgtacagattaaactctgcacataaacctagctctgtgtagcaacagcaagatgacaataataataataataatgttatgggtatagctgtgtttataaatctgtacatgctaaacttttagttattatttcttcttgaaatgtaaataattttaaaataataaacccttttattctgaatggtttaagtgccagaagattttacctatgaatgcagctcatattcattcatatattcactattaaataaatacttgcctcattcctgcttcccctcaacttaatcacatctgaatcttttttagtcccccataaggtttcaaaagctttgttcttgtcctgattagcatgtgtttcttcagagacaccactttggagtggaagtcagcaccagcatctccttggcaatcttctctcctgacagtgtaatttaaggttatgagtacaaagggtctggtgggaacccgtctacagcagccttatctcagctccatccctgccacatcagcgtttatcatcttcctgagtctctgagggagacagactggaactcaggatttggatcacctgtgacaaaggaaatgcgaggaggtaacaaggcactgcaagaaggaagcatagacaagattctgaatcactttgttcaaaattggatatagagtaaataacagtattttaagatgtttgctaaaaatcaagtaaatgcaaacagaataattgatgagatgccattatcactttcaaaatggcatcgattaaaaaaataagcactcagaaggttggtgagtgggcaacagaagggacgtgtgcccaccccacagcgggatgttgagttagcccctggctttagaaggcagttggcagggagccgcagaggaggcatgtgtgcagagctacgtctcggatctagtctgcgggcattaccagagatgtgtccagagagttctacagagagctgtctgttacatgagggaaactatgatgtgaagtttttaaaagtccaaaaataagaagtggatcagataaataatggcacatctgagtcgtgtaaactatgaaatcaccaaagtcatgtttaataaaactaatacctgggggtaaagcaacttataagacaataggcctatttttgttgtattccttttttcactacatttattttttagagcagttttatgttcacagcaaaattgaagagcaagtacagaggtttcccatataccatctacccctgcacatgcacagcctccccacttatcaacatcctccagaggaatacatttgttacagttgactaacctgaattgacacatcattatcacccagagtccatagtttaccttaggttcactcttcgtggtgtacattgttctggtttggacaaatgtacaatgccatgtatccaccattgtagtatcttacagaatagtctcactgcctaaaaatcctctgtgctctacccattcatccttccctcccttgaaaaccactgatctctttatagtctccacagttttgcctttttcagtattttacaggatgtaaccttttcagattggctttctttaactattaatatgcatctaagtttcctccccatcttttcatcggttgcttccaagttttagcaattatgaatagagctgctataaacatctgtgtacaagtttttgtgtggacataagttttcaattcatttcggtaaataccaaggaactcaattgctgggccgttggtgagagtgtgcttagccttgtaaaaaactaccaaactatcttccaaagtggctttaacattttgcattcccaccagcaataaatgagagttcctgttgctcaatatgtgcattttaattgcaattctgtaaggctctagagagaagtaggcaaagtccaggccctgcagtcaaaaaacttgagttccagacacagctctgccaagggacaactggaagaggaaggtgacggtcggatctccctgcatggtagcgatgaaggataacctagacagtgcgtgcaagtgcattcacagcacctgccgcacacaataaacactaaataaacacaacagtaattattctatgtgcgtgtgcatgctcatttaggaaaaagtagtcagtggctacttttgaaaaaaccaaatatccaatattctggttcttatttttcttctttgagtattttatagctttttagacatttttattttaggttcaggggaacatgtgcaggtatgttatacaggtaaattgtatgtcacaggggcttagtatacagattatttcatcatgcaggtaataagcttagtaacagataagtagtttttctatcctctccctcctctcaccctccagcctcaagtagaccccatgtctcttgttcctttctttgtgtctacgtgtactcaatgtttagctgccacttataagcgagaacatgtggtatttggttttctgttactgcgttagttcactcaggataatggcctccagctccatccatgttgctgcataggacatgatcacattcttttttatggctgtgtagcattccatggtgtatatgtaccacatttcctttattcagtctaccattgatgggcatttaggttaattctatgtttttgctattgtgaatagtactgtgatgaacatacatgtgcatgtgtctttatggtagaaatatttatattcctttgcgtatatacctaataatgggattgctggatcaaatggtagttctgttttaagttgtttgagaaatcgacactgctttccataatggcagaactaatgtacattccaccagcagtgtataagcattcccttttctccgcaatcacaccagcatctgttattttttgactttttaataatatccattctgactgatgtgagatgacatcacattgtggttttgattttcatttgtctaatgatagtgatgttgagcattttttcatatgctcgctggctgcatgtatatcttcttttgaaaagtgtctgttcatgtcctttgccaacatttttttttttttttttttttgagatagagtctcactgttgtcgcctgggctggagtgtaatagcgcgatcttggctcactgcaatctctgcctcccgggttccagcaattctcctgcctcagcctcctgagtagctgagattataggcacctgccaccatgcctggctaatttttatattttttagtagagattttatatttttcaccatgttggcaaggctggtctcgaactcctgacctcagatgatccacccacctcagcctcccaaagtgctgggattacaggcatgagccaccatgcccggccctttgcctactttttaatgggcttgttttttgcttgctagttggtttaagttcctcatagattctggtattagacctttgatggatgcatagtttgcaaaaattttctcacattctgtaggttgtttactctgtttcttttgctgtgcagaagctcattcatattctttttgtagcgggggaaaattacatatatatttaataatcctatattaatataatatgtatatttaaataatcctactgtgtggtatagcagcttaaataaagggtccatacctttccctgctaactgtctctggctctcacataatctttagctcactgattgcatcgctgttttctttgctgtcctcttttccctggtcttgttgcctgtatagtatctctacttggatgtcaaacttgccaagtgcaaagcagaattcttaaattttccacagaagcctgctgctccaagagtctccccatgtcagtgaggaactgaggacccctgttagaatcagtctgagagttttgatgtctttgattccaatctgtctctcacttcacattcaacccatcatcagctccagttaactgtgtcttagaaatgcctcccaatgtaggctgggtgccatggctcatgctggtaatcccaccactttaggaggctgaggtgggtggattacttgaagccaggagttcaagaccaacttgggcaacatggcaaaaccctgtctctactaaataaataaataaataaaattagctgggcgtggtggcgcatgcctgtaatcccagctattcaggaggctgaggcacaagaaccgcttgaacccaggaggcagagattgcagtgagccaagattgtgtcactgaactatagcctgggtgacagagtgagactctgtccttctcccctttcatagcctctgcctttgtgtttttatttagggatggtgcctactttgttttttgctgcatccctaacacccaacaccatatcttgtgtatactgctgaattgaagaaatcacaagggtctgaaagaggacttagagcaaagttggtatggataggaatcttctgctcctcagtgcctcaggggcagtggacacaatctgagggcagccactagggaagcatagatagcaaggagagagagagaagagcttatcacaaggcagtatgatgtggcttcaccagtgtatcaccagccagaacataatttggggaaagggattaaagaacatcttggtctcatctatttgtgatcacttgtacctacagacaaattgaatgtactgatcagccatgtcagccgagtggcttatagaacagaaagtttcctcattctaagcccttgaaaatctctcttctacttactaagtatataactaatagcatgcacgttttcctttgtttttcaatctgggatggataaagcagatttctccaaaaactattgagagtcatgggtattctgtaaggttttggggtctcaaaaagaaagaccccattaaagtctttttttttttttagtttactttgaggggctttggattccattttcagcttcatcaatgactcagagtcgttctttgaatcaatcactcaaccttttagccacaaaacttcctcatttgtaacaggagaataatgagagctgccacaggtaagctcccagagagtcgtggagatccctctttattcactgtgctctggatttcttcgaggaaaatccctgggggccggctgagtacagacctgcagaaagagagataagatgtcttagtgtctggagaagtcatgacaaagccaagccaggaggaaaagggaaagacaagtgtactcccttaggaaaccagagctaaggtaaaccatcccaagtattgtttctttttcttcttcttcctcatgttccaatatttttaagccaaagaggagaaattaggttaacatgaatagcagggggagttctgaaagtgaaaatgcacctccaattgtcagatgaagcccaaggttccagtggtaagtgtgggcaggaagacggagaagctatgagctggaaagtttcctataatcatctaggagaaggcccctttttcctgccccttaaactgcctcccaaattgcctgacctcagctttgctataggacttcttaaaggaattattttaaattatttaatagactttatatgacattggttttcaaagtacttgtataaacattagctcttttgatttttacaaatccttattttgagcaaaaccatcgtcatcatcattaatttaccaataaagaaactgagttttagagggattaaatgacttatttgagcccatatgaccaacaggtgatatagccaatagaaagctggatcttacaactatgagtcctatattctcttgatacaaaaaatgttgctaaacatgcagggagatggtgcttgaactcccgagtcaccttcatgatctcattccctttcttgacattttctgccagacttaagatctggtttcttctgcagttcacaattacaatcacagtgctttatcctttctcttacgagttccagagccctactgggctactctttcagtaaccagtacagaaccacttacattattaattttaatttttctttttctttctttctttctttctttttttttttttttttttgagacagagtcttgctctgtctccaggctggagtgcagtggcacagtctcggctcactgcaacctctgcctcccaggttcaagcaattctcctgcctcagcctcctaagtaactgggactacaggtgcgtgccactacacccagctaattttttgtatttttagtagagatggggtttcattgtgttagccaggatggtctcgatctcctgacctcgtgatccacccaccttgacctcccaaagtgctgggattacaggcgtgagccaccatgcccagcctattttttcttattcacccccaccaaagatccaatggagagaggctggaagcctcttcctggaacatttatcattcatcacaaggaacccagtttctaataatatttttagtttctttttcataggcatacaatactatataggctttctaaatagctgattcatccccaccaaagtgcattcatcctctgttctgtaatttagtttctgccatttgacattcatgcaagcatgtaattgcctctacctgcatcatagctcagcattagcagacgtgtaagccaagtctgaaagtcagattgcattacacacagcttgtacctccatgtttctcagtcagtgataaatattttatcatatatcaaaacaatacgtaacactagtagtgtttatacagggccttgtgtttataaatggcccttctacttctcaaagtactcatatattcactctgcttcatttatcttcagaggttttctaactttttttttgcatgtttcatagggccacatgaatgtaaataatgtaaatattcttatataagcagatttatgtttcagcatattttcaaacttaatattctttcatgtaagttaaactttttttttctgtatttctcggcttttccctgtctggggtctcctgcctgcaggctggagtctcagagtgtcccagggcaatgtgacatcccgtagacttgtgacttgtttttttccttattctacttcactgtcatgtctcagtggagacataaagacgggccttctgggaccttgatttggcaaaggaagatggaatcctcaccatctatccttcgcagattcctttggcagaatttctctctctttctctctgtagtcaattcattaacaatttttgttgatctttaagtatggttcctaagtcatggttaaaacaggcaatatccctgctttcatgaagttcttattctggtcagatactgtttggctatagcaaaatgaagccctctcaaagcaacttaagcaaaaaaagatcattgttgaaaggggtatttcctgcaattcaaggacacgaatataaacagtactcatgaagagctaaaacctgaaattgggaagtcactggagacaaagcaatgactctctcgccctctgctccttttgctggagccacctggggtttatgtcttctcttttggagggtgtttagcaacatcagtctcctttctgtagacgctttatctactcaagttacaaggtcaatatagttgcctaggctcaacttcatgtgacctcctagtcgaatctgaattgccagttctcatgatcgaccctgtccacccaatgggttgactcccttttcatcaggagttcatccctgggccaagtgcatggtgctgcttacatgctttatggatttacggtttcaaattgtcattcaagttttaagctttggaaactttctagtaatagattatgttctttccagttgtttggcagctccatcaaatgcagcatcagttgaagatgcaccaaaaaatattcacaaagacctatgtaaaggtcaattagaaagattttgttttcaataagccaatgaggtagccatactcaaatttagagtcttatttaggattgtctagtattctgtggaattaatgtgtcaactcttgtcattcttacttcacatccatattgactactttcatttatatagagaattacacagtgttaaatagcaccatttgatttgcggtactctaatgtataagaatgtgagtaggaaactgaaacttcagtaaccaggaaactacttacttatttttttttagtgccctgtgaagcacagaaattatctgaaaaattaagtgtacatcttttttcctagcattaggaagttgtgtcagccttttcttatccactaaaatcttaatggaatttaagctaatatacattgttcaaagtcatttgtaagttttataattctttcaggaaaaggatcttaggttcctgatggtttcactagaaagttgctatggcttcctaagaagtgaacttccgagacagctaaaggatagctttaagtgaatctaagaacacattttcttttcaaaagggctgcagcaggtcagtttccaaatataaagtcaaaattatcaaattatctctcttctgacaataacataatagaatgaagcacatttattgtaaagaagcccatagatcctcagaaatatctaaaaaagcaggtcatacagtgctcctttgatttatttacttattttttacattctagctctggctgccctgattctggacctttggatgtctaatttagggcttcataagaggcttttctctaagggagctggctgtgttccctaactcctacaaggacatttggaatcaccttgtgtggtcctgacccatgcttctcatttcagctcatcctgtacatcctacctggcctaactggctgtgaactctcctgaattaataagatatttaatagaggcaattttgccatttgcactttctaatatctaagacattctttggctgctcatcatcttatttgaaatggaaaaaaatgtactagcaactgtgaatgtcaattttagaatgttcaattaaaatagaagtgaagacaacacttaaaatatactaggaaatttactcatactttttgaataattcaaataatcaatgattctttaccttaaaaccatggaaaaccctgttgttaggcacttagacagcaaattggtgttagaccattttcagtggtcaacataattcatccttatctatgggagaaccatgtattcacagaatacacacaatttataaagcacactttgagagtgctaggaatccaacagggacgaagtacaccctcaagaagctgtaggtataggtgtacgtatagatatatgtgtggtataggtatagtataggcataggcgtagacgtaagtacagttacaggtgtagtgtagatataggtgtatgtgtaggtatagatatgcgtgtaggtgtatatttaagtatcggtgtaggtgtaggtataatagaggtaaggtatagacattggcataggtaagaatacagtccttttctgtaacctgtttttaccaatgttattacttttcaggtgtcatccagaactatgaaaatcgcccacattcatttaaggtcaagattaacggagtcagagacagctttcagctgctgaattttagaggagttgctgaatttcaaattgcatataagtggcagttggctcttttgcaggtttatataaaattttgtctgctgccactgcctgcctattaactttttttaaacataaagaccattgaaagataattagttatgtgactgggatagaatgggtcctatagatccatatagctttggaaaatagtaagtagctatttcctatgaaagatttggaagcttaatgaataaaaatatccagaattttttttaagtcaaaactctaaatctctaaaccatgaaggaagttcatttccttttaagacagtaggtgtggaggatcataatgaacatgaagttgtgattctaataccgttgtcgcttatgcctcttttgaaatacagtaatgagatagcattcattttgctttatgactccgcaaatgtttggcttgagccaccagtgaaacactatgccaacataatttatcggtctctaaaacaaatacattaaccttttcattctcaagcctgccttactctaatatctggtaactttttatcatgcatttgttttatttgtcattattggccaagatagcaattgtttcacagcatattatactgactggccaatcccatgagtaccagagcatttgtatttctacagaagtatcagtttcttctcaaatggaaaatgcttatttgtcccaccttggattagaatggataaagctttgtaaaaatgttattcaccctccaatggatttaaattatgtgcatttgtagaaaacttctctaaccagattcagtgtgtcccaatggtttaagaaagagggtttttcagggtggcagcaactgtatactaagcataagaaaagcaaaatttgtctatgatgtcttcatttcagttagattcttgccatcaagttgggcaagtctgctgaaacctcctatttaaaaaatgcagatgtgaaactgtataaaccattgccttttatctcctaaaattgaaggatctcaaacatgtacactgagaggcaaggactatttttgttttattgtgtattttgactgcctgctcttggaacaaagcagacacttaaatgtctgctgaatacacgggtagctggctggggaggagggcaaccaacacaagacgccgcccgaccttgattcatttgccatagatgggaaattaggagttggtgcaaataataatctgaaatgcataaaatttgtcagtccacattcttatgcataaactgactcaggttttgctttgacagaactgggccatccccaggatacactgcctcgatggccatatgtaaatgaggacatgcattgtttatgccagaaggtgtgtagtttactgctttctgatgtgtcagtccatgggaaagcctcaaaagaaagagaccctgctcaaagtctgtgaggagctgggacttagcttgattctttgtccagtgggagaggcagaggcagaaggaatggcagagaatgaaggttgatcaaaatcagaaagagtacagaccaaatgagatatgcatgggctatttctggggctcgttgccttcagcttgtcctgccttatgctatattcaggcaggggatggaacatagggaagaaaagtcatcttggcctccagctttccaaaaaccagggagagtaggatatgataccggaaagcacagggagtggaaagaacacaaatcaaatgcatttgcttgattttacctgctttgttgaagagttttgtatgtagaaacagaaactgttttgaaaatggagcatttgggtgatctgaaaattttacttactatgctatgccttttccttccgacgtaaatattctcttccttcctcagctccatggtagtaaaaaaaaaaatatgactaaaacttttcaccaccatggaagccaaatgcaattaaatggcgacatgcctctgtgttgctttcctgatatgcttctttacaaagacgatggatttaataccatttatctacatagatggcagggaagccacacttttttttgtaatcttcatctataatttctactgggtttatttttatagctacaattaaagtggcaatagaataatatccaaccccataatttttccaacgaaccattgtgaaaaatgaaaggctagcagttctgtaatatttcttttccagcactgcatagattgtgtcttgttccaagattcttaccttaaggatttatgatgaactttaatgcaggcagcaagtcacattttatttagagaagatcaaagccaaggaggcaaaggggttattgtttttgtgacagtgttgtggggttcagagctggtctctcacagattatttcatattttcttttcttttttttttttttttttttgagacagggtctcactctgttgcccaggttgggatgcagtggcatgatcatggcttactgcagcctccacctcccatgctcaagcaatcctccctagtagctgggactgtaagtgcacgtcaccatgcctcaggaatttctgtgtttcttgtggaggcagagtttcaccacattgcccagtctggtctcaaactcctgagtgtaagcgcttcacctgcctggccccccaaagtgctggaattataggcgcgagccactgtgcctggcctgtcgcctattttcttgtacaccttgcctctcctctctgtcttgtgcttggtcgtatttttctcttcaacaaatgagagcgcttgctgtagtgaagttgttacattcacatagattaattctttaatcgagcctttcttcttatgttgtgtcaaaaagaaagagagagatatatatagagagagagataaggtatgctctttctgttctcacagcccttctcttccattccaaataagaaaaatgattattcacttgtacggtgctgtgagaatggacctgaacacattttaaacacactgtaactgtttgttccaagcaaataatcactgtatgtaatcctgtcacaattggtgctctcttatccatggcccacggttgtcatggattgggcgtgtggcagttcagagagtacaggataaagcacaaacttcaagtgcttttctttttctaggcaaaatctataaatgacctttttcagtgtcttgctaaacaatctcatggaactcgtgatcctttttttgactagaaaggaatgttcacggtttgataaaggaagcgtcgatctcagaactgcacctagacagtctcgttcctgatgctagaaaggcactgagcagagggtcaggttgtgcctggaggctggggaacgatatgccaaactgttcggggaaccctagaaccgcatgctctctagagtcagcctgtcatttcacctccccacatgcagtggcctctgcctcagggaatgaagcccaggctcaacctgatttcccacaggttcgaactgacttatttgtgggttaaaaacttcctgactaccaaagactcctctttctatttctccccactggcccccaatattgaaagattttgtctactcatgaattatattctgaaatcatgatacactttccctgttagcggatgtcatgcacgacaaccaagctgatgctttccggatgctatgaaagaatcagcattgccacacccagtgcaccgaatttaagctaaagccaagcaaaacaaataggcttttaattattctgcacaacttccttgagtatcagtgcaaaatttccagtaaatacctgtatgtctccacaattacattcatgagctttttagagaaaactcttatctatgaacatgttctcttttctggctctggatggtagagtgcctggggtttggaaatctgtcagacctgacttagaattttactagcggtgtggccttagataagttattttacttctcagagcctacagtcagaaataaagaaaaaacatagaaagtgcctacaacagtatacaatgaggagtcaatgaatgcagtattttaaaaattaggtacttactgtctgctagctatcatcataatttcccacacaatttccagcatttatcccaataactttttattttcatccaattaccaaattaatataataaataatttattgtgaatttcatgaaggcgaagactgggtcttttgtctttggattctcagcacttagagtgatgcttaggcataaagaaagtgatcagggtatgcttagtgtataaatgaacaaccaaatctaaaaactgatgttaaataataataattatatttatatatctgcacacatacaaatgtacaagaattgtaattaaacataaaagtaagcccctcgagaaaaactacacaaataggagacagttaaccttaagagattagcaaggagctctttgtttaagtttgtgaagtcataaattacatgagctgtgatagacaaattgcctgtggtcagagctggtgcgatacaaatgagtgtccgttgtctgccaggcagagttgtaggtgctgaagatggtagacaaagggtatgtttcctgcccataatgagcttacagaagaatagtacaagagacacatcgtccaatcattccaacagagggagatttgtgcaatgatagaggtgtgtctaggatgccggggtgcgtcaagccctggagtagaaaagggatgccccttttctaggggttgtatctaggcagagttaaaaggattaatagctcaggggagctgaaggatgagctgaggctgaggaaggcagggtaaaagtattccaggaaaaggatacttcacaaaattaggtggagacttcatagagtcttatgttgctagaaggtaaagtgtgaggctgagaatgaaggaagttgagactgaggacttgggtcttatggatcttattgaagaacttgaactttattctgaactttcactggtaccttgaaaaaatttaaaccaaagaatggcatggccagattgcattttgtatgaatccccttggtggctgtatggagaatggatttgagaaagatgagactgggttctgggaaactattcagtggctgcatttgcaattagtccaggaaactggaaaccaaggcattgaagttgggatggaaaggagatagtaatttgggaaacatttaggaaacaatatcagcagaagttggtaattaatgggatgttagagttgagctgagggaagagtctaagttcttcatttgcatgactagatgtaagggtattttctccattgagagagagaatgctgatggaggaatgggatttcagaggtagggggatgaggcaagtctgagatgcctactaaatgctaaaggtggtggagctgaaacctcaaaggtaagatttaaaatagagtctcagtcaggtcatctgcacctggaagatgagaagttttacttctgagatggttctgtggcataaaccacgcctgggttgacatggtgtcttagtccatttggctgtataacaaaatttcttaggctgggtaacgcataaataacagaaatatattgctcacacttctggaggctgggaagttcaaaatcaagggtccagcagatgtggtgtctggtgagggcccattcttcataaatggcacctacttgctgcatcctttccacctcttttgtaagggtactgatcccattcatgagggtggagccctcctgacttaatcactcccaaagccttcatctcttaataccatcacattgcgtattaggttccaacataggaattttgggggaacaccaacattcagaccatgcacacagcttcataatgtaaggaggaagctgatccaaacaggagcagattaaagcccatatatagcttcattacatattctaaggcttccttaagaattagacagagtcaactcacgaagtctgaaataaaggacagggcatcaagtgagttcatataataaatatatatccacagttgaaaatttaaaaatagatatttctaaagagaaagatggaggcagaaatgaaaaaagagagcagagtggaggagaaagagaagaaagagcaattcagagagaggaagggacgaggggagaaaatgagagagagagagagagaaagagagagaaagggcatgtacttaagagaagaaaaagagttcctgctcctgggaatttcaaagcaatcctggccactcatctgcaatctggaatgaaaaccctatagcagtatgtttcctttctgctttaagttcaaaaacttaaacttttatgcaaatatatgcagaatcaatattatatgtgtatactaaatactcatgggtttgcattttaaactttcaggagtatgtttagttatgtgacactttattaatattgaactgatactgtggcttttcactctcaaataaaggaaacacatttccagggtttgaaaagaggaaaacgattgatttttgcattccggtgttttctatgagcccctccaacatctaaaatgtatctcaggtcatatttgttttcttcatacacaaattctgttctctcctctgaggttgcctttctgttggcttcttcctgcccccagtgggaatccagcaggagccacacaagatgaaacagtcagtgaaatagctcagaccgtgggctctggactggattccagccccagtgctgagtcctgagctggtgaccccaggcacctcatctaacagctgtgtctcagttatgttactgaaaaaaacagggtacctatgactggtgagcaacaaacaactctccatgagaatgcaggttttgctcagtggttttattacttggcacaaggaagggggacactgggtatatcctccaaagcagtgtcttcccgagggaaagcgacagacaggttttacagagcaatggggagggaagagaggtttgggtgcatcctcacgtgtagaggaggagcccagttgctcagatgcagtgagtgattaggcctgcacatggatcacagggaggctttagcaaggtaaagaggaacgttcacttgggttcatctataaattgctggggtctgtcagaagctgtttctaaaaccactgcatgacagaaggctgtaaaacaggctgattgctcaagtcaattaaattcctataatccctggagaccctccctgccttcctacagttatgagaaacctaaagcgggaatgacatcaatgtccacctcacagagctgtccggtgaaatgggaaaaatttcagcaaagcacttagtctgatgtctggtaatgggtcaacactccatactgagcaatcattattattatttaaacagatttgattattttttaattaaaagcatcatcatttaatagcttgctaatgatcatttgtattgttattcttatttaaggattaaatctgcactcccgtggggcataggcctctagcattgctgtcacttccttgctgtcccctccaagccccaaactcaaaagttcaggacctgtggccccagaaagagaatgtgcagccaccggggagttggaaaagctgggcaaaaccaagattggttttaggatcttctcagatttaagaatactccttcttttggatggatggtggcttgaatgtcttcatcacaagagactgaatttcaggacacagaagaaagacaggctcaaggcaggggaagctcaggcattcgtgtccctgcctgcagggaaaatgcctgggactctttaagccaccatgttctacaacacagtgcatgaggtaagagaaggtgaacttcatactggccaagcactgctgcactgcagatcatagcaccggcatccactgcgcggggacgcacctggggtgggcctcgcagctttagatccatgattctgggttcaggttgttcttgagaatttagccattgtaacccttggcttccgtgtttgtgaaatggtggtgaaattacctagtttgatcatgaagattaaattagataatgtatgtaaaggacttaatatcgggcattaacaaacatgataggaatggcagctactagtgcgatatgagttgatttcgttctcctaccctatgatggatcagttgctgaggtacagagaatgacggagagtgcccaaggttacagcgattgaagaagtggtgaggttggggtttgcccttcgttgtaactgactccagagcccacactccacagctctgagaggctggagtgcatggggaccctcgcttgatgtggggaccctggcttgatgtgcgtgagggtgaagcacattcctggagcagagggaagtgattcatctctcccgaggctcttgcactgtaatgatgtaaattattagccctattgatctacctatctggtcattttatggcacttttcagtggagaaccgaaaggcttatgctaattaatagtcctgaatcctaacagactttattacatttagaaatgggaaattctaattaaacttaatgaatctaatttccttctggcctttattcaaattcactgagacctgccctagccgtcctatctaaaatttccacaccacacactcacccacccacccactgcccctccccaccccttgtgtataaaacttcctgtggctcttctcttctttctgtgttcaccttaacacttatcactatccaggattctctgcaattactcctctatctcacttgctgtctatctcccctactaggtgtacttcatgagggcttgcattttggattttttcactggctgtatcatcaacacctaaagcagtaccaggcacagtgggcgcttaaagaatacttgcagaatatatggacaaatgaatccctattctttcccctacagctgttcactctttaacctgactctctcagagatccaaaattctccagctagttgaactacctccccttttttataatttgcttctaaaatccctcatggtgtttcatttctgttccatcacctattgtgacctcaattaaacaagtaaatagacaaaatggatctgtttgccctagaggtattgaattgatttctatgaaaggtatggaaaaggctatttagtatttccaccaccctactgaagcagtattgttgtctggtgtaaatatccgaggttcgttgcctcacgccaaggaaatcaaggacatggacacacatggagtgaggtttagagtgcaggtttactaggcaaaagaaaaagaaaaaaagagaatagctcactctcttgtgagagagaggggcctgcaagtgggtcttccagctggtggcggagtgcacagggttttatagacaggcttgaggaggtggtgtctgatttacacagggcccaaagattggttggaccaggtgtcacatttgcatagtgcatagggaagctggccaccccaccctaattttattatgcaaatgaaatctttgcctgactggtgccatgtagtctgctccagactgcacatgtggttggcaaggaaaagggaagatggagccgccattttgaacatgcctggtcccaggtagccttttcctattggcacagctgccagcattcacctgtgcaagcttctagcttgtctatgtctgcagcttgattttacaggctgctccttgttagaaaagaaaatgatttgggggctgcttttcattaaaagcaaaactttatcaaggacttccttaccctcacaatctgtctaaataatttcttcttaactcctatatcactacctgggaaggtgagatgttaggggaaccatattttattaaagggaagaaaaggagaggaaagaagacacacagaagaaaaattagtagactaggaatcagggtgcctgggttctaatgctggcagttgctaatcacgtgaccttgggaaagcattgaacctttccagaactaagcttcctcttctggaaaagaaatgggtcagacaagatacccccaaattcttcaaagacctaatatcctagacctagccatatatagatctaactagctctaacattctgtgactcaagataacttaaaatatgttttctaacatcagaaacactttcagatcttagtttatgctatggtttttaaaaatattattttcttttcttgggtgtaagcattgatccaacaaggtttaggtcaaagatctttcattttgaattcctttgcgcccaagccaacccatcattttttgaagagtaatagaaacaaaactgtcaggattttcaaaattgatggaaggtggcctttggcagtcttttgaatttgctctctaggctcatgcaaaacatgcaaaataaagcttcaagctttctttgaaaatgaaattggtttgaaactaatagggatttggaaacagacagctgagcagatttccttctgtaaatatcacgtgagttctccatggggcatggaaattcgaggaatttaaaaatagtctttggtcattaatagatcgaagtgttacttctggaatatgagaaggtgatattaagttctcatctaagaaagaaaagggaagatttggcttttttttttaaaaaaaagtatattcatataaagtatctttttgtagactgtaagcagtatctttatccacgtcctggaagagagatggttattaatcttaataaaatgagaggtcatgagagcattaagttgagaaatttcaatgaataaggttgagacgaacttttcccagatatcatctgaaaactgccttagataagttttaaaatgagtctgactttgcataataatggagaatatagatgtaaatattttatggacattaacaaataggtaggatattgataaattaattctttaatgaaacatgttaagtataatggctctgacatttattaagtaccttctgtgaactagttatttatataaattgccagaattaatccacgtaacaaacgtgtgagggagatatgatttttccattaatcttagaggaaacaggctcagaaagatctgaacatttgcttaagacaaaatatctaataagtggttattatggactgaatgtttgtgtccctgaaaaaattcacatgttgaagccttacccccattgtgatggaattaggaggtgggagacttttggaagtgatgaggtttagttaagggcaggaaggtagagccccagtgatgggattagtgtccttaaagaagataacggaaagatcagagctttctctcacatgcactgaggaaaggccatgtagggacatagtgagaagacaaccgtctgtaaaccagcaagagaggcctctccaggaatcaagtcaaccaggaccttggtcttgaacttcccggcttccagagctgagagaggtaaacgtctcttgtttaagccacacaccctgtggtgctttattattgcagcccaagctgactatgacagtggtagagctggcattagatgcccactcttagatttcaaagtccatgccaacgaggatgtgagatcaagaaactgtcatgggctggaggcgtcccgtaggctagatggatgcaccaaaggattgtggatcactgtggtccacggggcaagagcataatgtggtgaaatcttttcctacaagaatagaaaccctgaaggcagggagataccttcccaagtctctcacttccccacacgccctgcacagcattggcctctgagtcctgcagctttttctctgtccctctgaccaccctgctctttctgcctcagttcagttcagccccctctctccactgggcttcctgccttcagtcttgcccctttagtccatcataacccaggagtgatctccttaaaactcttaaaactagaaatgacttatgttactttcctgctttaaacctttctatggcacatggagtgtcactaccccatgtggggagcattagtgtcccactctaaggagaacgtatggatgtgtgacaccaccgtggccgttgttgccatcacaaggtggtgccaagggctgtaatctgtgccctggtcatggcccatgaggtgaggtcctaagtgcaccccatgttgtcttctttgtgtgatctgatgccattcttctcattctcttccctgcacttttccttagggtcagccagatctggtaagtaggtatgctcttctagggataaaggcagaaataaatacaaaactagagcactcagattttgaagctgaaatagcatgcgtatgtaaataatgcatatttgaagtaatcactgtaatgctatttatagcacaccttttcacccaaggatggcaaaacagtttacaaatattctctttctagtccttactgtattccaatatattgtgctatatgtgcaattttgagctatgaatttctttctttcaccttacaaacaatatctgggtaatttgttgagtcatttaacatagggtcaacacttgggaatcaacgtctttttgaatgcagactaaaacacagcacttggctgaaacaaacgtctgagtactgcagtcatcaagccacactcagggttgcagaaatgcattgaagaacttttagggccacttctcattctcttgattgaaattaggaaaatggtcattgcaggtgtattgaaggccaagggagcctccatacgtgagttgttttaaaggcacatttcttcaccatccagaacaggacccatggctgaggcacagtactccaaagcactacataatgtctcccaaatctcccttgctcatcttactgctgctatgctggcctccttccattactagaatatgctgggcatggtctggactcagggccttggcacctgctgttctcactggctggaggctcttcccctgcatgtcatcccagctccctcctcactccactttggtctaaagcagaatccttaattatccttgcctcccatcaccctgctttctatttctcctttgcctttatcagtatgtggcagattttatgtttattggtttattgtttttctttcttttccataatacacactccatgagaacagaaattttgcctattttgttcactgttgtatctactagtgcctagaacagtgcctgaaacatagaagtccttaggaaatatttgatgtaagcaaatagatgaacaagctgtccctggctaacatctgtagggttactagaacaatcagtatgattattcacaactgtgtttcactggctcttctccagataaactggtaaagtcaatgtctaagccacatttcgtaccttagtatgtgaaactatgaatttccatgaggtttgtaattttaactaagaaatcatgtaaagggaagatactttcatggtttgcaagttgtccttaaggcagaaaccctcacacaaagcaattaattagcatgcagaatagaaaaccctgaattgagaattgcaatgcatcaatatggtcattatacatcattcctcttaatatgatttgtttctgtctacacaaaacatagacagaatgtatattcctatatataacacacatgctttgtatttgcttttgaagacagattgcttttaagacttggggatatatgggaagaatctcagtctttccaaattccaaaccaaaaaagtctcttctagctgctagatgccagatagttctgtctgctacagccaggtttccacaggccatatgcatcatcttaaattatgactttgaagcatttcttttgaccactgtgttcgcaatcatcctaagatgtctgcttgtgtatttttctgcaagccatcttccacccttatcctgtcaaggagaagctattgaagctagtagggtatcactacaagcagatggattttattccagaatcccattcctggtgaagatgcaccatcatcaggaccactagcagtgtcctctctgcagagtgttttccaactggtcaggaaataaagactaggaaatatgtgtctacaactgcttcaaaatgtgcatttgacacatgtctgtttcagggctgaagtcagttttggcttcatgccagctgaaggcaactatgaattattccagaaggttaagatccccatgtggctccaaggctggcctgaaaacgaacccattccaaacttggtccctcagcagtgggatcccgaaggccagagctgggtttggcagatggggtgagtttctcagagacagaagtagggaagataagtagggtgtaaaaaccatgttcaacctaagagtaagaaagggagggggctgggcatagtggctcattcctgtaatcccagcaatttgggaggccaaggcaggaggattgcttgagcctaggagcctaggagcctgggaaaaatagcaagaccctgtctctataaaaattcctggctgggcacgatggctcttgcctgtaatcccagcattttgggggggtcaaggcgggcagatcatgaggtcaagagatcaagaccatcctggtcaacatggtgaaaccatgtctctactaaaaaaaaaaatacaaaaattagctgggtgtggtggcatgcacctgtagtcccagctacttgggaggctgaggcaggagaatcgcttgaacctgggaggcagaggttgcagtgagctgagatcatgccactgcactccagcctggctggagtgaaactccatctcaaaaaataaataaatatataataaaaaatttaaaaattcttaaatataggcatgtagtcccagctacttgagggcctgaggtgggaggattgcttgagcctgggaggttgaggttgcagtgagctatgattgtgtcactgcactccagcctcagtgacagagtgagatcctatctcaagaaaagaaatggaaactttcaagtctgatgattcggtgtgatggggcaacatgggagcaggtatgaggcaaagctgacaaggagtgatgtgagcgcagtacagtggggctttctaggggtatggagcaacccctgtgtttccatggctgcgtcctccagttgcctctgtcttagtgcattgcatggcaccatcctccagctgtctctgtcttagtgcattgcatggcaccccatgggtttgacttaaaggtccacagtcagaatggacacagatttaatctgcgaagagggtaatagagcagaaagagtgcccgtgacatttgctaatgacagcacacagagaaggagaggcatccagcccttttgaaagaagatagaaactcaatatactcgtggaaaagttgaagactagtcagttgcaaccagaatggaatacaagatgtacatggagagggagggaaaagcaacctgttcaagtatgagatcaaaaatgagaggttttgtgattttctggacggcatggctgtgttttgctgttaaagaattaagaaggaagctgagattctgtcttggggcaagaaccagaacagccctctattcctcaccctgagtgtcctgggtggatctgatcctcttaaagagacccctcctctgagtttgtctaatagaaagcagagacaaaaagtgtatatcctgtataaatatcattagcatcgcatgcctgtgggatagagtgcatgttatgtggtggtagtggccaagaggcattacaggacttgtgtcccctaatgatggccaaaatgaattcacgacctctcctcccattatgcaatgacaagatcaaagatcaggtaatattttaataattactggaacaagaaagatggagaaatctgatggggttggtgcaggaagcattttggaagttttagtataaccagagcatgaggatggtgaggatatcaagtaggtgtgggaggtgaaggggagctagcagaaaatcaatggagctaattcagaggcttagacaaaagtgaaatataataaggaatatccaaactagagaaaaaaaaacctatgggttactatatggtgggcatctggtgaccatccagtgttacaaataaactaaattccagtctagtaagtaacatttatgtgacactgttgaggctgtaaagaatgtctgcatataatgtaaactgctttttccagcaaccctgtggagtaagtgtagtgttattatcctcacttcacaggcgaggaagtgagacccagaaaacttaaatgactgtctcaaggccacagaacaggtcttagttggcataatgcacacctagctgctgaaacagacaattcccaaagcaaagggacttattaatagagttgtatgcttgcaatccaccagtaaaattaagtacagcataaggaagaggtttcaggcattaaattgtaaccaaagtgttaagggttgtgatagtttggtgggtttagggttttattcctattatcttttttttcatttttgcaatagagttgcattatttttataatgactataataattttacaattgacaaaagatttataatttgatagaagatcctctgattactctctgaacttaaggatagactcatctaagagcttcttccatcctgcacctcacgtccaattatttcttagacagtagaagtgctctgtaggaagaagagaaatctcataagatgtttgctgacctgctgaatagtttgtggtgatgtataaactgagccaaccctatttctcttttaaatggtgttaatttagaaaaacaagttctggctaagggataaaagaggacatatggaaatgaaagattaagcgattaattgaggagaaaaagctgtgcagttgggctctgtcctatattggatgttcattacgccaactaatggataatatataattatgaaaagacattgtcggaacagcacccaagtctattgattttgccatcatgagtacattatgctctatcttcacgagattaaaacgaatggagagggtaacaagattctctatgaattagagtcattcattttcatttcgagaaagggaagtttgctatattttcagcattttaattgagatctagcagatgagaactttacaaggcaataattttaaacagaatttatttctatcttaacagtaaattggtataatgataccaatgttagtctcaaggtaaaatgttgaagagatttagcaccatagaggaaagacagcttgcaactgatgttgatactgctaattgtgctagccagtctcgtgtattttaatacatggtaggtaaaaatgccgcattacataattaggtttttaaaattcagcagatatttactacatatctaccaaaagcaaggccctattttataggtaataaaaagaattttagtatatgttccttcccttcaaaaaagatagttaggaagacaattaataataataatagcaacagcatcaacgtttgttgggcacttaaaatgaacctagctttgagtgcattgtttttactggcattaaatcacttaatccccgcaagatccctgtaagtgccatatttctattcctattttattagatgaggagatggaggtggagagtgtttatctagctttgtcagataagcagtggttctacataaatgaatttccaggtaactgaagaaatattcaaagcccctacatctatatgttctaaatagacttctacatgttttaatcattttggatgaacttgtgctaaagtgtgtgcaaaagttccaccttaaacaggattctggaaatctttccttaatgacttaggccacttatggagtacctcagatgtttccttttaacttggtgatttgggggctacagcttctactgtgcgtggtgcacagtaggattgacaggaaccaaaatagttagaattttatgtaaaataagagtaaattatctctaaataaagcccagatgaattttctttagacaatgtaatacatttttttaaataaacttcctgtattttgggcattagggcttttagtcatttgtttattttgtggtctctctttctcactctctcttttttttttgttctaagctgtgttttgaggagttagcttgtggaataagagagttgataccattgcatatgttgcaagaaagaaacaatactttttttttgtataattggtgtaggatcactaaatccataccatagtttataaattgtttaatctgaaattgttaatatggttcagaaagacttcaatttttggttccatgataaaaatatacatttatatgcatgtggtattatcagagttgttgaaggtgtgtgaacactcctttcccagaatactgcatattttagtgagtggagaaagaatgaagggaggagggattataaagagttgtcatgcatacactatgtcatggtaaataacagctcagagccaagtgttgagaaactggccttccttaaaaagttagcacccgatcagagctaccattagtctttaagaatcaattccgctgcccaaaagctcagactgagttgacaaaacctcaaaggaatcctggaatatggaacctgtatgttctgtccactggggagatttgtatcttttttcatgttaataatggcattgagggaccctatatatgttggtaaattagtaagcatggaaacttcagttatagaaatgccagtaaataagttcagaatagatcagggaagaggttaactatggtaggttgatgatgcaactgtgccatgcttttggaagtgttattttggagtcattggcattgctgtcaaaatccttacatgtcatttaacagtaggccaaatgtgaattaagcatcctcactacgtcacaggccatttaggtgtattccacagaggatggaacccttcttgtggggtgtgttccctgcactctggttattccttgagaaggatgaatgccacatgcctagggggtggtaaagggagtttgtgcatcagatacatattggagtgaatcacctctgaagtccaccttgcttctctgcaggtccttgctgtgtgcctggcactgctatgactcactgtcttcccctttatcattgtccccacctcccacatttacctctactgaggtcttggctgctagtgacctcctagtcatccttcaagtgtcatctcaaatgcttccagtcttggcatcctccccactctcccaggaagggttaggagtttccttcacgaactgcctcagtgtgtcagacccagctctggagtgttgatcacctcgtgttgttgtctatctgatgattcccattgtgaacatctcacaaagggcaccatgtgttaacagacttatatttctggggtgtaacatagtgtttagaacattacaggtacttatgcaatactgttggagtttgattctactcctctgagagtgtatgtcccaaacatacctacattgggtaatgtaagctaaactgctttaacaagaagctcccaaatcattcagtgctgaagagtatgaaaacttatcctcacaggtagcagaggtgctccattttggtgatagctctctttgcaaagtcattcatttcttcttccacgcatgactttcaggttactctgcacatggctatctcagccaggaaagaggggtgaaaggcatataaaatagaatccatgctcagccttaagacccctgcctgcagggctctggttaagagtgagctgcaatacttcaactcatttccattggccagaacatcaacctctgaccatacctaagagctagggaggctgagcatgggctctgcttgtgctcaagaagaacgaagaacatgcatgttggtggacagttgccatcttctcctcctccagacttcccctttttttttaaatcatgaccatcttccccatcatttggcttcaaaacattacaattatgtttgccttctaactcttctttctcacctcccacctagaaagtctgaaggtcctctttcaacgtgtggaatctcttttcctctccgtggcttcctttatagttcaacagaacataataccttaaagtgaatcattaattaatagtaagctaaaaagaatgagaaaggcagaaagcagagtggctattactaaataaatttgaccctaggggaaataaaatcatggaaggcaaggttaagtgcacatatctttaactacttgttttgttttgaggatttcgaaaagtagtaattaagagagaaggcagagaaggaaaaaactggaaataaaggaagaccaaccaaatagaaaagaagcaaagaatatgcagagcctgctgtagcaagggagtcagtcaccatcccctgagtttggcagagactcacttatcacaggcagagggctggaaagctttatagcggagaaacaaatggctccaggtgtgccctgatggcggctgatggccaggggcagctggaggcagctaactagaaacaggacatcctgtgtgagtggttggggtgtgtatttggctttctttggttggtcttaagtgggaactgtggacaaaactcagggacacagtcagttattaatcaattcccagccatttggggctgattgtttcagcagtttttgtttagcttcctggactgtctctagagagcaatctgacctcctgcaagtctcacttacagcaggctggcttcctgggttgcttattgtatataaagggacagtttcctggcaagatgctacagattgtgggtcaaaattctgttttttatatggtctagccttgtccatttgtatcttcagtctctcaagacaataatgtgaatgaagaattttctgttttatacataaaggtggtggtggcagtggatggtggagagttgggtgcacaagtgtttagggagagtttgatcctaacaggtacaatgaaaagaacaaagaataagaaatgattctatgcatgacaagcaactactgaagtggctagggcttcttcatacaggcatagatcaagctccattgctatcagagcaagaacacaatggaaggcttttgatctttattaaaaaataaaattcagagtaagctggtaactcaacattaacaagcaattggataataagtaaagtttagaatggtgtgagcagcaccttaaagatgttgctgggtaaagccaccgtgtcatgagatagccccataaaaacagccatggcaaaagaaaggtgttcaacagaatgtgtgggccctccatttgtcacagagcaaatggcagtccccaattttcagtctaagcctgctcctcaggatacaggcttagaacctctttgacacggcctcagcacttcataccatatttctgtttattgcctgtctgccagcctgcccccagatctgccttggagatctctgactgaatgtcttccctgccagtatgttcagtgcctgcatgcctctctcacagagtaactaaccccaaagtgtgttaaatcagcatacacagcaagtgtgactttctacataaacattctcagacccttaaaacttgctaccaatgacatctctgtttagctaccattgtggcaaatagttaattaatttattctgtcctttaaagaagaattccaagaattatgttttagagtaaattttaattagctgtagaatgacttcctttcctctaataaattattcatgtctggagatatttcaactattgggtataaacttctcggataaacaccactgcctacattggaacaattaactgaattttcaacaaaagtgtctagaatgcctcagcctgtctctaagggtgtgatgtggtgatgtaattccattcaatggaagaaaacattacaagatctgttagcttcatttttccctctagtaaaataggaatagcatagaatggagataatgtagtttggagaaaagaggactgtgtgtgtgtgtgtgtgtgtgtgtgtgtgtgtgtgtgtgtatgttgctgcaccctcactgactaaatgtgctcttgttagatttgtcacgagtcactactgaaaccatctttgcaaaattatgactgacacactgaaagagatctaacttaactgactccatcttgcttctaacctccaagctgtccttattcattcctaggcgtaggctgaactaactttgggagaagtttagtttatagtttaaacaaagatggtaacagctctttcccaaagcagacctccttcttgcctggggactagattgcctttgtaagactaacattagccacaagattagaaattatggtttaggagtcatgtagcttgagtgtacaagattctgaccctccctaaacttctcctgagatcagtgcttgagatattttgcagaccctgcacttgatggatcagctggctccactcagatcaataaactggctcatccaatcttgtggcccccaccctggaactgactgagcacaagaagacagctccgactccctatgatttcatccctgaccaatcagcactcctggctcactggcctccccccactcgccaagttatccttaaaaacgctgcccctcaaatactctgggagactgatttgagtaataataaaactctggtctcccacacagccagctctgcttaaattactctttctctatagcaattcctgtcttgatgaatcggttctgtctaggcagcaggcaaggtgaaccccttgggtggttacactaccatctagtggggctaaaaggagagggtagatatgaagccttctgattctgaacttttgcttttaaatggaagaatacaggaatgaggcttatttgtccagagtcatttcattcactgtcttcatgcataagatcttcagcaaactgaaatcagggcattgagcaagttcaggacctgaagcaagataaagatgattaccaaaatcaataatccagaaatgtgaaaaaccaagttatgtcagtgtctctatcactaataatatatgactagtgctatattacttactagggctgccataacaaataccacaggtgaggagtcttcaacaacagaaatttcttttctcacagttctgcaggccaaagcccaagatcaaggggccagcaagattggtttctcttgaggcctctctccttagcttgcagacagcagccttctccctatatcctcatatggtcatctctgtgtgtgcatatttgttgaatatatctgtgggtccaaatttcccttttttttttttttgagactgagtctcgctctgtcacccagcctggagtgcagtggcatgatcttggcttactgcagcctccgcctcccgggttcaagcaattctcctgccccaggctcctgagtagctgggactacaggctcgcaccaccacacccagctaatgtttgtattttcagtagagacggggtctcaccatgttgactaggctggtctcgaactcctggcctcaagtgatctgcctgcctcgtcctttcaaagtactaggattacaggcatgagccaccgtgcctggccaaatttcttctttttctaaggactccgtcattcatactggggaccttattttaacttaatcacctcttcagaggccctgtctccaaatacagtgacattctcaggtactgttggttagaacttaaacatggggaagtggggcggataggcaacagttcagtccatgacagtgccaactgcagtcaagcaggctcctttatcatgtgcttgagtggaaaacaggactcctgtattgaaactaatctgggattacatcttatttcctaggaaaatattagaaaactggaatttgaaaatcttattttaaatttaatgagaagtttatgtattttgcagaagattattcctaaaaaatgaaacatctgtacaaaatatttagaaagtagatacggtatttttgttctaaagaaaatatttccatttcaaaagtaaaatattcatcatttcaaatttctattttaatagataattaataggagcaaaatgtctaataatggtttttaaagcatgtgattaaaatataatattcttataagtctatcttatatcctattgttacagaaaaaagtgtaaatggattttatagtaatagatataaggaataatttagctaatatagttgaaacaaaagggaatacaagagtgaaatttgcttttcagttacatagggaaaagaattaaatcacatggatatctttgactcctccaagatactgtataataaatatattcatttttggctgaacaggataaatagcattgttggtttgggtgtaattaagctagagaatatcagggaagggtctcagtgatgttcaaccccacgacctttcttcataactggatcatcctaagaataaatacatcccccattgcagaatctagatctgcaacattgatattttgccataaaatactttttgttatttcaagaagatattgcctatactcctcattaatttcttcttgaacaatttactcagccaagaaaaaatttccaaagggtccactggtttataaagttcttaccacatttatctagcttatactaattagtccaggtcacctggaataagtgttgatcctaagtataaggcttttcctctgtcagattcccctcagaacaccttgtcctcactagaggaccatgagccgggactgtcccacctgggccagccttgctaagatctcctccaaatagaacttctgcttttcttctccgccctgttgtgatgctaaaggttattcatgttaacattttgatgccttgtttacatattaactcttccaaatctttcttaacagcgcttcaaatagtgtgattgttaaggctccgggtaaattagtaaaaacaatttcttcttactagagagactgaaatcgttatacacagtgcatccctagtaatagaactacacttcacacagcatttaaaatgtcattcttttcctgggtctcttagattgtatttaacacaacaccctcgatgactcgtttatttaaagacattggtttggggatgaacagtagaaagctgaagggactttcacccagagaaacaaagctgctcagcaataaactctactccctctgaaacagcagattttggacaaaattattccaatgatctgacaaatgcataagaaagttgaatgcctttctaactccctttgctcaagtagtcgctgtcaatacaacaatagcgataaccactgaaggaatgagagctttgtgaagaaattaataatcacccctccatctctacatttttgagaaggtagcttgaatgctaggaaaccacaatgcaattcttcacattaatttgtagatagagatgcaagggtaaaatctgaagtaatttctgtttcctatcattccttagaaccccacaatttctgagaatcctgctatgaaacagacaacaatttttcttactgttttccaaataagtgattacagagaaatttgatttatactatttcagtaaatattgggcacattaattactgtttttgaaatgtcaagacagaaagaaatcatcgactattattctattttgcaataattcaaaaaaagggcaatttcattttttttgcaaattccagagaggcatcaacatatgaagtggaaagagaaagaacaaaataaatccagtcagacaaacgaaaagataaattcaattttaggtaaagccatgcaaactgtggttgtgtcatggaatatttgtttatgtggaactattggagggattaaacctataaggactgggtttcatcagctgtgtttgtgtatagctgagtctgacagcacttaggagaagagagttaaaagccaagttggatcattgagcaatgagtgacagaatgactgcttcccaggatttatgtaccagctcctgcccttaagaggactgtaggctcccactgaggtcaatatgaactatggacatgagaccctgttcaattatgtgcatctctcagctatcatgatatgttcaccatccatcatttataaatccatgatgctaaggtgctactaacaaaggtgctgaataaataataaatggaatacaatagcatattcactgatatactgtttgataacaggcagagctattttatatgtatatacacatacaagttgagtatctcttatctaaaatgcttgggaccaaaagtgtttccatttttgaattttttcagattttgggatatttccataaacataatgagatatcttggggatgggactcaagtctaagcatgaaattcatttctactttatgtacaccttatacacatagcctgaagttaattttatataatatttttaataattttgtgtatgaaataaagttttgactgcaacccaccatattaggtcaggtgtggaattttctactttctaggtgtgtcgatgctcaaaaactcagatgttggagcattttgcattctcgatttttgaatgagagatgctcaacctgtacttacatacacatatctcctcaaacacttctgggttgtggaataagactacagagggaggcccatgtgccatgtctaaacacttaaaagtcaaaaatgaatcttacaaattgctaaatgaaatatattctattgtgtttattctcctactttgataaatataccttcaaaatgtcaaaataaaaaaatatgtgaatatttatcattattgcttatataggtctgaaagtgagtgaaatatcaattgtgactggacttaattattaatgcaggagtcctaagcattgggctatggatcagcagcacctgctaagtaataaaacaaagcatacatccagtcaggtgcaatggcttacatctataatcccagcactttgggagggtgaggtgggtgcatcacttgagtccaggagttcaagaccagcctggccaacgtggcaaaaccctgtccctactaaaaatcgaaaaaaattagccaggcatggtgatgcacacctgtaatcccagcttctcgggaagctggggcacaagaatcgttccaaccctggagacggaggttgcagtgagccaagatcctgccactgcacttcagtctgggtaacagagcaagatcctgtctaaaaaaaaaaaaaaaaaagcatacatcattcacaaattattatctatttattgtaaatatttgtctttatttccaaaaacctctaatatgttgctataatcaatatcttcacacaatttttgtcctaaagatagtaatgttaaattaggaagttttcttgggtgtcgttgtaatttttaaattgttttttactaatttcagtttataaaaacttcacttgactgaggaagtaccaactggaattgtcactgacatttttaaagcaatacttagattcagaactcaagttcatatttgaatattacaatagattacatataataagttgtcataattttataaaatattacaaaatattttaatttcattatataactcaacatcacaaagtacaattttcaccacctctagaggcaatagccaaaatcatatgtaaaaattggcctgcacttctttcctgttatagctacaactgcatatataacaatttaattgtgtaatgaactgtttagtatttcaaagtcttctccagcttctgtgggcaactcttgagatactatgctaactcatgcgcacctcagggaaccacagattgcaacatgaagagaagcaaaaaaacaaaaacaaaaacaaaaacccagacattcactagcttttgggaaataattattatttgagaacctattgtgtccaaaaagatgaattcatttttcttttctcttacctaagtgattccacagcttatataatcactgtacatcaaagaagttcaactctgatgacaaagtatcacaaaactgcaaggcatttggctgtgatctcagacaggagatcccatcgctggtaaccagtgacgtaggttggggaagtgtcctcacttcaagctttcaagtgaagcttgaaaagtgttaaccgtgagtgtgtttgtgaactgtggggctcagctccagcttctctttgcaatgtctagggtgctgtaagagacactgactctacaccatggttctccacccacagtgtatctgtaaattcccaaatgatgctgaggtgggagcactttcagtggctccactctcggcttggcagagggcacttgcattgctccaactgcgatgtgctcttttgctcactttttaaattgccagctgttgtttaggtgaatctgtgatcctctcctctattttgttatacatcagaagtggaaaagggtagcaaattatatagtttagtagagcaaatatagtttcaactcaactgtcatgctttgctggtttgaaagcttcctctgaatcaagagcctttactttccatgtggaccacctcttccaatgctcgtagagtgagccagtatggtgctctggggacagctgttcgcctcagcccgtcagccagggcacacagtcttcatcatgaagtcgtgctcatttcctccagaatggggccatgtcttggagtgttgttcccagaaagacatatctcttagagaccagcagagatgactaggtatgagtgcaatagatgtgaacagctgtgcttttttgcagaataaagccatacatttgctcttctcttaaatgtaaaccaatgatcatgcgaggctgagatgaataagggttgacaaagctttctacattgttctcgaagagatacaccaaatttctaaaggtaacaacatcattaatgatgaccaaataatctccctttggccttgtaatgtgtttgtgtttcattcaaatgcaagctatctgatattaaaagattgcccacttttcaaattaaaatgaagccattttatgaaggtctgtgtcaggagagcacagaaaagcgttccaatatccctgaccaaacgttgtgttgcaagcctgggtaagaatgagccaaattgtttttatgtttgtcagagccattgtttctctttcctttggctcaaaagggagtttgtttgttaggcgcccactgagccatcagatctgcaactgagaatgctgtcaagattcagtaaatgtgcaaatgggaaaacccactaggtaaactaggttaactcaggttgtgctgttacttaaacacaaaagtgtagtagcaaacaccctgctgtcaatcatcttgtaaataactacattattacaagactaggaaaggtgcttctgcagccctctagtcctatgtgcatctatccccctcatctttccatgatgatgagaccatataaataagaagcacagcttaagcctacagtttgcttgactatttctaattgttttcaatgagtggacagataaatatactcactctttactttggcataaccatttataatccttaaggagttaaattcattttaaactaataggatatatggatttttaaaaaatacttgattttagatgtgaaaacataaattattcagagaccatttaatgataatatgaggtatcaatggccttactgaaatcaataagagtttagaaaacaagactaaatgcccattctatacgttaaaatactctaatatatataggtatgaagactgtaaaattttatcctaaaaatccatccacttcctgttaaacaacaaaattaaatcttccaatgaacagttctaggttgttcgaagaagactttattctgtatctgaactaacagttttgttaaaatgtactatacaacgaactacttgttctaccaagttcttttctctgggaagaaagacaggtctttcacagtggttcaggtttcaaatgacaatagacactaatggaaaagtaacatccttatttgcccctagaaaaaaatcagggaacttccttgggttttagtctttccctctgcaggagctgggcattgacttttctgagataatttcaatattaattattcacgtattttaaataaattactagtgatatttcatagcaatactggtgcaccttaaataatgatcctctgacctcaactgagttgggttgccacaattaagtagttcatcaaatagtcacacatatctttaagagaggttggttttgttattctgcaaaattattggttgatcagcaccacacacctcatgtatcttatcctgaaggaattcatgtgcatagggagagggaagaggagggactcaaggtcaaaatgggaaatgggaagtccctacagttaaataagaaaaaatactgatttcagatgaaaaacgtagaaacatgcatgccactcacattgacctatgacctcacagtcaatgtcaagttcatcaacctgtaagaaaggagggaaatacagactgcatggagaaaacttcttgttgtaactcattccacatttgagagtgctggggaaccctgagggaagtatcttttcattgaaatgctttaagtaatttctctcgctgtttatattctggggtcttgacatgttctgtcaaaaaatccccaaatgaaatccttagtatgattttttcccccatataccaggaaagactgcttcacaactttacatccccaaacaccaagcacagctttcagactgtgtattaacaattctgaattgctctttcttggctaaacctgcattattcccaatgaaaattggcaaagtaactgtaggactcacctaacatcttccttggcttatgtgcttcctgctggagctcggtcagtggaagcaacaaagtaaccctgatgtcagctctgtgaagtgattaggcagtcaagtgggtgttccgatgagatgggacagagagattctggtccaaaactcacttgagggaaagaactctagccatagttcttcaatagagcagggtattatcctggttcctttaatgataatacagtcatgtactgcaaaatggcatctcatttgactacggacctcatatacaacagcagtcccatagcttataatggagccaaaaattcctattgccttgtgacatcatggccatcatatggtcacagcacaatgcataattcctgtgtttgtggtgtatcttagtcaattttctgttgctataaaggaatacctgagactgggtgatttatgaagaaaagaggttcatttggctcatgaactgcaggctatataagaagcatgggtgccagcatctgcttctgatgatcatctcagcaagttttaaaccatggtcaaagtggaagaggggagcaggcatcacatggtgctagatggagcaatagatagagaggagagggatgccacactctttgaatcaaccagttctcctgtgaaccaatagagcaagaactcattcattactctgaggatggcaccaagccattcatgagggatctgcccccatgacccagccacctcccacttgtcctacctccaacattggggatcaaattttgacacgagatttggagggaatgaatatccaaactatattgagtgacattggtataaacaaacctactgctctgccagttatacaaaactgtatagtaatggcctaggctttcacattcactcaccactcactcactgactcttccagagcagtttccagtccttcaagttccattcattgtaaaattactattgtcatggtactatgaatgtatgatatataagcataccattttttaatcttttatatcatatttttactctacctttcttatattgagacatattcagatacacaaatacttaccatggtgttacaattccctaaagtattgagttcagtcacatgctgtacaggtgtgtagcctaggagcaataggccataccatatagcctaggtgtgtagtaggctctactatctagttttgcataagtacactctatgatgttcacataatgatgaaattgcctaatgatgcaattctcagaacatatcatcatcgttaagtgatgcatgactgtaataatttattgtgttattatcatatgcctggcatggtgctaagtgctttattttttcatgacagctggatgacttgaagaagtagctatggaatagtggacatagactgagaaggcccaattttaaataccagctccgtcaccagctgctctgtggcccaaggcaattccagacttctctgaaactcaggatcttgtctgtcaactttgtacattaacacttccctcacaagactgtgatgtagatgacaaattccttagtttatgtgaaagtgatttataaactgtaaagtagtagccaaatgtcagcagtgactttgattaaaattatgcagcaaatgagcactcgaatagaaaccaccattctgacagccagggctatttttgtggaggagaatgctactgatctttttctgaagctgaaaaagcattccagaatcttcttcttgagaaataaactccaataaaattataattaacaaaatatttgtttttgcacatccaaatgcacatatatttctctattcagaataaagaaaactgtagtttcatcagatgctctcctggaagcctgtgaataactcacagttattttccttgggtctgatgtgaggccagctcatttcacaatgatgctactgggacattaccaagaaagagcaagtggacaaaggaagcaattgccctttggtaagtttttaaactagataaccaaattgtgattctgtgacgtgatccctccttccttccagctctgccatgactacacattgaaggatggatcacagaagtctaatataattgactcatgggtgcaacatgccttctcttctcctctttggtactatgcctagaaacctatttatcatttgtttttctaataataaagagagacacagaggcttgatttatgacgagatgatggccaaggtgttaggtttctttgtaggtaatatcttcttatttcttatgtgagaaaatacagaaattatatcaataaatttactaggttatataatgtgaactctcattaatatttgtaaatgttattttattaaattttaatgattcattagtttgtttctaaacaacaaatatttattttctcacaatttccatgggcccgaaattcaggagcaacttagttgggtgattctggctcagaatctcccatgagatgggtgaaatcatctggggctgcagtcacctgaaggcttgactggggttggaggatacccttccaagatggcccaactcgtatggctactgacaaaaagcctgggttccatgctggctgttggcaagaggcctcagttgcccaccacatgagcatctccataggtctacttgagtgtccttgtgacatggcagctggctttctccagaacaggtgattgagagagagagagcccaataaggaaaccacaatgccttttatgtcctagtcatgggacatagtgatgtgtcctatgatgtgacacacaccctgagcctgtccctcccaccacattccattcattagaagcaagtcacgagtcccacctacactaaagggaaggggaattagtctccaccttctgagggaggattgccaaagaatatgtagacatatgtttattgcatcagcctcaactccttttcactcacaatctacatctgatccatgagggaggcctgttggttataccctcagaaaaaaacctagaaccctaccctctgccagtaattcaaatgctactcctaagtcactgcaatctctcgctttgctgccccaaacgctcaggctcttttaaatacagcagtcagattgatcctgttaaaaaccagctcagatcatatcacactgctgttcacaacccatctccctcagagtagaagcccaagatcttacaatggtttgtaagggctttactacttgctatgtctttaaacaaatctactttttctcaattctctaatttttttaatgtcagctgattggatctccacacttaagtagtacatcaagtaggcacacatacccattatgtaaagtggggtatgattctacaaaatgatcagttgtcagggacttgaatatcatggaatggatgtgagtagggaggtgcaagaggagggactcaaggtctatgatgggaagtgggaaattcctaaagttaagagatgaatgggaaaaataaatctttatttcaggtgaaaacttagcaacagacagtatagagtgaatgaatgaagaattgaattaatgaaatggtagatatgcatgacagaggagagaaggagggaaggagggaggaaaggaggagggaaagcacagagaataggtggaaacaatttaaaaaatgatatatttagagcaaggcttgctaataccttttaattgaattgaaacaggaagagaactcctcgaagagttttcgcgccccttcttccagtacttccatactgtacacattgcttccacctctctgttaggggtgttcaggatctccaagttgtctgagtttatctggtcttggggatgcatggagatggctttgtctggctcagtcagtctatagccaagttctatgggcccataggggcaactgtttctgaacgtgtttatcaacccctatacccctcccccaaaacagccatccttgatgtcaacctattacacctctcttacctattcacagcagtttgatggtgacattgcctcattcaggacactaagaagcaaatctgagtttattttctaatgcagttgaaagcaggctcacaggaattctacagacatcaatttctcacctactgtgtgtataagtctatctgccgagctgcacagaatcggctgtacctggcttgggaacagcagtcacatttgttgccaagtaaaagaaagaattctcatcaatgttgtcaaagagccccagtgcaaaacaaagagggtctcctccctcaaaatgacaattgtgaaatgagtggctctgaaaatacagagaaaaagaatggagatcttctcagacataatgagatcatctgagaaggtcagaagatggtgagatgggagttgggctgtgaagagaaatgtggagtttatgaaaatgggaagagagaagaggcaacccagagaatgcacttagccttcagggctactgttggacaccgcagggtccgttcttccccttcctcatgtgaatgtcaagaacagacacccttcgaaggcattgtaccaaggggcagcctctttggtctggagtactgggtgggagggctcaatgtctggcttcctaggggatacgggggcatgcatattgttttttgaggagctagcccacagtgaggcagcagtgagcgtccctggagagggagcgccctccagcagcagggctgttggaggtcccagggcaggcagctgtcagccagtgttgttctggaaacagatttacatgcctttctcacagcatgccttcagccaaaagctgctgacagcagggaggctgtgcccttttcctctttttatgggatctcatagcttttaagttcattcctttagtgcacacaccttattgggaaacccttgaatgtgatgggcactcacctcccatcaaatggggaatgtgtctttaaaataccaagaattaaaaatatttagagctagatgttaaaaggtctactttctaatgaaagatacataaagtgatcagctacagatttttgctcaggattgaattaaagccttttttaagtatattaattctagttattccatacctgtaaaatgtgaaaattaggcaaaccagatctggttggttagaagctctctgtttggttttctgtagaccattgaaactatagaagagaaagttatactttgaggttggaaatttaaatgtcaaaatgagttatatcaaataattattgggtggggggggggaaccttcaataatacaggaagaaatttaaattaaaaaaaatacaaaaacaaatcaccaaacactttcaaccaccgacaaatcaaaataaagattagaagtgccaaaagttggagcacaagctatatatttagtaatgtgttactggttgctggagaatttgaaaaaagcaacctcatatgggagctattacactcaagatcatatttagaaaatcaatttaaatctaagcacatttgcatattagaggcttcacatgtgtctattaacactatgactgacatgctatgctggtgagcgtacccattaggaatcccaatatccaagatgtttcagcttctcctaagaggccttaggatcccagccagggaacccagagcaaaacagaatcttgaacctaatgagagatggaatcttggaaatgagtgctgcattgcaccattgtgccatcagaccctgctgtcctgacaaagccggcagcacatcactccagaggctttctttgcagatttgcaggtaactcaccctttgtggggaggggatcagcctctcagccctccttttccttcctgtcttcgccatccccgttctccctaaggggcttacacaaaatgccattcctttggggctttgctctggggaactaggtgtgctgttgaagataagtatgttgtttgctaacaatctgcaagcaaaaattttaaaaagaaggtttccttgagtgctgcctaccctagttagcaggaataaaggaactctgactattagaacctgacagaatttactttgcacaagacatatccccatcttcctttcctcctctaaatctaatatggcaagcttgtccaacccatggcctgacacaaatttgtaaactgtcttaaaacattattttttgtgtgatttttttgtttttgttagctcatcagctatcattagtgttagtgtattttatatgtggcccaagacaattcttcttccaatgtggcccagggaagccaaaagattggatacccctagagtatggggaagcgtatcagttttcagaggcaatgtgtctccaccaaggggacattcagtattcagtcacatacaaagattgcaattcggctttcaagggcttggggaaagagctctgttgtttgtgaagattacaatgcctagtgacttaattttaggctttgctgttttgcagtaattttaaaaagttgctaaagatgttgccagaaaagtaaggggtgtaaaattcatttaattcacttaagaactttatgcttaaaattttttaaacagtagcttctacaatggctcctgaaagtactttctggaatgaaaccagatattttaattcacttgtaaatgtaatttcaggttcatcctactagtatgccagataataatgaatcttatacttggagaatatttaagctcagtacagagcaaagtgtttttaaagcaaatattcattgctttctccaactgccatatttatctattgtatttttaatactttttttaatttggagaaaattagagatcggcatgcatttgtaagaaataatacagagagatcattgtatgctttacccagtttccccaaaggtaacatcttgcaaaacttgaggacaataatccaacacaagggtccctcatgttattccttgatagccacactcaattccctccattcttacccccagtttgaaccatggcaataacaaatctgttctctttgcaagaatgttgtatcaatggaatcatgtagcacataaccttttggaattggctgtttttatttttttcattgagcatggttatctggacatcccaccaggacgttgcatggatcggcagtttgctctattattgccaagtagtgcaccatggtatagatgtacccatcagttttttgtcatttacctgttcaaagacacaagggtagtttccagttttttactattatgaataaagctgtcataaacatttatgtatattagtatgaacataaatttttatttctctgggacaccttcctaagagtgctatggctaggttaaatggaagttgcaggtttagttttataggaaattgccaggccagttgaggtggctcacgcctgcaatccccagcactttgggagaccaaggagggtggatcacttgaggtcaggagtttgagaccaggctgcccaatgtggtgaaactccatctctacaaaatacaaaaattagctggtcgtggtggtgggttcctgtaatcctagctacttgggaggctgaggcagtagaactgcttgaacccaggaggcagaggttgcagtgagccgagatagtgccattgccttccagcctgggaggcagagtgagattctgtctcaaaaaaaaaaaaagaaaagaaagaaagaaggaaggaaggaaggaaggaaggaaggagagagaaaggaagaaagaaagagaaagaaagaaagaaagaaagaaagaaagaaagaaagaaagaaagaaagaaagaaaggaaggaaggaaaagaaaagaaaagaaagagaaagaaagaaagaaagagaaagaaagaaagaaagagagagaaagagaaagaaagaaagaaagaaaaagaaagaaagaaagagagaaagaaagagaaagagagggagggggagagagagagagaaagaaaggaaagaaagaaaggaaggaaggaaggaagagaaagaaagaaggaaagaaagaaagaaagaaagaaagaaagaaagaaagaaagaaagaaagaaagaaactgccaaattattgtccagaatagctgtgccattttttattcccgcttataatgtatgactggttaaattttttgcatcctcactggtatttggcattgtcattgttttttaattttagtcattttggtaagtgtttagtgatacctcattgtggttttaattcattttcctagtgaccaataatattgaatttttgtgtgtgatgttaattctttaatttaatttttttttttttttttgagatggagtctcaccctgtcacccgggctagagtgcagtggtgcgatcttggctcactgcaacctctgcttcccgggttcaattgattctcttgcctcagcctccggagtagctgggactataggcgccagccaccacgactggctaatttttgtatttttagtaggaatggggtttcaccatgctgcccaagctggtctcgaactcctgagctcaagtgatttgcccagcttggcctcccaaagtgctgggattacaggcacgagccactttattttattttattttaagttctgggatacatgtgcaggatatgcaggtttgttacataggtaaatgtgttccatggtggtttgttgcacctatcgacctgtcacctaggtattaagcccaacatgcattagctatttttcccagtgctctccctccccctgcaccacccccaacaggccccagtgtgtggtgttcccctccctgtatccatgaatattgaacattttaaaaatgtacttatttgtcatctgtatatcctccttggtgaaaattctcttcatgtttttgcccaagtactaatggtaatgtctattttatttttttaccattgagtaagaaaatttatatattctagatactattcctttgtaaaatatgtggttttaaatattttttcccagactgtgggaaaaacagactttgtctctttaatggggtcttttgcagagcaaaagtttttaatttttatgtcacctaatttgttaatatcctttatgaattatgcttttggtgtcaaatctaagaactttgctctagatctcaaagattttctcccatttttttcctaaaagtttaatcatttcatgttttactgggatccattgtaaattaacttgtatataaaatgtgagatttaggttaaggttcctgcttttgcctataggtgtctgattgttccaagcactatttattgaaaatgctatttttcctctgttggatttcttttatatctttgtcaaaaatcagttggtgatatatgtgtaggtccatttctagattccatattcttttccattatctctgtgtctactcttggccgataccacccagtcttgattactatagatgtataataagtcttgaaattgtgtggactgattcttctcatgttattcttcatcgaaactgttttggctattctagttcctttgcctgtccttataaattttagaacaatcttgtctatgtctacaaacaatcttgctggaacttttacagaaattttgttaaaactgtatgtcaatctggaaataactgccatctttactatgctgactctcccaatccaccaatgtggtatatctttcagtttatttagatctttgatttctttcaccagcatcttgtagttttcagcatatagttttgtacattgtattaggtttacacataactatttcattgatttgagtgactgtaagaggtaataatgttagtctcagctccctggtgttcattacatgtatgtagaaatacaactgagttttttatgttatcatacatcttgcaattttgctgaattggcttactagttctaggagggttgttgttatttgtagattctttgggattttctatgtagacaatcatgtcatctgcaaatagggacaaagttttttgtagatactccttatcaagctgaggaagtacttctttattcttacttttctgaggtattttttaaaatcataaatgaatgtagaattttgtcaaatgctttttatgaataatttgatatgatcatgtgattcttccttcatggcctattaaggtggattacattgattttcaaatattgaaacaaacttgcatctctgacataaaccccatttgttatggtatataatttttatatgtattgcttaattctatttgtgaatattttgttaaagattctttagtctatattcatgagggatgttggcctatagtttttccttttgtgctgtgtctgtctagttttgacattagggtaatactagctttataaaatgaactgggaagggttctcttctatattttggaagagtgtatagagtttatgttaattattcaaaccaagccaataaaaccatttagacctggagatttttgcggggagagtctttaaattatgaattcaatttttcttaaagttataggggtattcaagttatctatttcatatgggtgagttatagtggtttgtgtttttttaagtagtttgtttcatcttagttgtcagatttatatgtacagaattgttcataccattctcttttatggatttgatgtctgtggggtctgtagtcatgtcacctgtttcattctggatactggtaatgtgtgttctctctttttttacccaaacttgataaagattggccaattttattaatcttttcaaaaaacaagcaattggttgctctattttactgttttttaatttcattgatttctgctctaatctttattatttccttccttctacttgctttgaattcatttacctctttctttctaggttctagaggtaggggcatgaattgttaatttgagactcttcttttctaatgtgagtgtttagttctactaattttcctctcagtactgtgttaactatgtgtcataaatttggaaatattgtattttcattttcattcagttttgtatatattttttaatttcttttgaaacttcctctttggtccatgggttacttagcagtgtgttgtttggtgtccatgtgtttggaggtttccctgtctttctgttatagggttctagctgattctattacattcagaggacatactcattagtgttgccaactgccattttttccattgtattttaaaatccatatagtttggccaggtgcggtggctcacacctctaatcccagcattgtaggaagccgaggcaggcagatcacctgaggtcaggagtttgagaccagcctgctcaacatggtgaaacaccatctctactaaaaatacaaaaattagctgggagtgatggtgggtgcctgtaattccagctacttgggaggctgaggcaggagaatcacttgaacccaagaggcaaaggttgcagtgagccgagattgcagctccagcctgggtgacaagagtgaaactccatctcaaaaaataaaataaagtaaaataaaatccatatagtttaatataagctcttttataagaagaaggaacaagtgcgaaattataaatgttcagttgtaatcatttaaaaaatatttcttataaaattagtgtaagaagttcttttttgaacatgattagctacattatggggaaataattctaaatgacatcacatacattttatcatttatatctgcttaagttttgagaaacactttatatattattaaaataaatgctttttatgatttgattttagtaaaatcatgatgtaattttagtaaaattgcagatattctatcaggaagaaactgtaaaagctttacccatttttaaggaaaatattctattctaagccattttcctaaagaaaatgtttatacgctaattttgtttctttgcatagatgggtacttataggattcaaagataaatttgagcttacaatattgatttgactcattctgtcataattaatttgatatagtgaatctagactcatagttaggaaataaaatacttagaaaaaataaccatccagtcttgatttatttatatctgcatttaagctgtttattccagttaccatcaaagtaacttttcaaataggtcattaacatctacgttttgatatcttgaaacattaacccattgaaatacttcacgcccaagacactggaaaacgggaatataaacatttggatccactggaatattttcaaagccttctatcaacttaccttgctacatcttcaactttgtttcttattatccaccattatgattttacaattctgataattgtctcctacctcacgatttgttcatttctgttagtttgcttctcattcttagaattccctcccaagccctctctatcatcctcataaagacttaatttaaattttatcttctctaagaagctcttgaacagggacaggtattctttacaaggccacttgattgggtaaatatacaccaactactcccatcttgatcaagtgtgttttccttcatgacattatcacttctcaaggtatccgtgttcctaccaccttttcagcacacacgctaatctcctccaccttacctcagtagtgatggtgtcttccctgggctaaagggatgtagtcgaggtgggagacactgagaaaagccttggtgcacaggttatcatatctccaactggaacgttaatagacaacatctcgtgattggcaatcctcaatggatggcatcaagaggggcaattaactgctgactctttgttcacacaacatcctgatatgctttattcttgcttccttactccctcactgtctccagacctgttccatctttttatccagtatcttaagatttggcaaatttatttgtctaatattcctttagcatacttctatcagttagacacctgctttggttacttaataggtgagtgtttgcagcctttgtttctggctgtgcaatcgatgactcaagtctgtcttaataccatgggggaaagacgaagacctcaggatatgagtagggaaattcatgcaaaacctgttgaaaatattacccaatgaatccagtgtccctttgcacattaagttgtcaatacaaaagtattgaactcatatatttctctcattttctttctccttattgttctttctccatgccaaatcaacaagaccagttgagataattcatgataaaaataatctacaaaaatacgcattttattatcattattcacatattaatactgctaacactcagtgtaagacacgaggctagctgtaaagggaaggaatcgagaggtgattctgccacgagttctcttcctccattgctttcaagctccacataggagggaagaggagatgaaaataaatttctgtgacagaaggtagtaatgaatgacatgagaaagacggaaaagtattatgagaaggcacagaaaaaggggatcatttccagctgaggacatcagagaatatttcttctaggagatagattctgatgcttgtactttagtattattaataagactgagacatttagagatagggaagaggtattccacagtgaagaaagattgaattgttcttttgatacatagtaactgggcacttactatgtgctggtagcagggacaaagaaataacaacaatatgttaaatgattattgcatgaaactgtaaataattcaatttagctagaacaatggtttgaacaaaggcatggtgggaaatatggaataaaagttgtatgtgtgtaaaataagattattgagataagaataaggcacttactgatctgaccctttgcagggtgtgtttccttggcacttactgaatttcaagcttctttttggctaggactgtgtctcctaagcgtatttttcaaaaaggataataaaattgctcaatagagcataaatactaattatctgtctactcttgacgagcttataaatggggggtagatttactgaccacatgtattcactttatgtttgagtgttttagttaatgttttattccatttttattattttgtactccacaaatctattaatactgattgaatagcataaaatgaagatagtatttcatagactaacagttcacctgttgtagcagagaaattcaaaataatgatgacatagataaacagaagtttatttttctcatgcagaagttgggatcaatggtctaaagctggtatggggctgggctgtcctcaggggtccaggttccttacattttgttgctctaacatcctggtcacacctccaccatgtgatgttgaaggtgactgctctgtccaacagcaacataccaggaatccagcatgaggggaaggagggagaggtgggggcatattctttccttttaaggaaatgctgttgcacgtatcacttccattttcattccctggtttagaagttagtcacacagccaccctcagctactgctagtgaggctgcaaaatggagtctttgactgaacgtccatatggccagctaaaatgtggcatcccactattaaaagaaaagggtagactggagattgggcaggagctaatggtttccttcataattacctgttaagattctgaacaagtaatttaattaattaccttttcaaaagccttttgcacctttttccatcctccaatttgccaatactattttttttcttatggagaaaacaaatacagataccacacagaaaccaagctttgcaatccaattccagtgcaaatttagagaattaatgaacaacaaggaaccaattatgcataagtaaaaaggtcatagttgagctcctgttgagattagaagaaggaagtaacagttttagatggaaagaaactgcccaagactatgcaggaccagaggagaccctaagattggagaagtcaagcaggactgctgagataaagttggcaattttcatactcaccacaactgttgttttgtaccaaaacatgtatgtgtttatgaatgtaggtagatgttcaaaagaaataacaaaattgtatattatacaagaaagaataagggccatcagttaatacatttgggttcttatttctatttttaatatttagttgtgtgaccctgaacaaaatgcttaacgattgagggtctctatttcttcatccataaaatagagatgttgacttagatttataagcaatagaaaacacatttcaaaagcctattctgtgctagactacattccagacatgtaagtaaatgcttcaaggagctcacagtgtcttgggctggaggattggtgtctactcataaacagacaattccaacatgctgatcaacacagcatcaggaaatgatacccaagagcttggggagcacatttaaaagaggcttcagactagaaacgtgagatttgatgaatgagtaatactggattaaaatttcattagctcaaggtccaatacgaggttaaatttggcgatcaaattagaaagtgcataaaatgttcagttaaggcaagatgggttagaatggagctgtttctgcataaaatatttgttaaaaatcaatatataccaggtactcaatggaggttgaaacaggcaagattcctgcctttgaaaacctacaacatataatctagaatttaggatttttgagatttggcacagggtggcatataatctggccatgacctactgagataaaaaagctcatccttacaggggaaaggttacagtttctgctttattgggaaagttatacaaataaagaaaagagactgggaatgttgtcataactttttaacacataagtttttaaaaaatatttctctaatgaagacatatgactacttaggtacatagataatcaagtagttcaagatacgcccaaagggggctctctctaaaggtactttactcccagatcctatcaactgaagctttggggaagatggacctattggctttcttttctttatatattcattgttaaagcacctaaaatttatttgcaatcttattaaccaacttacacatatttactatagtaaattagaagaaaacaagcaataagaacaaggaaaatgaaatcatgtaaagttccatcagcaatttcatcatccaattataatattactttgtatatactcagaatttttctaaacattgcatatgattagttacatttacagtcgatttttctggcctttacccagcaagtttttaaataaaatattttatactggaagaatttctacaacaccttttaattttagctcttacgtaccaaaaataatgatgacagaatctctcacatttgctcaacagttacaaaactggaaatcaaagaatcctagaacttcctttttaactttcttttgtaaaataatgtaaaaacttacagaaaaattccaggaataacacacagatcacctataacctttactcaaaattcagcaaattgaatacattgcctgtgttagtccgtttgcattgctataaaggaatatctgagactggataattataaagaaaagaattttatctggcttacagctctgcaggctctacaagcatggcaccagcattacttctgatgaggacctcaggaagcttccagtcatggcagaaggcaaaaaggaggcggcatatcacatggagaaagaaggagcaagagaaggagaggagggggaggtcctagatctcctgtgaactcattactggagggagggcagcaagccattaatgtgggatcggcccccatgattcagcacttcccaccaggccccatctccaacattagggatcacatttcaacatgatatttggaggggacaaacgtccaacctatatcattgccacatttgctctaccattttctcttctgtctgtccctctgtgtgcatgcacacacatgtatatgtatgtacatatataaacatatatatgtcatgcaaatataaacacatatatgtgtgtaaaattttttctgagctattcgagaataggttgaatacaccatgcccatttaccctttaataattcagtgtgtatttctaaggaacaaggttattctctattggaacagtcgtgtagttatcaaactcagggcattcgcactgacacaagacctttatctgatttacagtccacattctatgttgtcaattgtctggcccttccttacaacatcttttgcctttcaaacagggtccagcccaggaccatgtgttgcatttcatcttcatgtctctttcgttttcgtcagtctggaataggtttatttctctttcattacattgacattttggagaacaccagccagtcgttttatagagtgactctcaagatggatttgtctggccctgctaattttaataagtaggtgataataagcaccctccaggacaaagtggagatatttctggcagcctgaggagcacaaggctgagagaacaagagggagcttgtcacagatgaggaaatgaacaaggctccgtgtgacctcctcaccacttgtggaattgaagggctgagggagaagccaacagtgagaccaggcaggccagccagggtcaggtgctgaagggtttagaccgtgaacttgattctgaaagcattggggatcactggggaatttcagtcaaggacataataatgtttgtttctgagaaagacaatgtcttaaagataatttagtgacgatctgagagcacagcagagtgagtaagaattctgttaaaattattgtgatgtggactgcaggaagacttggggtgaaaagatgcaacatattgggataaatgttgtagaaaatagaacgacttggtgacttggtatacagagtgaagaacaggaagggccagggtgacagctggaattctgttgtgtgcgctgaatgtcaggtgcctgatcctctaaggctggaggtgggatatagggaaagcagctctgagtcagaagaggctgaacactgttttggacatggtacattcgaggtctctgtgggacatccaagggttgctgtgttccaggacctgaggagggagatttgtaccggagatacagatttagatgtcaccaactcacactcactgaaaccatgggctggaggagctccccaggagagggaggccttctgggaggggagggagcatgactaaggacacaagactgtctggaggtgtcaaagcccccgctgtaggtggagaaccacgaattcatggataccaagagctgataggacaactcttccagcagcacattattgttcaggcatgtgaaaggtgaagcaggtggttcagtcgaaccaggggtgcaggaaaggcattgacattattgataagggagtcgctgaaatgatggatgacagactctatgctgtgtgttgaaggagggaaagatagatgagcctgaaagatgagtgttgggacctggaagtctccatgggttaaatgacagatgcaggagctgaatctgagtgaaaatgaaggcattataaacagcaggtggaaatcagaaatgggaatgtttgcggcttcagaatttcttaagtttatttctgggtgatgactagttcagggacaggtgacagacaggagctgaggtggagtgaaggtgggagtcctcgagggcaaggagatagagtgggcaggcatctaagcctcagatgcattgtcctcatgggcatgaaagcatctggatggagatgggtcgtggaatagaaagtgagtctatgggcactgaggctgcagtggaggatggaaatgagggtagacagagggcttacacaagggggaggagcaagcatgcggaaatagccctaaagggagagagtctgctggccaccttcagggcagctttactaaatgtgggggaataaggtgcttccatcgtggggatgcaagacaagagtcaggcaggatgatcgccccaacaaaggtgaagccatcattggagaagaacatctggagaactgggttttcagaaggcagcttttggtctggaaaggaaggaacaatgaaggctctacactataaggctaagagtaaaggaggattatattttaatttaagaataatagtgatgaaatgaggtccaaactggtgtttctcactgttctcatcagacactttatttttttatttattttttattattatgatactttaagttttagggtacatgtgcacaatgtgcaggtttgttacatatgtatacatgtaccatgctggtgtgctgcacccattaactggtcatttagcattaggtgtatctcctaatgctatccctcccccctccccccaccccacaacagaccccggagtgtgatgttccccttcctgtgtccatgtgttctcattgttcaattcccacccaggagtgagaacatgcggtgtttggttttttgtccttgggatagtttgctgagaatgatggtttccagcttcatccatgtccctacaaaggacatgaactcttcattttttatggctgcatagtattccctggtgtatatgtgccacattttcttaatccagtatatcgttgttggacatttgggttggttccaagtctttgctattgtgaatagtgccgcaataaacatacatgtgcatgtgtctttatagcagcatgatttataatcctttgggtatatacccagtaatgagatggctgggtcaaatggtatttctagttcaagatccctgaggaatcgccacactgacttccacaatggtggaactagtttacagtcccagcagcagtgtaaaagtgttcctatttctccacatcctctccagcacctgttgtttcctgactttttaatgatcaccattctaactggtgtgagatggtatctcattgtggttttgatttgcatttctctgatggccagtgatgatgaacattttttcatgtgtcttttggctgcataaatgtcttcttttgagaagtgtctgttcatatcctttgcccactttttgatggggttgtttgtttttttcttgtaaattgtttgagttcatcgtagattctggatattagccctttgtcagataagcagtttgcaaaaattttctcccattttgtaggttgcctgttcactctgatggtagtttcttttgctgtgcagaagatctttagtttaattagatcccatttgtcaattatggcttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtataaggtgtaaggaagggatccagtttcagctttctacatatggccagccagttttcccagcaccatttattaaatagggaatcctttccccatttcttgtttttgtcaggtttgtcaaagatcagatggttgtagatatgtggcattatttctgagggctctgttctgttccattgatctatatctctgttttggtaccagtaccatgctgttttggttactgtagccttgtagtatagtttgaagtcaggtagcatgatgcctccagctttgttcttttggcttaggattgacttgacaatgtgggctcttttttgattccatatgaactttcaagtagttttttccaattctgtgaagaaagtcattggtagcttgatggggatggcattgaatctataaattaccttgggcagtatggccattttcatgatattgattcttcctacccatgagcatggaatgttcttccatttgtttgtatcctcttttatttccttgagcagtggtttgtagttgtccttgaagaggtccttcacatcccttgtaagttggattcctaggtattttattctctttgaagcaattgtgaatgggagttcactcatgatttggctctctgtttgtctgttagtggtgtataagaatgcttgtgatttttgtacaatgattttgtatcctgagactttgctgaagttgcttatcagcttaaggagattttgggctgagatgatgggattttctaaatatacaatcatgccatctgcaaacagggacaatttgacttcctcttttcctaattgaataccctttatttccttctcctgcctgattgccctggccagcacttccaacactatgttgaataggagtggtgagagaaggcatccatgtcttgtgcccgttttcaaagggaatgcttccagtttttgcccattcagtatgatattggctgtgggtttgtcatagatagatcttattattttgagataggtcccatgaatacctaatttattgagagtttttagcatgaagcgttgttgaattttgtcaaaggacttttctgcatctattgatataatcctgtggtttttgtctttggttctgtttttatgctggattacatttattgatttgtgtatgttgaaacaggcttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgccaggctttggtatcaggatgatgctggcctcataaaatgagttaaggaggattccctctttttctattgattggaatagtttcagaaggaatggtaccagctcctcgttgtacctctggtagaatttggctatgaatccatctggtcctggactttttttggttggtaagctattgattattgccacaatttcagagcctgttattggtctattcagagattcaacttcttcctggtttagtcttgggagggtgtatgtgtcgaggaatttatccatttcttctagattttctagtttatttgcgtagacgtgtttgtagtattctctgatggtagtttgtatttctgtgggatcggtggtgatatcccctttatcattttttattgcatctatttgattcttctctcttttcttctttcttagtcttgctagtggtctatcaattttgttgatcttttcaaaaaaccagctcctggattcattgattttttgaagggttttttgtgtctctatttccttcagttcttctctgatcttagttatttcttgccttctgctagcttttgaatgtgtttgcttcttgcttttctagttcttttaattgtgacgttagggtgtcgattttggatctttcctgctttctcttgtgggcatttagtgctataaatttccctctacacactgctttgaatgtgtcccagagattctggtatgttgtgtctttgttctcattggtttcaaagaacatcgttatttctgccttcatttcgttatgtacccagtagtcattcaggagcaggtttcagtttccatgtagttgagcggttttgagtgagtttcttaatcctgagttctagtttgattgcgctgtggtctgagagacagtttgttataatttgtgttcttttacatttgctgaggagtgctttacttccaactatgtggtcaattttggaataggtgtggtgtggtgctgagaagaatgtatattctgttgatttggggtggagagttctgtagatgtcttttaggtccacttggtgcagagctgagttcaattcctgggtatccttgttaattttctgtttagtagatctgtctaatgttgacagtggggtgttaaagtctcccattattattgtgtgggagtctaagtctctttgtaggtcactaaggacttgctttatgaatcttggtgcttctgtattgggtgcatatatatttaggatagatagctcttcttgttgaattgatcctttaccattatgtaatggccttctttgtctcttttgatctttgttggtttaaggtctgttttatcagagactaggattgcaacccctgcctttttttgttttctatttgcttggtagctcttcctccatccctttattttgagcctatgtgcagacactttattaccagaggcagaaatgataagcttcatcataacagaaaagagataataacaataagattattaaacacttgaagaaaataactgaattcaaaaatacttatttatattaatgtaagactatgaaacagattacaatcagaaatgatgggagagagaggcacccagattgggctcagccagtggcgatgggactacaggggaaaggtctagaacccactgttctgtatagcagccactggccttacatagctatacaaacttacattttaattaatgatcattaaaattcaattccttgcaacactacatgccaaagattcaatagccacaggtggatgtggctactatattgggcaggtccaataccagacatctctgtcattacagaaagtgctgatggcgttgtgccagcaggggaatctcatatgtggcagggtgggccccagttctcctggagtgagtattcctggacacctgattgctctagggacccagagaaaggagggggtcaccggaaggctacagagagacttctcatctcttactcccaaattagcctaaaaaggtcaagcttttctgcttgttagagtgaagcaaatactggactggaaggcagaagattcagtcaagttcatacgtgccttgagtatgtcacttagcatgtctgatttttagactttatctatgtaaattgggcataataatattaatacttcacaatggcaatgaggattaaatttgacatattttataaaattactgattagcttaacaaacacagcactgtataaatattaggactgatgctggtgatgttggggaaattagcctaatgaggttctagcagttctcattcccaacccaccaagctcaatgcccttccaatcactgaaggaaaaatatatgacttgtatattgatccatgaaatgatcttaccattgcccctcaataaaaataaaactctttcctacccccaattagatatcaaaagctttaaattcttaattttaatggtagatgtaccatgtaagtaaaagttagtttcagtgtattcaaccaagaaatgtaggtaaattgtttagttttctctcttctgattaagagaaactaacaaaaggggctgaagggatcaggtgaaagataagatttagatgatgcttggagaaggcaaattttacaaaccacaattttgtttaaagtggggtgtatttacctgctcctaaacagagatgaaaaaaactgtgcatttttgtccaaaagctgtgcatgtgggccgataaactgaacatggtttataaacattgaaatgggtggtaggctgttttcatttaaggaaatgcttattgaagcttcattgtactttgctatttagcatctcctgcaggtagctatccagctttcaagtacagagacacagcaaaaaaggtcaatgtaactaagactaagaaaagcagctcctaaaacagtacaaaaagggtccatatggaatcatgacatggtgatttgtccattttcatgctgctgataaagtatacctgagactggacaatgtacgaaagaaagagatttaattagacttacagttccatgtggctggggaagcctcactatcatggcggaaggcaaggaggaacaagtcacatcacatggatggcagcaggaaataaagagcttgtgcaagaaaactcccacttatagtagccatcagatctcatgagatttactcactatcatgagaacaacataaagacctgcccccattattcagttacctcccaccaggtccctcacacagcacgtgggaattcaagatgagatttgggtggggacgcagcctgaccttatcacatggtataaaaggtaatggattcatataagtgctcaactgatttttggcaaaggtacaaaggcaattcaatgacagaaagatagccttggagatggagcaattggtggtaagatggatttccatatgcaaaatccaaattctcttgaattactatttaaggtgtgagagcaattggacatccatatgcagaaaaaaaaaaaaagagcctcaacctaagcctcacacctatacacaaattagatcaatacagatcacagacttaaatgtacattttaaacctatacacttttagaaaaaaaaataggagaaaatatttgagacctaggactaggcaatgagttcttagatttgacaccaaaagcatgattcagaaaaggaaaattgataaattggactacatcaaaattaaaaacatttgctctgtggaagactctgctaaggggatgaaaagacatgctgcggactgcgagaaaatatttgcagaccagatacccaacaaaggactagttcctagaagttacaaagaactcccaaactcaacagtcaaaaaacaaacaacctaagtacaaattgggcaaaagacaagaagaaacattttactaaacagcatatacaggaggggtgcagtggctcacacctgtaataatctcccaatactttgggaggccaaggagtgaggatcacttgagcccaggagttcaagaccagcctgagcaatatagggagacactatctttacaaacaataattttaaaaattagccagacatggtggcacatgtctggtcccagctacttgggaggctgaggtggaaggatcgcttgagcctgggaggttgaggctgtagtgagctgtgattgtaccactgcattccagcctgggtgacaatgaggccttgtctccaaaagaaaaaagagaatctatagatgggtagtaagctcatgaaaaaatgtgcaacatcttcagaaattaggggagtacaaattaaaaccaaagtgagatatcaacatacacctatcaaaatggctaaaattaagaacagtgacagcagcagttgctggcaaggatgtgaagaatccagatcacttatacattgctggtgggaatggagaatggtagagccactctagcaaacagcttggtagtttgttataaaactaaactaaatacagttatcatatgtattagtccattctcacactgctataaagatactaccagagggccaggcatggtatctcatgcctgtaatcccagcactttgggaggctgaggcgggcagatcacgaggtcaggagttcaaggccagcctggccaacatggtgaaaccccgtctctactaaaaatacaaaaattagctgggcatggtggcatgtgcctgtagtcccagttactcgggaggctgaggcaggagaattgcttgaacccgggaggcataggttgcagtgagccgagatcgtgccattgtgatccagcctgggcaacgcagcaagactccatctcaaaaaacaaaaatgaaaataaataaataaagatactaccagagactgggtaatttataaaggaaagaggtttaattgactcacagttctgcctggctggggaggcctaaggaaacttacaatcatggtggaaggcaaaacagtcacctttttcacaaggcagcaggagagagagtgtgtgtgaaggaggaactgtcaaaaacttataaaaccatcagatgtcatgagaactcactatcacaagaacagcatgggggaaactgcccccaggatccaatcacctcccaccaggtccctcccttgacacgtggatattatggggattacaatttgctatgagatttgggtggggacacagagacaaaccatatcaccatacaatctaacaatctgaatcttgagtatttatatcagaaaaatgaaaatttgtgttcatataaaatcctgtacctgaatgttcatagtggctttatttgaaataatccagaaactggaatcagcccagacatccttcaacaggtgaataatgcccctctcaaagatgtccacatcatgatccctggaacgtgtgaatatgctatagtatatggcaatggcaaattaaagttgcatggaattaagattgcttatcagctgtcctggaaatggagagattctcctggattttctgagtggtaccagtggaagctgaagagaggaggttggaatgttgcaagttcagaaaaggcctaccctgtttttgctggttttaaagagggaggaagaggccataagccaaggaatgcagcagcctctggaagctggaaagggcaagggaatggattcctccctagagcctccaggaagaaacacagccctgccaactccttcattttcacccagtgacaccaacacaaaaagttgtaagtcacttagtgtgtggaaattcattacagcagcaatcaaaaactaatacacataccatggcacactacttagcaatagaaaaagcaccaacactcacaacagattggatgaatctccagagaattatactgggtgaaaaaacccagccctgaaagattacatactatttgattccacttaaatctcatatttaatatgacaacatttcagaaatggaggaaagatttaggggttgcaaagagtttagaatgggaatggaagagaaagtgtgagagggaatagatgtcattataaaagggcaatatggtatttgtagtaatggaacttttcagtatcttgactatagtggtgtatacgtgaacataaatgtgtgataaaattgtatagaatttaatacacacaagcacacaaataagtacaagtgaaatgagagaaatataagtaagattggtggagtgttatcatgtcaatactctagttgagatattatattatagttttgcaaaatgttaccattagggaaaataaggcaaagtgtacaagagatctctgtatcacttcttgcagctgcatgtgaatcaacaattatctcagtacaatttttaataaagaatattgtaggaaattgttatcttgctgcttattatagccacgactatggattgccttagttaaaacctagaatgtagggacaaagctatctaattcgcttggtacactagctcccttgccatcatttgctgctaatcatttagaggcttttcattaatgatgatgatatgtctgaatgtgccttatagcagagaatgttaacctatttatgaggatccttaattcagggggtccttcattcatctggaaactctagtcaatatttgtgtgtgcatgtgtgtctgtgtgtgtgtgtgcatgtttttgaagaaaacatgtataactttctaaagggctccattaccccctctaaaaaaagaagaaaaagaaaaacaccaagagccaaactccttagaaacacactaagtgtgaacttaaaaatatatttctttggagtgatttaaaataatgctatgcacaactgcgtcaatatttttaaatcggagaaaatatgcatggtctttggtagaatgggctccggggtcagacttccaagtgcgtgaccttcagcaaagtccttatcctttctaagccccagttttctcatctataaaatgggaaaaataatacttcctattttatagaacattgtgagtttcaaatgaaacaatgtatatgtcatttagcatagcacctgacacgtgataagcactccataaatattagcttatttctgtttactattgtgtttaaaatgggaagatctaaagattcaaattattcttttcaaagtatcttttcaatataatggaataaatggcatataattttgtagaaggggcactggtgttagtagacttattctgccattggttccctgagtaagtttggacaagtcacactctctctgagcctccaccataacataagagggctaaaagtttgggtgtaaaaagacgcttgaattaactcaacagacatttatgggagttctttatatggttttcaggttgagttcctcagaagccgaccctgagtgggagattcgtgagaaaaggtttattccggaatgctcaggaaaaacttggaggaataaagaagtgggacaggaaggggaagaaaggaaagcaaagacccacagagggtgttatagggtcaatccttcagaaagctctagagagaccactaagtcaccctcagcatcatctccacctgggaactagggtgcttatatccccactgcagctggttattatttaagggcagtccacactcgcatgaattcccaggcactacctgctccatgtgtgagccagctgagcaaattccagctgcctgagggcagccttctggcaaagatttgcaacagttggcattttgggagtgaaagcccacagggagctcatgtgcctcgaattggtaaagggacccaagggaaaaccagcagagcaatgacagcatatgcaagctctcagagccttcctctgccttcatggatgacactcacagtgtcatggggaaacacatgagcagccacacaattgctaaagaactcccaggagagggcctcagttcagcctggagtgtcagagaggggctcagagggcccccaggagcaaatgaagacagagaaataattagtcaagcaaaatagggaagtggtgagagggtccagccagctgaagagagcatgatactcaaggaattaaaataagcccagtgtaaccagatcaaaggagcggggcagctggagatgtggctagaaggtgaggggaacccagatcatgcagtgaatcaggtgagttaatttgtaggctcttagggtctaacacagtttgttacagacaagtatcatagctaagaaaagggtacaaatttcttaatatacaatggaaatgatagcctagtttcctattagcatccccaggttatagagaaaaaagtcattggggacatatcatcatttttaaagaattgaagttgggtagatttaaaattctttttatttcctttgcatgctggaaggtaaaagaaaagtcatatagaacctaaaataactgaaactgtctctgtaatttagcaaaaaaaaaaaaaaaaaaaaaagaaaagaaaaagaaaagaaaaaactaaacacaagaagagcttctgcagttgattatgtcaataaaaccctggcttctccttggtctgcagtccagagtcatctaccagctactgaattaaaaattaaatcagtagattctggttaaatttgctctgaaacagcctgttctagcaccatttaatttcatggtcaaatgaggataattattctaaaaagcttccagccatgaggttcttgtgattttttagttaaaaatgtggccactttgaaccctgttctgtgatttttagatgtggatacaatgaagtttttgcctttattcactctgactctgtttttttttttaatgagaaaaatcagcactttccatctgaaaataggagattagaccaggatatttctatcaatagaggttactaaaccatttcctcaagttaataaaatataataacaaaaattcatagttgccaacttataatgacacctttgtctttttcaaggttcatggaatgagaactttaagtaatgaatttgatatttgtttcctttatttatatagccaattacaaaggcagaataagaaggcatatttaagaagttgatacaaaccccacactatggttatttttgccacctcggagattcttatcctgggatcccaatttagcacttttggtgagatttaaacaataagtctctaaatagtcaaaactgcaggcactttagggaatgatcattggaatttagcatgaataccaaaattctttatgttggaatgtcggtagaacaatagtccatcattgatgtaattaacgcccatcaagatcttatttagaagtattctcttttcatgaattttatgagcatctattttatttgatggtattcttttcctcttttgggtttaatttaaatttttctcataaaactgtctctaatcactagaatccaaagacagctatataatctaagaccctttctatcatcttctattcatagatggcgtcaagacaaggagaaagagactggacccaggttgttgtggatcttagatgtggactctgtctcctccctaggatagttctgaactagattctttaaacaagacaaaacatttgattagttttttcttaaggaacttcatatgacacagttgtttggttacattattctgcttcctttctctggttttatagcattttaattgctgttttaatcctgtgttttatataaagcatctataattcccttggtggatagaaaccatagaagtaaaaagtgttattattatgcatttcccagtctgttagtgctttgatagattccctaattcactcttcaaaaaaaaattgctatatacattgtgttctttttacaacattactatcatgagtaggaggaatattttagggtaggataaacagtaattggcaaggagctataacattgatttgtacaagcttcatgtccaatccattctgaggatgctattagagtaatgggtgaaatgaagggagtgctgatttgctaaatttacttcgggaaaagatcaaagtggtgctagggctttggaggcactgcccctggcagtttcctgaggtgcactctggcccttgtggaagaaagagcacaagttacccagcggcagcatgcatggtctttggccaaaagaggcccaagatgctgagagagagagcagggtactctggaagccactagatgggggtgtctacttgttcagtctgggcaaataccccatcaaccagctggcatgaaagaaataaaggttaaaatgagggtaaattccatattcctcaatgccattcttttacagaaagtgaactgtgttgaatgtcaaaagcaacttcgagtcacctgctgcctccagtgatttggcctgggaggatagccactgagatcttctcatgctggggttttgggggctctcgtttgaaagcagcattcctctgggaaaccaatgaatacagaataacgaattagaatggaggtgaggtaattcaccaagtttttctgcagagttatgagtgtttctgacctagtcatttaaaccctggacacccacagtttcctaccttttcaacgaacagactaatctttgtccatcacagctaccaataataatgataacttatgattttataagcaatctccaaatgtgatcagtcctaaaataaatgtatctgagcaggaggaggggcagcagaagcagctacaatttcaggattcatccagcaccagatggaaattccatcctttggttaaaattcttctaagaccttggctggcttgtgaacttggcagacccaattattatagcaattaagattttaaaatgtgagtcaaattatgagccaaactcgtgccaaaagctggcagacagacaccctgaatttaggtcagggatgttgttccctgtaccagtggtaattcaattacatcccagccccaggcatgcaagttccaaccccaggagacctggtagtcataataggtcttctctgggctaaagaaaccctgggatgcccattctgcctgaggcccccccatcgctggggcaccgacctcaaggaacagcaggagaggccaccatttgtcccgacattcagctcccggggaaaccgccgtgctgagacaaacacctgtgagggccaaatctgctttgctatatttattacaaaaagactcctggaggactggctggtattctgataagaacttgaaggagaaatacttttctttaagagttagaattttttgaccacaatatttgatttttagcattaagtattctgaatttaaactactaaagagagaaagaatgcgtgtgcacattagggcaattggtaacaggctcccaaagtctgggagctaatcccacctccccgacctaactcttgtgagagtcatttcacactctgaacctcaattttcccatccgcaaaatggtgaggataaactacattcaagaagggaaggccatttcttctgcagtggcagctcagtgtggagaaggctctgtggttggagaggtccacatggaatgtgtatccagagggactgtgttggagccatgctgactgcaaggacaggagtggagagagggcaaaaacgctgtgcatttgccgttcctaaactaggtgatttcacggtgtcattttcattacaaatgatctttaaaactatacatgcatttcctgagtgttcaagtgagagagcaggtccaggttagagcaatgtgtcaacttgatacctgagtggaatgggacagggagacctattttaaatgacagatactaattttattagcaggtagctttagcactcattcatggaccagctgttgtgtacacagcactattctgagctgcaaggacacagagataagtaagccaggcactaaatgtcaggtgttcggagtccagcggttccaggggaatttttgtaaatgcaataagtggttgggttttccgcccagccttggtcagtgtccgtgaggagcatgttcttattaatattgcaaaataagtaaataagatgtgtggcagcgcctaacctgctctctggaggaccttctggagagggctgttgctggcactcccacgctgaggctgtgccattcccaggagagactcagcacccgtttgaatgggaataacttgcctgtagtcctagctaattgggatggtgagggagaaggattgcttgggtccaggagttcaaggccacagtgaactatgatcatgccattgtactccagcctgagtgacagagcaagaccctgtctctaaaaacataaaaccaaatggaaagaactttttatgctacaaaaccacctcattatgcccatgcctcgtcagtctagaaaacccccaaggtgtgtttaatcaatgttctgtgaaaaggagagagtggctacctattcaagaaacactggagtttttaatgcactttccatattttccatgctcttctccaagtaaaaaccttaacacaggaacatgatagcatctctctgaaaatcctaaaaattgtatggaccctcatgatttagtgtgatttgagctaaaggcaagaagactcactaatgaatctcacagagtccctgctactctgggacttagatcttagctggtggctagaagaagccaaaaacaatcacctacaccgtaaaaaatcattgcaacatgaattcaaaattcaaatgaatggagtcttagcaccataaaggatttttctaatttcagatgaacccattcaatgtggccccctccaaagtaacagtgacagctcacgctaataatttacagtctctaaagcacgttcacagccattttatcttattttgaaaatctgttgagggatgtttcctaccaaaacaccaaatcttccacatcttgtgaccagtagcaccgattctcaggctgtgaaaaataggacagtcacatccgatctccagcctcaccgtggtccatcccactctcctcattcatgattcctggtatgtagcgagaaagccaaggatgagacaaatagttttggttcaggattaaagtcatgagttgtctagatatactccttttgtcaaaggtgattatagcatagatctatttaggacagaatctttgttaagaatatttatgatttacagatgacattggaagaaaatcacacattgattttggtttagaaagatggtttacagaacacagtagtgttctgagactatgtgattgagctaacccatccaaatgtccagttcctcccttttcctctgccccttcctctggcctgccccaccacatccctagattgcagcaaacctatctgaaaacccagtttcccctttacctggttccttcctccgatccactccaccctttctctaccgcaacccccaagcatatttgagatgactcagaggcattatggtttggactgaattaaaatgatggaaacataaaggaattcttacactgcttgtatctaatgaatttccctggtgcaaattcaatattaaatgcagattgaagctaaaatggtccttaagggaataacagaagtatatcggatgttaaagggacttttaattaaaaggaatagctggctgggaagcttttaataaatatttattttcagtggctcaaaaaataagtctcccagaggagggcacctactacctctactaccctctaaaataagaattgttttttatgccaaagtgtacatagacatctgttctggaaacttaacagactaggaaaaaaaacaaaattatagtaatcattagcttgcttatttctgaaagattttataatcactcatgtgaaatatttacctaaattacttggcattctatcatagatgatgagtgaacaaaataattacttatatctaaagtagcattgaattagtctgagttttgcatctaatgtccccgaaatgattgatcacaggtaaacaaataaaaagcccctccccccattggttgttatttttctaacttcagatttattgtgtctttttgaggctggggttttagtctatgttttttggggtaaagctttgataaattaaaatacctcctcacatttcattttcattagaaaaaataactcatactgcatctgagaaagcaggattcataaaataaagagttttcatgctaaatattaacattggctctgatttatttatggataagagacagtactgtggcattttcagctcagccccagccttccagccagttgtcatgtcagacctcagtccatgctaggcccaggcagtgatggagggctcagtatctggaggtcaccccattactgtgagtgacagagaaccactgtggacaactcaggcaggacgtggtcaacaaaagcatgatgtcaagaaaatactgtggaaatcacccagcaatacagagagttgatgattggcataggggtcctcatgacataggaggtcctaacatcaggggctgagactcaggagcagaattctgagcccaaggaagatggcttcaatctaagtgtagttggagaatccagaaaaaataaaaataaaaaccactaagaaaacagataggaagccaggtcatgaaatggtagtaccacactgtaattcattcacaggaaccaagtaataatccagtttattagaaccaatgttcaaggttggactgaaaccagtagaaagttagcttaatgctaagttgcctcaattgttggcttgaatcaatgtcttctgacactagatcattttagggttactgggagacaggcaggatgatcatttatcttgcaagtatcttcctaaaaattaccctgactggcctgaatcattagcccatatcttccattttataaaaatcatgacaaataggtactataagagcagataatcctgagggaagtcaaaagtagcattataaatatctcaaacatcaataaatggttgttatggagtattataaaaatgcagtgaagtctttctgttcatgtcaatgagagtttgttgaacacctactatcaactagaagaagtacaggaggatttgatggcacaaaccaaacaattttgacctcagtgcctcttctctgttctcattagcagtttgtcccaaactcgaccaaaccaaagtatatctctccatggcatagacccaatccagggagaaagcaaaatgcaattttgctttgggcttgcatcacctttttgttaaatgagattaatgcttgctacctggaaacattcattgagaacctactaccctaacattacaatgaatttttggagtacaaagatgaatacagaatggttactgtattgaaacagctaacagttcaagtgggaaaacatacacgcagaacattagaaacaaacatacctgcccccatcaggcacgcaacctccagagcagtgtttcatataagacagtgcttccaactttgcaggaaaagagttgttataagtttctctattatcagatgtgacaaattaacaagtagggccatgtagatccacaacaagaaagagtatttgaagacctaaacaattaatttcaatattaaaattcaatagtacaggatagcaatgttctagtacagtacctattgtcaaagcaaaagagaggtgcctcccatgaaatcataagttgacttttgttcattttcttctctttgtggcagcttgttctctctgcaactaattttttccatggaaaactattaaggtcattgtgacatcctgtgaaaaagaaaagagagaaatacactgacaaaaattcataatcaagtcagatcaaaagaactcttatattacttttttttccctgtgatatttttctttaaaaaaatcaaaagaaaagtaaaacctagatctacaagttgtgacttgatacctacaagtaaggtatagtttgcgatttgtggttctttggtagattttaaatggtttactacagaaatgcaaaagcattattctttgaccattaacataacatgaaataaaaggatctaaattcatttcatgtatcaaatatgtcactcttttgatgcacataccattgaactccaaaaggttattgcagtgaagtcatttgcgatgtttctaaaggccattccattgtaaggataaaaaaatgaagcagttattttctaatttacattgattcatgggcaagaaactgtaacgtgctgctggccttcaaagatgaatatgttgcaatcttgtttctggaagagcttacagtcagaggacacaactatgaaattcaaggcacatcataaaaaatgctataaaatataatgcacatattaataatataacaaagtatgaaggacctacattaggcaaaagctattttcatctcctttagtctttacaattctaggaagtaagttatttttattttagacataaagaaaagttacttggtgagatgaaataatttttccttgttttctcagttaggcagtggtagaaatgaaattcatgtgcatctgattgcaggatccataatctgtactttttagcaaagagtgtggtcaagaggagggagcattaattgaagatgtagaataagggtgaaccttagcagtagccgttatgtctttctctcccagtttcttgctggaaaggtgaaacttacttctctgtcctctctcattttagcacttatttttcttgcaccatctcttgcagaacacaagggcttaataattcagcagccagtgcgttcaatgtgttatattacgttaggcaggctagaaagccttactctgtattgatctgaaaaacagtcattgaaaagcagtgctctaacagtgcaaaacaacagagctgacagttggttcaaacaatgagtacttttagtgagaggaaaaaagtcagaacttgcttgacttctgtacaacctcaagacctcacctgttaggctcagaacttgccctgataatatgtaggagttaaagtacttacctacccttaacttcctatctgaaggaaggaagagatttaagttcaatgtaaattaactcactcatcaccaacaaaagatacccaattgacgctgaaccaaccaagctctgagtagtagcttgttttggaaaagggtagaagggggagaaagtttctgctattagcataaatactatgaaagctcacggtatttggccttcttttcacaaaagtagaaatgttttatccagatgttaaattaggggcattatattaggtctgcctcagatcctaacatgatttgtggggagcatatccttcttttttcatctccactaaatattgcttgattccattatgcctgattctggcagtctgcatgtataacagataccaaatcatttgtcaaaccccaactcagtagtaaccctttctataaagtcagactcggttccttcactggcatgagacacacctttctttgtgttagaaacatcagaaactacgacagaaggcttctgtcgtagttttttatgtattggtgtgtctccctctaaatttaaggtagccacaaactccttgaatgaaaggaccattaatctgtcttctctttccttcacttaactctttacctcccccaaacatccttctttgcatagaagagaagagccagattggaatccctcagcctcccaccaccacacctgcatcttatctctgcttgcctctcttgtgccctgatagaaacgaggaggtaagcttccttgcatctaggtccaaacattctgcctggctttatttttggtcattgcctcctcctgccttcttataacacctaaaccactgactatccctcttctattttgcagattcgagttctctcttccaataaattctttgtcattagtttcaacccagttcctctctctgttattaaactaaacaaaacaaaatcttccctcagcaggctccttaatcaccagctcctcagccctgtctctctggtcttctttacaacatgaattactgaaagtgttgtctacacttattggtgccatttcttaaccttgactttctgctcagcctacccctcccatgaactacttcatcaaaacaaagctgttctcacggagggtgttactgagttccaggactcatctgcacctgagactatagaccctggccttgactctgggacagcatactctgtgctttctcctcttcatagtctgtcttccttgtagactcatccttccctacctactcattagaatttttaccttaaatggtggatattttaaaaatgtataaactagatgaagggcatctagcattcagcatatatttgtgaacccaccacctattaaaaacatatcttgggccgggcatggtggctcatgcctgtaatcccagcacttcgggaggccaaggcaggtggatcatgaggtcaagagatcaagaacatcctggccaacgtggtgaaaccccgtctctactaaaaatacaaaagttagctgggcgtggtggcacgcgcctgtagtcccagctacttgagaggctgaggcaggagaatctctcgaacacaggaggcggaggttgcagcgagccgagatcatgccactacactccagcctggtgacagagcgagactccatctcgaaaaacaaacaaacaaacaaacaaaaaataacttatctttacaatctttgacatccttcctgactttccccaattccaccttgcttgtctcctcagtgataaccactattctaaattttgtgttctttattcttacaccattctttataggtttaccacatgcttttatccctaagtaattgcttaatttagcatgtttttcaaattttgtataaatggattcacgttgcaagtagtctttcttaactcgctttttcactcgagtatgtttctaaatctcattcacgttcttatttatagctgtagtttctctatctttacctgtatatagtaattcttatgtccatatgtatttgaatgtgtcatcattatgatttatttattcattccgctgttgttgaaaattttcctgtttcaagtcatttgctagtaaaaacagcaactatgaacattatcatacatgccatctcttacaaatgttcaaacatttctgtggaacagacttttgcttgaaattgtgaaaccataaggcagaagcatttctaaatttgcctgatattttaaaattattttccaaagaattttaacaatttatactcctaccattagagaagacgagttctcttgctctataatcttaccaaacatgatatggccagatatttgtttaagttttaccagtcagatgagtatagagtagtatctcattaagatcttaatttatacttccctgctagagtacgtgatatgtctttacattatatttgcattttatttttgttcattgattttgctaacactgtcatttatcttctattctttttgttgtaatataggaacaatcatattatctttcaaaaatggcaactctgttttctattgtcaatatttacatcttgtttctttttcttgcattcttcccgtgaggacttcccgtatgttgttgaataaatgttgtaaaaatagtcatcttgtatttttttctcatattaaaaagaaatatttcaacgttttgccattcagtatgatgttttctgtaaggattttgcacttaccatatattagcttaagaaatttcttttatagttctagcttgctaaaatactttaaatcatgaatggatgttacattataactagtgatttttctgcatttattgagatgagtatataattttgctttttaacatatatgtggtaaatattactactattaatttatgtgtggtaaaattcactttttttggtgtagagttctatgagttttgacaaaggcacacagccctatactcatcattgcaatgaagatacagaacagttccatctcccaaatattcagtagtgctacccctttgcggtcaatcctaaccccaactcttgcccttggcaatcactgacctgtttttttctctctatagtttcaccttttccagaatgtcatataaatggaatcatacaatatgcagcttttgagacaggcttttttcactggaaacttgagatttgagatttagccatgttattgtgtttataagtcctctgttcctttttattgctaagtagtattctattgtgtggatgtaccatttgtctatccattcaccagttaaaggacatttgggttgtttccaggtttgggtaattttgaataaaaacctctgtaaatgtgtatgtgcaggtttgtatataattctgtttatttctcctgtgtaaataccaagaagtgggatttctcagtatgagactgtggaacattgttctatgtgtccttaatgctttgttcatttcagccccctctccaagtctttttttgtctttgttcttcacattggatcatttctattgatctgtcttcaagttcactgacttctctattatcactattccactattgtctagccattttttttaaatttgagatattgtgtttttaagtttaatatttccatttagttcactttttattcctctgctttcattcctctgctaggaatgtcaaccttttcatttacttaaatgtgtttgcctttatcttatatagtacagttataatagtcattttaatatttttgataattctaacatctgggttatcttagggttgacattttttattgtctttttttgagacaaggtcttgctctgtcacccaggccagagtgcagtggtgcaaatgctgctcactgcagcctcaacctcctgaactcaagcaatcctcccacctcagcctcatgagtagctgggcctacaggggcaagccatcatgcctggctacttttttaatgttttgtagagacagggtcttgctacattgtccagactggtctcaaaatcacaggctcaagcaatccacccaccttggcctcccaaagtgctgggattaagtgtgagccaccgcacccagcatttattttctttgcccttaagaagtggccacattttcctggttcttgaatgtcatgtaactttagatcatatcctagacactgtgtactggtcctgttattatcctctgaagtacacatgttctcattattatacaaacatgccattttcctctgaccacgaagttttgctcagtgctctattgacctaatgcctttccctttatctcttcatttctacttatggcttaactcactgtaggggaaaactatcatttattaagttcctgatatgcatttgattttgtgttagaatgcagtgttccaattaagggatatgtgtatgtctaatttctgtaggaagaggctgagactaggggacaggaaataacttttccaagatcacatagatattaagagtcagcaccaggtttcaaactcagcaaactctgattcaaaaatccattcctttaccactacctctcccaacttcatgaaaccttcccttcccatatcaaactttaaaataactttgcctcctatacaaatattttaccacctttctcatcacataattctacagggtcactgattgtttaatgtatatctaattcattcagtaagaattaaggatccttgacagtcaaaactgagtcttctatttcttttacatacctttcaaaagatggaccatgtattttatgtgccacaaaatttatgtgccacaaagtagatgttaagtaaatgcatatcaaagagattttaaaaaataaataaaaacctagttaaagggtaaaatatgaggcgtaattttagcacaaagaatagaccatttggaagatgttagtgttgctgtgctataatcagaaaacaaaaatggagaagaaactgttttaattaaccctcctatacatttgcctatagatgtattctgagcttaatggattgggcttaattatctatactgcactaacctttgaatgggcgtcagggctttctcacctcagggatttcttccactcatctcttgaatttccaagcaggggggcagaaagatgagttgtgaccccaaatcttccactgatttactgtattggcatgagcaaataatttaccctgcggggtcttcagttaattttaaaactaaaatgaggaaaacaactcttaaatgtctcctttgaatttgaatgtaaataaaatatgctaaacctaaagagctttgaagacttctaagaaaagctttacataagcttcctttatttctattttaaatattattttttctttcctaaataattttaagaagattcaagaagaggtgacaagatgtcaagatatggctcactcccccatcattgttagacataatttcctgtcttcctggccccaaatgttatcactgtgaggaacaattgtttaaaaattgtctatgtaagagacactatacaaatggattctatggggaaatttttacaaaagaataagacctggtaattcctctctaagaaattgatatatagttgaggagataaaacttgttcagacagaaaggaaactgttatataaggtggaatataaatttcaaatcagtagcataaatgtgccagggtttatgcaatagagataaggatgaagtatggattaagccaattgtttagcctgtgattttgaatgccaaaccgaagaatgtgggcttgatcctgtagacaacagaggcactgaggacttctgaattgcgaatgacctgataatgaggggtattttggaagataaatacagaggaaagaataccggagacaggcagacctgttagtatactgcaattgttcaggcaaaaaaatcatatacacctgggtggggatgttggcgattgtaataatcaccatttgtttaatgcctactatgccaggccctgtcatgagtgcttgacataaattctagttctcacaataaccaggcatgatcagtgttgttgttttatcttgcagatgaagagtttcaaagtgcttatgtgatttgtttaacgagattataaattaagtctctctggtttgtaagatatactacacaatattcccctcaactgattttttttcctttttttttttttttttttggaaacagagttttgctctgtcacccaggttggagtgcagtggcccaatctcggctcactgcaacctccacctcctggactcaagtgatcctcccacctcagcctcctgagtagctgggactacaggcgtgcaccactgtgcctggataatttttgtactttttatggagatgaggcttcaccatgttgcccaagctggtttcaaactccttggctcaagcgatctgctcacctcggcctcccaaagtgctgagattacaggtgtgagccaccacatccagcctacaactggtttaaaagttgtgaaagttaggcggatttgagttatgagcttaggcagcaagattatatttgagtttttatgcctaattaatttgacttttcaaggagaagacggcctaaagaagccagaaaataaatgtggccagtggtcaaatgtgggatcacaagatgattttgagggacaatgaggaaacctctctcccttgcttctttatgcttgaagtcatcttattcgagaaaaagacctcggaggctggtagcctcaagagcagaaacacaatcacttaagatcgttgcaaggcgtttatgaaacatgtcagatcattccaaatgcttttgtctagcttgtccagaaatcaaagcataaggtcagtaggcacctaaatgagaggaacagggaaatcattagcttcataatcattgtaaacaatttataatcattaacattacctcacaatttggttagaagtgaccttttaaagtcagggcacttttattgaagtcgctaggttttctcccccatttagaaaaataaaatgtttataatatatgctcaaaattcatctcttcctttgaagaaagccaaaaaaaaaaaaactttttgtttggatggcatcttttatgctatccccaaatcaagagtgtgaaggaaagtaggtgctcataaagtacacaaactactcaaataccctgtttaaggcagtttctctttcaatttctaaccatatcatttattcattgctggagatggcacagaggtcaaactagagttaaaataagcctaatgcataataattctaattattatagttctaaattgcttcaaggttgtattttgctggagccatacttgaatgagaccttgcaatcaaatagtatttgtgtcttttaatacatataagtatagcatgtcttttcagtgattgtcttaatgttaattaacattctttggtcataaagaaccatatttgacagaagaatttagcaaaatatctgggtaaaaagaaatgttctctagaatagctttgacttttgtgacattttacatggagaaaaataaagtctgtccaacctttcaaccagaacaaataagatgctagttgccaaattcacatggataactctagcagcaaaaaattagatacagctttgtgataaaaatgctagtatctagtggtgatgatgtcaaccaaatcttagaaaagttcacattcttatggttatttgtattagtcttttccaacactgctatgaaaaaatacccgagactgcataatttataaagaaagaggggaaatgccagatgcttataaaaccatcagatctcatgagactcactcactatcaagagaacagcatgggggaaaccaccctcatgatccgattacctccacctggtcctgcccttgacacgtggaggttacaattcaagatgagattttgggtggggactcagtcaaaccatatcactattgattgaatttttcatatgtgggcttcaagttaaaggcccatacataatattactgaaacagtacatggtgaataaggaagaggcagcccctgtcttcaggtagtccaccttcaccaaaacataacatcagtgtcccaaacatgagataccatgcaagtgctatataattattcctaatggatcattgtcttgagatgcatctcctcactccccacatcctgtcctttggaaagtgtggtcactttgaccttctgaaggccttcagcccatctaattcctttcaacctcactaccatgacctcttacttgaagagcacaacagcttcacctgtgtttcctgcaatccaatctcctcagagtagcaattagatgggttcacattgcacagagagcagagcccagcccctggctccctccagtttcaattgctgtcgctcatagtgatgccaccgcatgaccttttttctagtctttgaatgtgcctcactcaacccagatttagccccttgtgcttgcactgcctgcagctcccttccctgaatcttcacagggttggcagtgccatttctttcggatctcagctttactaccccctcctcagagaacctgtccttaactacccaatctaatttaccaccaacacccaccatgttttcttttcttcatagaaattatcaattatcttgttggtgtgtttgctcatggtctctcctccactacctcgcagacaccctggcacaagggtccctgattctcttgtccactgctctgtctccagtgcctagatcagttcctggaacaaggtggcccctcagtgaatatgcattgaatcttcataacaatcctgatttaatagtgttgtgttttcttttcaaccgtgaaacttgagttcctaaatctcatgcccctgcccctgccccaggatagtagaactcagagttgatatatttaaattttgtgaagaaaaatagaatgaggaaaaagttgagaaaaagggagactacagttccaaattagcctatagagtcttaagcttgtttaacccaatgcccacagctgcatgtagcccaggacggctctgcattgctgcccaacacaaattcgtaaactttcttcaaacatgagatttttttttttgcacttttttttttttagctcatcaggtatcgtcagtgttagtatatttcatgtaaggcccacaacaatttttcttcttccaatgtggcccagggaagccaaaagattgaacacccctggtctacataaatattctacatggactaagtttcagcaataaaagtaatacactaaataaaagggaacataatcacatttgacatgtcttaacttagtaattagagattctaaatacctagttcttgtttactggcgtgtacttcctaggctttctgtaggaactccttcccttgttccttctctaaaatgtattgaggtttccaagttccatatgttataaggctttgtttaatccactcatgcaaataaatcctattgttttatcatcaagaagtatacaagaacattgctgtgtgtttccctgtctatgcccactttcgactaccaaaagcacaatcaccccagtacatgaggcagcatgatgtaatggaagatactaggcatagaggtttggtttaaatatgagtctaccactctcttgttttcatttaatctctccaagcttcaggctccatatggaaaataagaataataactaattctcagggttaattctaggattatgtgaacaaatatatataaagggactttatgaattgggtgtggttataaatataaggagtgtcatcatcatcagtattatcgtcagcagcagcactatcaccatcaccatatttgagctggatcagacattactggtgatttttaattgacatataatatttatcttctaccagaaccagtctcaaaaaccaataaggcagtgtaggtaagcagttaaaagcatgggcatgataatcaaacctacttgagtctaaagcccagctgtgccacttactaggtaggggacttctctccagtgacccaatctcactaagactcagtttcctcacctgaaaaattagaaaaataaaattatctctaccccagtagcaagaaatgtggattaaatgaaaaaatgcccagaagggagtaatatatctgacacatggtaagcaatcaattatcacttgtgtaagtagtgaattcccacagagtaaaaaatggaaaaaacatgctgttttattaaaaaaaaatacattgttgtccagagtaaattaattacctttaaatcctcttaatgtcatggatttgaagggttgcttcttctacccaaaacaactgaattcagcagtaatgaagttatgctcacttgcagctttctactgaaatcctaaacttcctggaatcttcacctacatatccccaagtcatccacatccaagcaccttccatgagtctccatgataaggctcattcccttcctccccagaagtcgtgagtgttcatggcatgaagtacttcttccctcagaaactcaccaatcttgctgaccaggacaagatggcaagagtggggaaaggactgcagtattggctcacatgtgactggctacaatgatctgcattttgtacaagttgtgagtccatggaatcatttgcttgctgtacaatctttttttattgtggtatatatacataatataaaatttaattttatattttaatcattttaatcattttcaagtatacagttcagtgctattaagtatattcacactattgtgcaaatatcaccaccatccattgccagaacttttccatcaccccaaactgaaactgtacgcatgaaaccataactccccattgcctccagcccctggtgtgttgtttctatttttatttgcctgaagatactttctaattttccttgtgatttcttccttgggccattgattatttaacagtatgttgtttaatttctacatatttgtgaattttccagtttttctactgccattgatttctagttttattccattgtgattagaaaagatgctttgtataatttcagtccttttaaatttattgagacttgttttgtgtcctaacatatggtctgttctagagaatatctcatgtgcatttgaaaagaatgtgtattctaccgttgttgggtggagttcaatagatgtatttcagtctaattgggcatatattgttcaaatcttctatttccttgttcatcttttttttagtgctctatccattactgaaggtcaggtattgaagtctccaactattattgtaggaatgtcaacttctcctttacattctgtcaatgctgcagatatttaggaagtctgatgcttgaggcatatacgttgtaattgttaaatctgtttgataaattgaccctttatcattacataaggtccttttctgtaccttataacagttttatacttaaagtctataatattttgtatgatattagtttgccatccctaccctcttttggttactgtatgaatgaaatatcttctattctttcactttcaatctattcttagatataagatatgtgtcttacagacagcatgtaattgggtgctggtttctaaatccattctactaatctgtgtcttttgattgggagagtttaatctatttatattcaaaataattaccgataaggaaggacttactattatcattttgttgttttctgtatgtcttttagctatagcgtccattatttcctctattactgccctccttagtatttagttgattttttgtggtgacatgttttgatcaccttctcgtttccttttgtgtatagtctatagattttctttttttggttaccatagggattacatataacatcctaaagttataacaaaactttaatttcaatcacacacaaaaactactcttttacaactgtactcattcactttttattatggatgtcacaaattatatcttcatatagcatatacccactaacatacattcatgttatttttatggatctaccttttaaatcctgcagaaaaataaaagctggagttaccaaacaaattataatttttttatatttattcatgtatttacctttaccagaaaactttatgctttcatctggcatcaagttaccatcttgcatcctttcacctcaatttgaaggactcccttaaaatttcttgtaggacatatctagttgcaaggaacttcttcagcttttgtttacctagtagtgtcttaatttctcccacattttgaaaggacagtgttgccagatatggaattcttagttgacagttttttccccctttcagttctttaaatatatcatcccactgccatctgtctgcaaggtttcagctaagaaaagtgttaattatcttattgagtataatgtgtcttgctatgggtttaagtttatcatagttggagttcattcagctgtttgtatttgtatacacgtatctttcctgaaattcaggaagtttttggccattatttcctcaagtaatccctctattcctttctctctctttcatttttttttttactggaacttccataatatgtatgttagtttgcttgatgatgtctcataagtccctcaggctctatttactttttttcttctttttttttttcctcagacttgacaatttcaaatgacctgaattcaagtttgctgatttattctacctgttttgagtctgctgttgaaccctctggtgaatttttcaattcatttattatattttttagctccaggatttctctttttaaaaattttatttctttcttgatattctaattttgttgatacattgttttcctgagtttttctttttagttctttgtccatgttctcttttagctctttgagcatatataagatagttattttaaagtcttgtttagtaagtctgatgcctgtgtttcttcggggttggtttctggagatttattttgtgccattgaattggccatgtttgtccatgtctttgtatgccttctgattttgttgaaaattgggcatttgaacaaatagccacccctctatctttgcaaactggctctatggaggggaagaccttcattaatcagctcaaactgaagacttaaagtcttctcaggacttttctgggcatgcctctaccttgggcctatgagtgtgctttattctgattcccccatatacatggctgcttttaaaaatcttaatttccctaggagtttcaccccttttctttctcatgaccttagctgttctattgtatttctcaatcagtaatctctggcctcaggtatctgtgggtgtgtagtccccttgcgattttcttgagttataacaatagcctccaatggctttctctagcctgaaattcaagctgtgccacttttggaagtctgagtgctgagttaggtgacacagagaccattatctgaagatgtccccagacaaggtagaatgttacaaatttggtctgattcacactcctggtttgtagaaaggagctggggactggagcactgctttccccagactgtattgcaccacatcaaggaggggatggggcaaaggtgagtaaaaatgtcatgaaatgttgtagcattttaaatttagttttctcttaatgaggagattggttgctgtatatctttgactgatttacagtgctcctataaaattattttagccactctagttgtttacttaatgttcacctgagagaacaaggatctggagtttcctagtgtaccatgtttctgacatcactatacaattttaatagagaaaaatgaaagaaggaaatgaaagacctactaattaaacaaacctaagttataaacatagaggacattacctcatagatgtcagagaggactgaataacctagaatggtgaagctcaagtgtttggtaatcactatgaagtgattacatagaagaacagaagtgtctgctgctacatatggggtaaatgacttcacaaatacatttatggaagtccttagcatgtctggaggatataaattaaatcaggagaactggcataagtgcacatattaataagacataattggagcttagggctgggtcatgataacatctccatctataacagtttctcaatctgtggccctcagagcagcaggatcaccaaattcttgatttttatccctggtctactgtttcataaattctgggagaaggctcagcacttagtgttttaaccagccctccaggtgcctctgatgtatactcaaggttgatctgaacaaacttgcagcaatattcctggacccctctcttcactcccaacttcatgccgtcataaagaccaacctcatatacctgtgcatttcagaattttaaagtaattttaataaagcaactgatgacctgatggcctgagatgtgtatgggtgcaggtgtacacatacagataatgtgtgggccattgctagaattactgtcttccacaggaggaagtcacactaaaaaacaaaatttccctcagacacatgtctgaaggactggggttatgtgacctctagtcctgtgtgaaaatcaagcacttggagctaattttcctgggtcctttgctaatgtagatactgttcctggatgacttcatactgtttctgggtccttcatccataggctttggatcagctctttagagatggatagcagtgtacaagaaaagcctcagcctatgaaactgctccatgtatggcagggtcagttctactgctattaactctggaaaaattttagacaacatagggcctggattgtagacatgacctgggtctaaactcagatggctgctgtcagtacctgataatgttttcatctatgaataaaaccatgaagcaagcccagaggcaataaagttaacaactatattaaggaaacccaagaagcagaaatctaaattcactaaacaaattatttgtggggtgcatatatttccaaagaatcatttacttcacaaaatgacttattatagaattatttgaagtagagagcttctttgaagtactatgcagcagtttaaaaaaaaatctttatgtgaattagacatacacatggcaatatctatagatcttaaaaacatgacactgcgagaaaaaaataaaggaaaatatttttaacaaaatatcatttaataaaaaatgcatgccaatagaacaaatgcaaaaacaaatgccaataatgtcaatgtcttagagtgtgatgcatgcaattatcatgtaaagcagcaatcccacttatagttatttattccagtgaaaggaaacctatgttcacacaaaatcctgtatttgaatatttgtagcagtatattcataattgcaaaagcctggagacaatccaaatgtcctacaaagggtgagtggataaacaaacttgtacatttatgcaagaaaactacttggcaataaaaagaaatgaatgattgatacatgcaacagcttgggtagatctcaaagacattatgccgaatgaaaaaaatctaatctcaaaatgttatacaccatataattccatttatataacattcttgaactgtcaaagtgtagtgatggaaaacagatctgtggttgtcagggttagtgttggtggtggttagaaccataaatgggtagcataattgagttaattttggattatctgcatcctaactgcagtgttagttacatgaatccacatatgttataaaaaattttatgcaactctataccaaaaaaaaaaaaaaaaaagaaaagaaaaacagagtacttataaaagtgggtgatatggtttggctgtgtctccacccaaatctcatcttaaattgtaactcccacaattcccatgtgtcgtgggaggaacctggtgagaggtgattgaattatgggggcgggtcttttctgggctattcttgtgatagttaatgggtctcacaagatctgatgggtttatcacgggtttccacttttgcttcttcctcattttgtcttgccgtcaccatgtaagaagtgccttttgcctcccgccacaattctgaggcctccccagccatgtggaactttaagtccaattaaacctctttttcttcccagttttggatatgtctttatcagcaacatgaaaacagactaatacactgggcaaaagtcaaaataaggtctgtaacttagttaatagcattgttccaatgtcaatgtcaataccttggttttgatcattgtgctatggttatgtaggatgttatcactgggaaaagctgagtcacatgagaactctatatactatttttttcaatttctatgtaagcctaaaactacttctaaatgaaacgattttttaaagaacaaatgacaactaaaataatgcatattaaacacattttaatggttgcctgggggagaaagggaaggcagattagagggggagggagaaagatattccagagtatatttaaatatttgatttacaattttggggggtacactacaattctctattattaaaccatcagcaccatgaggtcaagaactggtttctcccagtgactagcctagtggtgtgcatgcatcaggcgcacacgaacctttattctattattaaacaaatgagctcctgaacatgtatttatttcatagctgaactccataaagcaaataatcctaaacttgcaagggtttttttggtggaaatcttgacattttaggaatacttactttaaatattacgctttatatttgggtctgaaacatttctgtgtgccgcagttacatcctggccagcctttacccaacagtggatgtgactgccatctatatattcagaaattcagtgggaaacagcagatggggagccaatttggtctcatcactaaaaagggccctagtgtctcctactaccaaaatttgccttttatcagaaaagaaattatagtccctagaaatatcaacatgggggtttctggaacccaagctggacccttgaagagagtgccccattaatcaagtcatggggttttgtttgtttgttttgctcaccagtttttatattttctttatcctcctttccaccttaagagggtctgcatgcaatttaatatttctttatgatattttatgaatcagggccatgtttctcaactagtaattgcagtcctttcatgtgtaatgaaggctgctcagaaatgcagcaagctgtattttctcttccttgttgccagtttatgcctgggaagggtgaaaacatctaggagggtatatcatattaacaactgaggtggaggaaagacagaggccagtgaaagagaaagaacgacaaagggaaacgatgaaagaattgtatgcagtggcaggggcaatggtaagataaacagctattttaataaattagtaaatatgaagggagtggctgtgaaaaaattacataatctgaaaacatcactgaaatacctagaataaaggctttttaaaggaataccctttgctagcttgtctcagctctgaatcctgtggtccttttgagaacaggataagtagttttcttattcttgacaggaaaggcagaatattttcctcactatgttatgagaaagtcataatatgtgacatttggttaccttgctgccatattcaatatgaagggtcttccttttgctatgaacagcatgtctcccatattgtctcttgcctaagctgactggaatcaaaaactgattacagaaataggccaatttggcctgccctgtacgacaaagctaattgaacaataagaaaaaaatgtaaaacttttgtcaggcattgtgaaaagggaaggtcacatggatattagagaaatcttctctttaaaaaagaatctgttttttaaaatgctaattgctttcccaaattgtgttttaaaatttgcatcttttatttgggcaactgttgttttcctagatccccctcccacacaatccttggtgagaaaaataaagttattgattcacttatggtaaacgtcttaccctgggtccctccaaagcccagcctgtgacaagagctagtgtgcatgtgctgtattttgggttgtggttccagggcaccagagtaggagccaagaaagcggcaatggctagcccagggtgcaatggcaagctggtcaccactgtggggcatgggagctggacacatggagacaggatagaggggggcatttatccaataactcctcccatccttcctggtcaaggggtgccccatcacatgttgacaccctcttatttacacattgtttctgacaagtcctgggacaaaaagtgggagcaaacactgcaactcaacaagatgtggtcaggttatacctgtgcaaagccaatgacattggcagtggctggagtacagctgaactgggaggctggccgcaatacagtaaagagaaccgagaggacacaatcatcagcacttgaagcctgaagctcctcaaccaaattaagctttaggggttgatttttggatattttggatttacatagacaatttaaaaatgctcaagaaaaatcatacttgattgtttggattccagacaaagctaacatttcttaggccagtaagattgctccagatgaagttgagcaataagtaaattgaactgtttaatgcagctgttgaccagtagatagtttggtgttaggactcacagcaggattccttctagaaaccagaactataaaggctgttcagaatgaaatagtatatcaagttcaactgcatattgagggaactagatagttctgactcaaataaaattttaatagaagaacagaaggcaatttaggcatgagtaactgacaaattttcctggactggaaacgcgaggctgtttgataacataggatgctgtggccatggggctggctgtgtctgaagggcatgaactttggaggccaacacaaatggcatctatgctcagctccacttctcattagctgtggaaactttacacgtgatctaacccccctacagtgaagactcctcatgggtcaaaaagagtaagtagcaccactttcataaggcttccgagaaggctaagaaaacatatataaagcattttaccaattaagcacatattttaggcagaaacactgttaatttcctttgcctgatcatgcgtgttcattccggaaagctgactggcagaagcaaaccttacagctgcccacatacacagtcatgcctcactttgatgcattccttcgactgcccctcagtcaccattcatagccaagtgggaagtttgaatctgggtgacatggcaccttctttttctttaatgttagcaagtttaaatttaatactaggctttcataaaacaggaggacgtaggcagtccttcgttatctgtgcagcatgctaaaaattgtgtgctagacagtaaattagaaaaaactgccctataaatttcaattaatcttactttagttttaatatttaatatgtcatcatgaatcacatttccacaaaccacactggaagttcagaaaaagaatataggaatgtgttagatttttactattatgttttttccaaaaaaaacaacaacaaaaatgctattccctaaataaagcatgaaatcggttggattttcctctatgacctgaaaaagaaaatcaagtcttattgtccactggtgttgctaaattgaatccaaagcatgacatataacttcagttcataaatgaacagaatggttcaaattatatcctaaaagaatacgtgtacatgcccattctgtattgatttattttgtgattaaaaacaattggctaggaggcactggttgatagtaaaatatgatatggcacaaaaggaaggtctgtatagcacaatgctcaaagacaagaacaaaagaaatggtttaaagtcctttatatttgaatgcatacatagttaactgtaagctcacagccaacagagatgcatttttagctgaggttgtgtggtgtttggtggtggcattggttcttgacacattgtgcatatgtgcatgtgtgtgtatgttagaacctcataattcaactttaagtttcaattaatgaatttacatttagaatgatgagttggataggcacaaaggagagataaactatgtacaacagaatcaccagcctaaggagcttgtaatcaagtgagacagttaagactaaatagcatatgaagtaatttgagcaaatacctgttgcactggcttctgctcaccaaagagcagatgtcactaactgacaccagtgatcccaaaggccagctcaggatccttcccagcgcagtcacctccagtgggtcacagttaggatgcacaacaaaatctatttctcattcatgaattagggatcactcctcggcatcaagacttttcattccgagtgagttcagtagaatctcaggggacaagagtcactgtggtaggaagagcagttagggaaagcttgagctaaacctgaaggaatggttcttggatttggtcatgccttttgtataaggggtagtctctaccaagggaggaagcagtagggacatgaaggaccagggagagcagcctgcatgggtcacacatgtgtcaccgcgcagagataacctgtgaagctggacctgataatcgacaacctgaagaactcaaaagaagaatcaagacacagtgggaaaattaggaaccattctggggtgtttgagcatggaactcatgtaataccaatggtacttttggaggatttatgtctagagaaagaagcacatcattgggggtgctgcggggaacctgtgatacaactgagatcaggatttgagtgcaagaggtttatttaaaggtggtcccaggaagtactagtcagagaatagggaaggggaacacacagagaaactagtgtgttcataagcaggtcacctttgtgggcagctgggacccaagcccactgggactcctctgtgaggcagtggtcagaacccttcagaattacattacctggcaggtgggcagcaggggtattgatgctcccattcccacttttcattggcagagggctgctcccagggcattggctctccagtccttttaggctgccctgcatgaggtctacaacaaaaccctcaggatgtaccagagtgtgagtgctacaggaccacaggcagagacatgtctcagggtacctgtgccaggaaggcgccctggattctctgtgtttccttctgtccctttccagtaaggatatttctgactactctgcaatgaagaactttctgaagacatctgtgtcatttccaccagcacacccaccaaaaaaagatgaccaaagagcatgtaggtttagacatcatggaaaccttatcttcaagttaatttcaaaccgatgccatttaatttcctcctaaccccataggtggacaacaggccggctttcaaactcttggccttgggaaggaagagacctcctgaacattcacacctccctgagagaagctggatccttggcccctggggccgcctgatgtatttaagcatggtgccttttgaagtaaaaccctctcggtgggcactgaacccactcatagtaaggatgcacaggaagacattaaggctggcactgtaagtgagggcagtctcatcttgtcttatggctttaaataccctaacatctcccaaataatcccttagactggacctgaattccaatgcatgcatccaactgtctactcaagatctctgcttgaatatttaaaaagcatgtcaaacttaaactgtccaaagctcatcatgatctgtggatctcgcatctaagttgccccatctctgtaaatggcaactctatctttccaggagctcagggcaaacatcttggagtcagcattgcctcctctttctctcacaccccatgtcttccatgagtattacaaataacgtgtaacatggtcacaaatcccactggctttaacttcaaaataaatacccagaatctacccagttcctcactgctattgtgcaggtcctaacaaccatcatcacttgccaggttattgcaacagcctgcctctgactctacactcgctccccttcatgccattctcagcacagctgctggaagtcctcatgagatgttggcctcactgtgctcctcccctttttaagccctctaattgcttcccatctcactcgcacagtccacacagtgcccaccatgccctatgtgatcagaccgtcccactgcctctctgctctgatctcccactgccccccaccgatctgctccaccactcatctccctgatgctcctggaatggaccacacacactgccacctcaacgcctcctgttcattctgcctggaatgttcttccagattttaaacgaagagggcttgcttcctcttcctcctttggactttgacccaggtttcacctctctagtatatttccctgccacacatctgaacttgcaagccccgtgaaactccttactttccttcctgtcttacttcattattggcacttagcataaacttgtatattttatcttgtacttgtttattgcttatcttccccatctaaaatgtaagtccctatttcatttgctgctgtattccctcgagaggagtgttgatctccaagtaggtgctcaacaaatacttgttgaatgaaagagtagaatgaatcaattgttttagtcaaaggagactttccttttggaaacactgaacttttgtctgtaggcacaatgcctaggtaaaattctttatagtacctagcttggaaagtgatctcagaaacttttctcgagaagggctctgcatgctgctagatgctttgtatggaggatcatccaactcctgccatggttagcacattgttttcaacagcccatttaccaaattcttacacccagttgtggtatgatgattttccctggggtgctaaaaacagttgagagcaaatattgctgaaccaataagataagaaaaattatggttcttatgatggtgaaagcttttcgccctttcctggactcatcttcatgagctgctctgtgctatattccacggaagccatttccagaaacattcccaccacaggcatgggcaggctgttggcacagggagctcagatgctttcctcctattgaattggtctcacagcctctgaaatgttggcccatgaagcctttcggcattccactctcagaaattagctgcccacatgaaacagtgataaactgtagaccaaacctgccaatgtacgctgggagcagacaaacattgtctgctctcctcccagaatcttgctgcagagggcacagttaatggcccctgcagactgggctcatgcagagaaggggcattgctgctttcaagaaagtcctcctattcacaaccactaaagtatttcagactcaatctagccagaccttgggttcttttattctccatctttgcacaacactgtattttatgttttctaattctgacaagattctggagagacacagcttgaatttcttcttcccctagaatggatgaatgaatgaataaataatacaattataatgagacaataatgtgcacaataacacactgccttaaaaagaacacaaaatgattgcatttggacctaaacctctgaaagcgttcagatgagatggggtgtggcaggtgaaggttgtgtggctgtagatgctgtaagcatcgaagctcttggaagttggcactttgctggtgaaatcaatccctgtgatgtgcactgcttctggacacttcagacaggacctcagggccaccagaaacacacaacaccccaagttgttatacccccactctctctctcccctccatacttggctgcccaatggatgtgacgggtcaggcaccctaggcctatggatttttcagttatcttttaaaactataaacatccataaatctgctaaagtgaagcagtaaaatgctataaggtagtgctgtgactttaaaaagaatgaaccactgcacaaacacatgcacacagacactcggtgctttccttatttatcataaaatcacttgaacagggcttaggacaaaggttctgattctatcacgatcactgcttcctgagttgtgagaacaaatattctgttaaccctgtctgttttttttttttttaatgtggctaataatttctgccagtagcctcttaatcatttgaagacttggatcacagtcaccatgtcaatattatgtcaaatagtaaccactgctctatttacttcaagccactcttctccatttgaatacacattttactgttaaaatatttgcatgtaggagctctacagaagaataatttggggagaaatgctgcttttgttaggtacagttgctatgaggcgatgcgagtgcatagagaaccttccttccaagttcagcaacttcctctcctatttcagccggactcaccaagttgcccaagaggccctggccatagtgcctactacaggagaaattatttaatagagaaaaaacttctattacttcctcctctaggtctaaggaaatgcctgaagagtaactactcatgtaaaaaatatcttcatgagagatatgtataaaatttaagcaaaacatatcccatagataaatcttgttttcacataataataaaaaggagaccaggtgcagtggcttatgcctataatcccagcactttgggaggccaaggtgggcagatcacagcaatttgggaggccatggcaggtggatcacttgaggtcaggagttcaagacaagcctcgccaacatggtgaaaccctgtctctactaaaaatacaaaagttagctgggtgtggtggtgcacaccacacctacttggtgtaatccccactacttgggaggctgaggcaggagaatcacttgaactcgggaggcagaggttgcagtgagccaagaccatgccactgcactccagcctgggtgacagagtgagactccatctcaaaaaaagaaaaaaaaaagaataaaagaataaaaaggaaataaataaaaataagcctttatgaaatacaagatgctgaataagtatgactgtactttgtgtaagcttacaatgccatacgccatgatgtgtagccactgaaatatgatcttctttgagggccaaaattaattctccttatttctatctaggaaggagatggaggcaatcaaagtgcagctcatgggtcaagtgtatgcagagaaacctaaagcctcattagtctgagagtcagtgttgcccttgggaagaaaaattaaagtgtgcttaaaaaggaaaaagtggtcaggttcaaggatttcttggaaggccctgtgcatattccccatctctcttttcctgctgtgaatgttcgtaacatcagcatgagcgggacattacatgcacactcattgctttgggagaagtttggtgcctctggtgagaggtggtgtgcttggggcactgagacaatgacaatgaagagtggagtgtgggtcacagcctgctctggtactctcagggtggaagacagccccaactgtcccctatgaccatgacccctaatgcctgtgtcaaatagaaggttatccaattcattcactttttttttgagacaaatactgcatcatttcacttatatccagagaagatatctagagtagtcaaatcccgagaagacaaagtagaatggtgtttgtcaggggctggggaaagaggaggaatggagaatcgttgtttagtgagtatagaatttacattttctttttctttttttttttttttcttttttgagacagagtcttgctctgtcacctaggctggagtgcagtggcacaatcttggctcactgcaacctccacctcctgggttcaagtgattctcctgcctcagccttccgagtagcagggattacaggcatgcactaccacactcggctaattttttatatttttagtagagactggcttcaccatgttggccaggatattctcaaactcctgacctcaagtgatccacctgccatggcctcccaaattgctgggattagaggcgtgagccaccacactcagccccgcttcattctttctccctcaattcacatagttttttcttcctttggatgattagtgggaaataaagtctaatcttgaaacaagagccactaggaaaatgttctaccatagaatgtaggccagaattttaagttattgttactattattcaccacagaatggagaaggcagaagcctaatatcctggtactaaaacaaggtggtgttgtgagtgtccttgttgcttagcttacccatcttaggatgacaagtcatacaattttcttaagagtaacaaaaacagaaacctgttgaggttatgtgtgtgtgtgtgtgtgtgtgtgtgtgtgtgtgtgtgtgtttagaaagctttgtagccaggcaacagaagaaaatatcacttgctggaatcactgtttagtaatgttgtttatttaaagatcttctgcacagatttcactctgtatttttcagacagtaaaaataacaactgataacagccaaactgtttaatgtacaaaagatagcaaaataaaattcaatattagaatatatttgcatagtatcatcataggtattaatgatttcttattcagctatggatatatcagcagttaatgtaacactcggtcaaatcttatttagggattgaaatatttatcttacatatgaactgtctgaaacatgactcacatacatcccatttccccacaagtaatgtaaggattatgtcaattatttcaattttagattaaatatgtactagctatgtgatctttgacataccagatgtttgagatttccctgccaagcttgtcacttaggccatattatgtttcagtctgaacttagtgacataggaggctgtggtttgagtccatggtgctgtttagcacttggaaaatactgatgaaaaggagctgagaatttaaatgcaatttacatgttcagaatctcactggacttgattttgtgcctgtgttgtggaggggatgggttacatataggtgtccgtgtgcatggtgtagtggggagttatgcatgtgtgttttcatgcacatcttcaaaaatgctaaggaaatcacaaagtcaagatgttgttggattgagattatgtggataaagtcagtgcagaattcttggtgacctttgtgatgtaaacaaaactatatcttcccttagcatgcttcccagggcaataaataataagactgaccatatgagaaaatgaatcagtcatatggtaaggaaagcaagtgtcttgtaaaatgtgtttacctctgaagaggaggcagaacacattgacatttcagagagggcttttatcgggaacatctcccattagcactaatgagagctgggtatttaatccactgttctctcatgctcatggcatatttcatccttgatggcaaggccttgaaacttttttctgcctttaatgatactctgtggtagttatgctaaatttttagctgtgtatatggctttctgtgacttctctctgccatctgtataaatatctaagtggaactgaagcttttcattactgtgaacttccctgaccaacctctttagagatattttcttacaaccatgcagaatcctcaaaaggaaaaccttagtgagccccaacctccaccctacctagcccccagcctggattccctggatttcaggaagcccagaaatcagcttgtttctcagtaggatggtgacatcttcgtcttctcctctggaaggtcagtcgaagcccagatactgattaacagactgatctaacccaatgtgacaaaacaccatgccggataacatgcctagagaaaatgacaaggaccgaagacgttaaatcacctcagttatgaggggggaaaagaccagcaatctagaggaatccagaacatcaagagccactgttcatggcagcgtgcttgtcatgagtgaggcatgtgtgtgccaggcacatcctcccatctaatccccacacagcctgtgagggagggacagccatccctgccttctcaaggggtaattctggctcacaggatatcgtctatgagaaccagaaggaaataatattttctagatacaatcagcacagtttccaaggagacaagactgcttggcttttctcttcaagtgtgcaaagggtcattttccagggactggctgtcagccatcctcctctccccagtgtcagaagtggacatggggttacaatataggacatgaggttacaatacaatccaggaaggacctggatagactggatgaatagagataatggataggtagatgatagagggagagagagacagacaaacatacacacacacacacacacacacacacacacagagagagagatgatagataaaagagacagaaagatacagaaataggtagagatctagatagagtaacagagacagacagacaagtagatagagatgtttacatagagatatagacagatatacagatagagagatagagatggatacagatagacatatagaactagataaatacagatagacagagagaaagagatgaaagagagagtggtttccacagactttgagttctctgatacaagctgacccacacaaatcagagtctcaagatgtcttggagcccaggtagctgaaaggaaaatccaaagattaaggtatcattgctactttgattttactcctgaaaaaaatcaacttatttttactgacatctaatatttacttattgcttactaggtaatttatgtacatcatctcatcttatttttaattagtcattttttaacaggatggaaacctaaagtttagaaattagaaagtaattccccagagttctggaactgacagagccatgattgttcagaactgaagtccttaacctctgcacctattgtctctcagcaaaaaagtacgtagaagactgggaaatgcagtaaataccatctgagcgtttttgctatggtgaattccagaataatgcaagctggacagatgtaatgtatgatcatggaacctggtattgggatatcggggaccttggcccagcttccatctctcagccatatcaccttggacatctgatccctacatccctccagcttctgcatcctctgattccaagctagaatattatagtataaaatatgtggtaggaatttgtcagtgattttgttaccacggtccgtgttaaataagccaaatttgaggatcagcgcctgaaaaataaacacattaaaattgaaaatgacgttcaggcaaatcacagaataataaatacaagaggctaatacacaccaacgaatgttaaaccttaataagaataaaagtcactaatcgaacatgcattttgtccacccatataattggcaattttaatgataatacataagggtttaagaaaataaggacacttatcactaccaattagtacagtctttctagagaacaattttacaatatatatcaaaagcttaaaaaatatgaaagctatttcagcactttagctacatgaaagtttattacagcattgtttatgaatttcaaaaataacaatgacacatgatcccaccactgagagatcatcactttaatattttggtgttaaatgtcctaaattttattctgtgtgtacacacacacacatacacacacacacttaaaattattaatgggatacattggctatactattttaacctgccttttgccttaacaatatacaatgaatggatgtgttataatttgtttaataccttatcattgggcatttgggttttaaccattttttgtactataaataacacaatgctgtatatcctcatagctaatcctgagtgaatttgtgcgtgctctttgcctatagttattttcaaagagcaagagcatgtgcaggacaccagcctggcacttcacatgacccacccgcccctacttcctaagggcaggacttccaggctggtagatggaaccttaatctagaatattttcctgtgtcattctttgtaagctggacccatcaaggagttgctatgttgtatggaggtctttcctccatcaaaaattcaggcattttaaaactccccatctaaaagtaaagtttgatacgagctatatagcacagatgaaccttgaggacattatgctaaattaaataagccagtcacaaaaagaccaatactgtatgattccacttatatccagagaagatatccagagtagttaaatccagagattcatccagagttaaatccagagaagagagaaagtagaatggtagttgccaggggctggggaaggaggggaatggagaattgtttagtggatatagagattatgttttcttttctttttcttttctttttttttttttttttttgagacagagtcttgctctgtcaccctggctggagtgcagtggcacgatctcggttcactgcaacctctgcctcccaggttcaagtgattctcctgcctcagcctcctgagtagctgggattacatgcgtgcgccaccacacctggctaattttttatgtttttggtagagatggggtttcaccatgttggcaaggctggtctcgaactcctgacctcaagtgatccacccaccttggcctcccaaagtgctgggattacaggcatgagccaccatgcccagccagtgtttccattttctaaggtgaacggacttctgaagatgggtggtggtgatgtttgcacagcaatgtgatggcacttcacactcctgaactgcacacttaaaataattaggacggtaaattttatgttatatatagtttaccaaaattaaaacaaaaaaactccccattcaggacctgaaaatagcttttatttttttttgtcatccttggtttatagatgtttgaactctgtatgtgcagtattagaaggtttgattttgtgtcttattatgtgaaactctgtgaaacctaatactggttgttttattctattggaagaaacctgtcaccaggatcagattaactgtgagctcaaggtgctataaaaacaaacgtctcattgtaccagaagagttcaagtccctggggagcatgtttgtagctttttagcctatagaaacaaacagctgggagtatacatagccttctcccagaaaaaaactggaaagaaagtagctcagggaggcatttgtgggagttctactgaccatggaggtcctgaatttaaaccttctgttagaattgcaaggaagtggagcatttattcattaatttgttcactccctgcaaacactgtctgtgctttcttcacaagatagccaactcttacatcttcacacagccaacatcactggcccccctgatcaaagccagcatcttttctcacctggattattgcactagtcttccggccaatgcccctacttttctcctggccctactatcctttattttccatacaataaccaactttgttaaaatgcaagtcagattccctacttttccattcaaatctctccagtgacttcctgtttcccttggacaaaaacataaaattgcaaatattgcatgtgttcaatacatactcattgaatccataaaaggatgcatgttaattgagtgcttattaatcatcagaaactgagccagatgtttctttataggggtacaaagacaaatgacattctttcctctctgggagtttatattctagaatatgagatgaactcacagatgaatacatacaaaaataatgttatttttccctagttaaagtctgagtaaagataatttgggctcaaacaatggaatggccagttttacccgggtggggagagaggccaagggagagggaattcttgagtattataaaatagtagagattccagcgtgataaggaatgtgtagaggcattccagggcaggagaaccacatgagcaaaggcacgaggtgtggattcatctccaaggagcagggagtgtttcaatgagtgtgggaacatagaatatgggatagggcatagaggccaaaggttaggaagaaaggttaaaactaaaagttttaaacttaaatgccttcatttgcattgattgactttactgttttgtcttctaggcagtggggagtcattgaggtttgggtgatggaaattggattcaatgtatgtcacagacaggtcacactagaagcaatgggaagaatccattagcgttttcaaagtcaatcaataaatagtaagaactagcatttactgaatgcttactatctattaataccaagctctgtgctgagtccttcacttttattacatttaattctcaggtcaacctatgtgattggtactgtgattttccccctttaaagatggacatattaaggcagagagattttaagcccaaagtcataccattagtagattaaagaaccaaaatagaaacccaaagaatctgactttagtaaagggagaggaaaagaaatatattaaagagataaaagctccagaatatagttaccagatgtaagtagtaaaggccgaaaatgccccctagatttagcttaatggatggacaacttaatggatggaagtgtctccccagtatagcaaatgggacaaatttagaaagaagtctaacaaggtgttttgaatatgtttgcttttatatgattgcaggaaatctggaaagtagatggggacatgggtttgaatctcaggtgagggttggagtttgagatgcagacttggaaatcattaaacaggggaggagaagtcatggagtgaacaagatcaaacactgatagaaaagtgttagggttgaatcgtgtcctcccttacagatactgaagtcctaacctcatacctgtgaatgtgaccttattttggaaatagaataagatctttgtcatgatcaagtgaagatgagatcattggggtgactcctaatcagtatgactgtgtagttatataaagaagaaatttagacacagaaacagacacacacacagggagaatgccctgtgaagaagacagaaattgggatgatgcctctacaagctgaggaatgccaaagattgccagcaaaccaccagaaactactgaagggtggcatgcaacagatgcttccttacagacttcaggaggaatgaactctgatgacaccctgatttcagacttccagtcttcagaaccgtgagataataaatttctgtgatttaaaccacagtctgtcacactctgttaaagcagctctaggaaactaatacaaacaggttgcatattcatggagtattcaaggatgattggtgatgatcgaatggagactatttattcaaaaatgtgcctggcagtcagagaatcaggaaaggctattccagggctattccaagcataagcatgtgaacagccatggaggtagaagaaaggaaacaccagcagttggcactgagctcatcacaagctgcagccgtgcagcggtgggagaaagagatctgcccatgaaagtccctgtaaagtgcacgatagcaagcttcaccttagagttcatacagagcagccaaaggttcaagggaatgattaaagccattttgtgttttaaaatggtatgttctgcaaatatggtgacaatggcaacatcattctttagtctaccaaaattatcgaattaaaataggcagagcaactaggttgataaaactgaagaattgtggatgataaaacagtgttgagatacccccataattacctagagacaaattagtgacaacatgtaagagccaatgtgatatcaaaaccatgcaggagaaagcagagggaagaccttgagaaccagatactccctgagaagtgccctgaaccaagctcagagtaggaggagagatatggagggagggtgttctcaatgatccaatgcaggggtgagtccaaggaggccacagtgcaaccaaatctgatgctactggagcaggctgggtcctttaatcccattaactaagaaactgaaggcctttcccaaacaagcctccatactgaggagaatctgctgggaatagattccaaactgagtaggacagggacaaccgcaaaagatgagagagaatgtccaaataaaaggggggaggagcagaggcagctgatagcagaaagtaacaagtgattctgtttaccacttcatgagaacaccagaagagtgtgttagagctgtaaaaccagctcagctatcctggcccactcatccctcctaaaagtataggaaactaaattaacttttaaaacttagcaacaagaaaattatcaattattacaatgaaaagaaagtaagaaaactaatgatgtttctatagacaatgaaacaaaaaaaaaacacacatgcacaaaatggataaaaatcataagcaaatacctctaaatgagctgaaagaaaattttaaaattgtaaaagctatgaagaacaatataaatcagaattagaaaaattcataaaagaaataagtagaaaaaagtaatatttgacacaaaggatgatggataggactcatcagtatagaattttttttttttttttgagatggagtttcattcttgttgcccaggatggagcgcaatgacatgatctcggctcactgcaacctccgcctcctgggttcaagtgattctcccgtctcagcctcccaagtagctgggattacaggcatgtgccaccacacccagctaatttttgtatttttagtagagagggggtttcatcatattggtcaggctggtcttgaactcctgacctcaggtggtccgcccacctcagcctcccaaagtgctgggattacaggtgtgagccaccatgcccagcctagaattttatatttaaaaaaaaaagcaggacagacatgaaaactcaactggaagggatatggcactatacacacaccacagtgagaagatgaatagaagacggagaggaggaaaaatcaagaagaaatttgagattagaaggattcaaaagaaactgttagacacagaataaagcagatatagcatatataatcaagaggaggcatccaagaagaaagacaaagcaatggattagaaaaaatactgaatgctatcattcaagaaaaattaaaactacacatggaaacctgaagctatataatgaagatacatatcacattcttcagaaaatggatgcagaacagccgatatcaaggtacattctaataaaaccatagatctctaaaaagaaacaaaatatgcttgggacttcaaagcaaaaagatcaagtagcttataagagaatgaatgtcagatttctatcagacttttccataagaacactaggctagtaaacaacgaaatgacagatttaaagggctcaaataaataaatggcagatcttgggccttgcatggaatatgcatgaattctatatccatccaacctaagctttcggtgaaaagcttgcctggattttctgcacctgcacttccttgctgtatctctgctatccttcgctcttggcatctgagaatctttgcactaggtaaatgcagttcattcacagactctaaaagtaggtaccaatctccaactaaaactgtgaaacttttgggtctgtgtaaccaaaagaacctatactcacccaaggcaagattgagaactacatactgttataaatatgcaagagctcaggaaatattatccctatgtacctttcttgagggatctaccagacagcaagctccagacaaccaaatactgtagagacattggcaagagagctggagaagtattctaacaagtaagtaaagaaggatgatggactctgaatatcaccattttgcaaccttgattgcaatatcatcagtatatggtaagatcataaaatagaacaactaattctgatgtgcttcctgatgaaagtacacaatatcacctgccaaaagcagtcgaacttgaagctgatcaaaattctaacactaattacccatttgcagaaaacacaaaggatagatatgttaaccacaccatgcaaatacaatcattaaaatcaagacaaagaaaatatgcaagaaatttaaaaggacatggaaggataatccatgttgtaaaaaagacttaagatacatatcaaataatcatcttatgtggatcctgtttggactgcatttcaaacaaacttaaaaaattgtgataatcaggaaaatatgaacattgagtatttgatactgttaagaaattactatatttgtaaatgtgatcacaatattggttttaaaattattttaaataaaatacttatagatgaaataatgtgatgcccggggtttgctttaaaataatttggtgacaggacgtaagtggaggtgcaaataaaaaagattggcaatatgttgataactccagttgacccttgaacaatacaagtttgaactgtgcaggtctacttacaggcaaattttattccatctctaccaaccctgagacagcaaaaccaacccctcctcttcctcctcagcctattcaatgtaaagatgatgacgatgaaggcatttatgatccacttcaacttaatagatagttaataattttcttttccttatgattttaatattttcttttctctttattataggaatacagtatataatgcatatagaaaatatgtgttgatagactgtttatgttatcagtaaggcttccaatcaactataggctattagtgaagtggagagtcaaaaattatatgcagattttcaactacattgatatcccaaccctcattgttcaaggatcaactgtacttacactgagtgaaagggtatagtggatgcattactttatttttttctccttttgtatatgttgggaatttgcaataataaaaagtgattttttaaggcataagaaggtttatatgcacatatattttggtatttcaggctttcattctgtcctaggagaaatcccctcatgaacaccgttaagcacataaagaaactgacaaaaaagaatgtatgtagatctttaaagtagcaaacccattctccacctgaatttccaccacattccacctcacgcttcttcatattgcaattgagcagaaggtctttatgaggactaaaattgcagtgacttctcaaagtgagcatttacaaatatgggtactcttaagcagttaactttggactttaactcataagcccccgaggtaattgtttcttgtgcttgcttgcatatggtggcttgcagaaaagaacaaccctggagtttgaattataaactatcatcactcatctctttcttattctccatgttttctttctagatatttccacacaatatacttaggtattcgaagccgacagagtggggagaatgacagatggaggttttactggaaaatggtatatgagtatgcggatgtgagtatgctgcatttgctagccacctttctggaaagtgctccacagctggtcctgcagctctgcattatcgtacagactcatagcttacaggccctccaaggtaagggcttgcaatttggtttctgaatttggggaaagattgactggctacttttgtcacaatccgaggaactgtcctaatgccctttgttgacacaggcctgtgatgtgtctgctgttttacatgtgtttcgtgaatgatgcatgatgttttcctaccattgcttctcatgactgattaattgaaagacagcgcatttttgctctccagctgtcctcttagtaggaaaaaaaaaatctttatgattttacacttggtcgatgtggggatagagtcagtcaactgaggctttctggtttttataatggtataatttccaaaagttgcaaagaaagcagtaactctctctctctgtctctaatatacatatgtgtgtatgcatgtatgtgtgtgtgtatatatggtattagagtaattcctactatttccttttgatgttgagagagagagagagacaatgagaaaaaggagattaaaaggaaatggtacagattaccctaatatttaaagaaagaaggtcataaaggaaaaaaaaaatttgtgaatgtttattaatatttatatactatgaagttttataaaacggatattattatcagattaatatctttgtgctttctcatatttgatgatctcatcagtaggactattccagttacagcagagctgccaggcatttctttaaagcctgctgctcaaatcctttctagaataaggcagcaagaagattagacagactggtgggtaagcaggtgaatacatgggcacatggatgatggataagagggcattttctaaggaaagcatttcctattaatttgtcaatcctgtaactaaatagatgctgttacacagttaacgtattgtaaggtgctcgttttgtttggatctcagcagggcctctgtgcgcccctctgggcacatgctgctcccttgtgctgggtcatgctccaatttgagttttgttctggttggtccggggaatctcctcactgtccttataactttttatggcatggagcatgctagtttaagctgagtgctttaatttgggggacagaatcagggtgcatgttacctgtataggaaaaggaagagaaaatgtgtattggtagctggtgacccatttattcatagattcctggcccaaccctagtttcacactagaatagctttggtccaagaagtttgagaagaaggtcaaagagatccacaatgtatgtttctcaattgctagacagcaaattggaggaagaggaaagtggagtctttgcacagaaaaagagaaaagcacggagaaggcagaaggccgtgtgaattagttgtggatgactgtttttcgttgcgtctggtggttgaagaccatgagctgggcatgcagaggcctgggctctggctgtctcactacctcactataaaacctctcacagccacttaatctctctgggccccaggttgctcaaatgtaaaggtcgcaagttaaactggatgatttccaaactccctgacagctctattctatctttgaatcaatgaattcccaataggcatataatgccaggtatatgttttaggaaatgatctgtaaaccagaatacaaatgaaattgaaaggcaacatcaaactaaatctctgtcatgaatttagtgctcatctccagaacaacttggcaactccttagtataattatacaattgggaactctctagagggagaaaatccaggagcacacgtggagggttgcaagtcaccttctggtggcctgaggtcactgagtatctctactagttttctaaaagatttggaaaattatggagagatttttcttccaaagatgatggagatagagaagggaaggtgagagagggatctgagaaaatgaggtcacattttcagtttaaggacgatacataaaattgtacagaaaaaaaaaatgaggaaaatgcaatccttagtcttcatcagattatttatcctaaacataggaaccaagagttaagttgcgttttttgagtctttggctctttcctcacatctagtgtccccagctaaccgattaagcttgacacatatacgtcaggtgtaccacaggcgttgaatgccagacctcgtccttagccaaggcaagccttgctgtcaagtttcagaatggcgtagggaaactaggttctgtttcactccaaaggtggccaaaagacaggttgatccaaatatcactaagaatcaatgcaagtcattgagtcaagaggaggaataagcccactatgttgatcttattgctactgattttttaacaaggcaggtgggtagatggttgtgttacaaaacaaagagtgaaaatatctgacagtaaaaaacgacagaccctccagccaacgaagaccagcccaggcaacactctgtgattccttttgcattttgaagagaaacctgaaacctgtcttcagagggacagcttctaaatacccctctgctgatagatgatcccacttacaaacaaaccagctgataaattaaattgatgtgagttctaagaacagagctgttcccctttaggaaaagaaaaataaatgtgataacctagtttgacatgtattttcatacatcttcaatggttaaataaaattattgggatttacatgtgaaaacacagccctctgctatgaatgtaaataatcaataggcatgaaatctgtaaaggatttgcagatagctgtgaatcaaaatatctaaaacattcttatttagcagggagagaatggtcactctgtatgtgactgtctaaaattactattttttaggatagaaggaaaattgatctttaaacccaatttcaaccatccaccactctctgcagtgcttttaaaaaataagaaaaatcagacaagaaatatgacattttataactgttattaggtattgtattctcttcgtggaagctgggtagccctagaacactgtcagctgcttctccttccttatgtagtcactcagtcagaggagcctcctcatgctggaggctgacaggcccagggagaactgttggagcataattgtttctccatttgcactggcccaagaggcacagtttggcatctgttcagagagcaggaatcagggcaaagctgagtctcaaacctgaatatgcagctcttcacgctccacagtcacattggacatattacagggcagcagctactctccacgggatctgggatgtcccagagccagctccccgcggagtataagatacacaccaggaggcccgactgcatgcacggctgtacctgcacaggtagtgctcactgtacttccagagagtttccagtttacaggtcgttatggttttccaatcccaatcccttatcctcactaggagagaggcggagaggggagagggacgttgagagggggagaggagggcaggcaggaaggaaagtgggatggggagaaggagggagggagaccccactcgaccgcggagatggaccatggcatttctgttagtgtccacatggagggtgctgctctctacctgtttagtgagggtgccaaagatgctgaggaagatgtggtccgaggcctgtcagttgtatcttccagcaaaatctcactcattcgtttcacctcatttctactgtgctaccctggccggaccatgtgcactcccacccagacccctgtggatagcccacagcttcatcctcacccgtgccctcttccttcccttctccttggagcagtcctagagccgcttagactctaatctaaactacttcagtgttccccttggcactcattaaaattaaacaagattcctgagcaagttccaaggcctttgtgtcacagccttctcctcattagtcactgctctgcaaccacgctgcgctcctctctgttctgaaaatgttcccatttctctcccacctccaggcctttgcacctgctattaacctctccagaatattctcgtcccctcactcttagcctgtctagttcttactcgtcctgcagaattcagtttaacctcctcagagtatccggtcctaactgctcgttcacatttttatttccacattagtatttcctcaaggtgtcctgaacttcagcccctgatctcaggcaattttcttatcgttgttaagcctcaatttgcccatgaatactgagggataataatagtgctaattcataggattgtagagattaaatgagagagtacacacaaaggattcggcagacccttggcccattgcatagggcttcttaggcttgatcttgcagaaatctaccagggaatcttatggaaaagcaaattctcactgagtaggtctcaggtggggcctgagttttagaacagggaaataacaggtgaagaatttgaggcatgtgaaaacgggaaaaatagttcaaatttgagctcatgaaccctgaattaaggggtgtgtgttagaaaggaagtgcaagaaacatcgtgaagagagaatggtcaggtcttttgacagacagagcatggaccaaaagagaccgaagcttgagtccatttgactgagagagaacctggtgacaataaaatcaagcaggtcagcaggagcagccacttagggggagagcattttagacattttaagcctgaaatggtggaggacaatcaagttaaaaagtcttgagactgcagaaacaaagacagcttaagataagtcacccagaatttcagacctccatgtctgtctaaatgacgccagcaaaggtagaaggttcatggtcagagttaccccatctggacttttcaatgaccccaagaacctgtaaaatgagcagtcagttttagttttgtgattgtcatattatgaatagtttattttggttgcacagacccagcctcccatgataggcagagaaaataccagttcatgtacagacaactgtccacagccttcctcagcaatacagccttgctgtatcagagctccctggggtcaaagggtgtgctccccagagcagcccagaacaccatgtagaatcacggcacatagcggatgctctcaatgagggtgtataaaccacagcccaggctaagtacagcacagtcacctggctgcacaggggaaacattgtgcggaaataatgcttccttgtagaggaaccatctaagtaaaacaaacaaacaaatatctggccttcactagatgaattgtttgagtgccaatccaccaacctaaatgtttccactttttccagaaggctttagttctttgtttcccattgctaccttatcactaatggaaaatctcatcctacaccctaagtgtatttagctggggtgtgctgagtgagttaccaacaaatgccgtcccacaggccatgtgcccaggaaagctttactgaacaaaaacgaaaaacaccgacttctcattccttcatattctagaagaatatgaaaaaaactccttttgccaacagtttatcctgaatacttcgtgaaaggaaaagggaaacagggagctggaaggggtttctaattattcctctcctgtcttgcatcctatgaggctccacaggaagtcagaagtaaagttgtcctcaaatatccggcaaacactgttacctgctaactagggtaaccaagaaatacctgaattgtgaaaaacacctcatttgtcctctcctgttgagcactcttgagacctaacactggcttgcaacttgccccacctcatcgcgaagcaggtggagacaggtcccagcctgtctccagccgcatttaaatgacctgggttagagaaaatcccagtcacccctgtgcccaacgccttcctcctttgccccgtaccactgtcttctaatgtgcttgcccctacctctggattctgcagagggggaagagtgcaggcgagagtgccagtctgtgaggggtctaggctccaggtccctctggatctgcctactctgcagttgctattatcgtagttaattaaaacatttattgaaagcttgtttgtgcatgatggtgtgtgaagctctgtgcaacatttgtactaaagaagttcactttttactaaaagtttataatgtgacgctataaacaacacgacagaacatatttagaaacacccatttatctgggtgcattccagactgagtggtgccattttgtagaaggatcaataatttggtttaattaggttaattagtttaaaatgagaggggggcttacagcacttccagctcacctgctccgggaaggggccaggcagcctctgcctgagcagccgtgtgtccattgtcagacagttctgatggactgaatcacacagttccgatcagacagttctgacgtccttaatggtactggaaggagcaggaaggcagcatcaaggacatctggtcccctcctctatctgacgcgcgagtctttgctcaaatccaactttgcccagcacattccacccccgggcccaccgcctcagctggaaggatgctcatcatcgcgagactcctacgggatgagccctcctctccagctctgctcaggccacgccctgctccttctgtagcgtgttctccccgatgcccctcaggacactgaatattcatgccaagcaggttgcttttagtccccaggcagggttgtctgaagttgagctatgcattctgccagagtcaagctggtgtctgaaactgtttttctcaatgtccttcttattgttcgtttggttggctgggtttttgttttgttttgttttgttttgttggggttttttttgttttctgagacagagtcttgctctgttgcttaggctggaatgcagtggtgcgatcttggctcactgcaacctctgcctcccgaattcaatcaattctcctgcctcagcctcctgagtagctggaattacaggcccccgccaccacgcccgactaattttgtatttttagtagagatgggatttctccatgttggccaggctggtctcctgacctctggtaatctgcccacctcggccacccaaagtgctgggattacaggcgtgagccaccacacccgaccaatttgtcctttttattgtaaacttaggtttgcattacataatttagttaggttaattagtttaacttagtttaattagtattattaatagataaactgatgaaatatagtgtgaaagagagttgtttctatgaaatttatgttgacagcttttgaaaacttgggtaggaccagggcaaagtggtgtgtttaatccagttgcatcacagcctcaggacccctgggaggaccttttggctgccctgggatgtggagcatgaggctgcagccggctccactcttccgcagcctgctgtgcgcgctggctgccgctggcccttcacgcacgacgttcactagggtggcacgcacagtcttccagtgggtccaaaccactgagctttgttgtagtatggcagatcattagctgctggattttgctttttgtgatgatgtatcaagtagcataccaccccagaccaggaaagtagaacatgttagataattttaaagaagggggctggacgcggtgactcacgcctgtaatcccagcactttgggaggccaaggcgggcggatcacctgaggttgggagttcgagaacaccctgaccaacgtggagaaaccccggctctactaaaattacaaaaaaattagccgggcatggtggcgcatgcctgtaatcccagctacttgggaggctgaggcaggagaatcgcttgaacccgggaggcggaggttgcggtgggccgagatcacaccattgcactccagcctgggcaacaagagtgaaacttcgtctcaaaaaaaaaaaaaaaaaaaagggatttagatcgaggaatgggcggcacaggtgctgggagggtgagaggatgaaaagtgatgctcatgaaatcaggagattcgtaactgaaggaagaagctcttatctgtagggctagaggactgaaggaagagggctcagacctctagggaagggtactgcctgaggagtgctgggtgacagaaggggtgcaacctcgcagctgtggggacagccatggagccagccaggcagcgagggagtggggcgcacctggaacattccggctgcggagggcacaggccggctgctgctgcctcccctgggctgggacgaggctggggccaggaatgccaaaagcagcggctggctggagacaggcgctgtggaggcccagtgataataggatgctgatatgcagaggaaaccagaaagtctcttctcctctcctcctaccttccaacctcccaccagtgccacctattggcagaacccaccgggcagccagccagtcagggagtccagaacagggtctgcagagtcccccctttcgggtggagggagctggcacacacttcccattctgttttgtgacttgcgtctgctcccagctgagaaacttgataacgaagcttgttaaagctatttctgagtaacagttggaggtgaaggcctgaaaggctatggtatgagacaaaagcaggcgctctagatcatggaggttgtgtcatgaaaacgcccaggcagccgagtctggcaactgacatgtccttccttaaatgcgtgaccacagacctcacgtggccactcaaccttgtccagcaagcctaccttatgtcccccttgaaattccgtttcctgctccaaaatgaactgcttcctactttctctggtggcctcatattccaatggtctgactccagtattcttaacctgatttcagtaagaaaatagaggcaataaaacaagagctattttattttctcacccatatgtcctgcctttcctctgagaatatgctggctcccagctaaagtccttctcttctaccctggagtccactaccacctgctcaatcaccctgttcttggaattaccctctctctccctattctgcattatcagtttttcctcactcctgcatcactgccatcatcacacaaacaaacatgctgtaatcaagaaaacatggacccacgccaccacccactaccacattactttcttgctcttcacaaactgcttgaaaaattcatcttatcctctgtctcctcttcctcacttcctatcctctgtttttgtttcctaatttttaaacattgttttcaagtgtaacatagatacagaaaagtacacagttgtgagaaactactcccaaggtcaaaggaagagcgttttcagcatcacagaagccctgctcttaccccctccttccctgtgtgcccaccgttctacatgtgatcactatttgaaaaaattagttttgcaagtttttgacctttatataaatagaaacatacattattgtgtgtgtgtgtgtgtgtgtttctggattctttcattcagtgttgtgcttgtgagatatgattccacgtaactgtaacccattcatttcattgctctacaataatttattgtaagaataaatctctgtccattttgtggttgttgatgtacactggtttgttttcagcttaggagtaatatggttaatgttactattgaatatttttaatgtgtctttaatacatgtgcacacctattacttctgggttcatacctaagagtgaaattgctgagtcatggggtacagacagacacactgaatgtgagtagatgatgccaaagagttttccaaagtgctgggaccaatttatattcctaccagcagtgtgtgtcttgagattgctccaaatccactccaaaacgtggcattttgagtcctctgaattttacccatgggttagtatctcaacgtgactttaatttgcatctcctgataataatcaaactgaaaagtatctttcattcttctttttcctcacccccgatccagtccatcagcaagtcctgtgtgctccacctccaaaacacatcccaaatccgaccaccctttgctgcctccgctgataacactctctccaaacaccagctcagttacccttctccagtgaactggtaccccccttcaccttttcccacagcctacttgccacacagcagccatagcgatgcgttttgttttgtttttgtttttgttttttgtttttttgagacagagtctcactttgtcacccaggctggagtgcagtggcacaatctcggctcactgcaacctctgcctcccaggttcaagcgattcccgtgcctcagcctcccaagtagctgagactacaggcacacaccaccacacccagctaatttttgtatttttagtaaagacggtgtttcaccatgttggccaggctggtcttgaactcccgacctcaggtgatccacccgcctcccaaagtgctgggattacaggtgtgagccatggtgcctggcccacaatgatctttctatcacttcactgctctcgttaaaactccctggggacttcttgctgcaattaaatgaagtacaaactggtgacaggcatgtgacaaggcccctgctgtggagcctccaagtctccccactctcccactggctcgtgtgagtcctgcagctctggctggccgtcctctgtctctgagacaggccctggctgctgccccatcaaggaccctgcatttgctggaccattgccctttcactctcccaggtcttcacatagctcatccctttccaatcaggatggggctccaacatcactcctaaaacacacagctctcccccttcccacagacgcccccatctacttactctgcgtgattttctctttggacttctgaaattctattcatccctatgttttattattattctcatcacctttactagagtgtgagcaccatgaagcaagaagtataggaaaaggcctataacatggaaggcactcaaaagtcctctgactgaagaatgctgacagatttttaccatcttcagaagctacttcagtttgtattggcttttcagttggactagccaatacagactgctcacaagttcctgtggaatgtcacagtgttattttacataaaggaaaggacacaatataagttcccctccttcaaatgctgtatttgtaaaacttttacatatttggaatttttaaaatatttacttttattccctattacacatattattaaagataaaatagaaaacccaagtatgcatgaaggagaaggtataaatcaccttcctgccactcagaaatgaaaatcttggctggttatggtggctcacacctataatcctagcactttgggagtccaaggcaggaggattgcttgaggccaggagtttgagaccagcctgagcaacacagcaagaccccatctctacaaaagagaaaagaaattagccaggtgtggtggtgcattcatgtagtcccagttacttgagaggctaaggtgggaggatcccttgaagctgcagtgagctgagagcatgccactgcactccagcctagggcacaagcatgatgctgagaaaggaaagggaagggaagggaaggggaggggaggggaggggaggggaggggaggggagggaaaggaagggaagggaaaggaagggaagggaagggaaaggaggaacgggagggaaagggagaggaggggaggacagagagagagaaagaaaagaaaagaaagaaaagggaaggagagggaaggaaggagaaagagagagagaaagaaagggaaggaagggagggagggagggagggagggaaagagaataaaaatcttgcccctaagaaataattaagaattatattttgttgcttatctgtgtaaacttatttaatgttttaatatatattacattaaaatagaatcaatattggataccagtttgtgtccttttttaataatacatcacaaacatatattcataataatatatatagttcttcatttttaatgaccacataacataccaatatatggattatccttttctttttgagtcattttctacttctgaaaccataagttattatatatatttgctataataaataatgctatgataaacactttaagaactaaatctcagctagcttcagtggcacacgtctgcagtcccagctactcaggaggctgaggcaggaggattacttgagccacagagttcaaggctacagtgagctatgattgtaccagtgtactccagtctgggtgaaagagcgagacccccatctgtaggaaaaacaacaacaacaacaacaacactaaatctttgcagcaagccttaattatttcttaaaaataaatagctaaaagtggaactgctggattcaaaggcaagcaggctttcaaagttttttattatataatgtcaaattggtcattttgatgactatgaagagctctgtaacatctcaagtttctgacacaaatgctcaggaagtcagtgaggtcaataaaggtgacaaaggctgagaatggggcaaatccgttgagatttaggaaagagctcttaatagtgccccatctgaatgtaaagggcataattctcagaagtgttctaatttcttcccttgttactttattgtatccaccttcataataagctttattaaatctattaagtagcagtagttcattagtaatgaaacaaaattgtaagagcagcttcatcttcatcagagacttgatttgaaccaaaattataaggagagtagacataagctcctcaaaacacttcccaaaagtctgaccaatgagaagttgtgaagagccaaacttataaaaattaggagcagcagcccctacataggagagttgtgatttttttctttgtctttctaaatatattacatttatccaatagcacttagtgctaagccctcagggtataaaagaaagatgacagctcctccctgccaggagctggaaaattccgtcgagatgcaaaaacaagcgtggcagcatgatgggggcagcactccagggcacttgcacattccttcccaacacagtggaaccaccatactcagcacagagcaggcgatcctgggtgtttgttgaatagaagcaagaatggacgcctggtatgtgacaaagccctatgctaggcaagacagatacaaagacacagccccctgctctccaaaatttcagtctaatggaaaagagagaccaaaaccttattagaagtcaatgtgctgtgtcctagtggtggtcactttgaggtcctttggtgacacagagcaatctcgtatgcaaaatggtacaagggaagtagcaatgccatgctattgatgtttgaaggaggaggacatcagggagtgtagaatcaggaaagtttttgtgaaaatagtggctttgagctgggccacaaattatgcccaatactttgtcaggaaaaatgatattctgtaaggaaaagatagcaatgtgaacaaaaccagactggggatgccatatgtgcccgtgtctgtgcagcaatgctggtgatcagtctccacaaagcaatggaattgctgatgttattggcagcacgtaattagatttattcccaacacttgaaagaggtgttgggtatcagagtaaatccttgcatatatacttttaaagtaccacaacctattttcctgtatttctgacttttgagtctgtctttgcattgttcaatacttgggatacttgggaatatcagtaaatagatcaataaaatagtaaaccactagtctgcttaatcaatacatttatggagttcaattttaaagactcatcaccaacaacttcataaggaaagaatcacaaaactcactggtgtgttggccatatggctccactttatttaaaagtactggcagaataaatgatggttgtcgtggaggtaatgatattattgatctctttatttcacattcagtagtctcttgagtcatggtaccaccccaagttatacttagaagaacagaaagaagtttcttctacttatcattgattcaagtgcttgaaatcagctctatggtatatcaacccccagcacagctgtgaatagctttgaagttgaatcattttgaacataatatgaaataaggggcctgactatttttaggttctacttaattatctccaataatcaagcacaaatcttggtatttttccactcagtatttctcctctctcctgcctctccttccctctgaggtgtggtgagcacacagacatgttcaggcacagggagaggagcggggtcatggatgtggtggacagtgtaattagtcacgtgctatggctatgggaagaggagagctggaggaaagatctagagcagtcagttcaatcctgtttggaacaaagaagcatcaataaggagctgtctgcaaggaatggtgccccaaacactggctgcttgttggcctttcctgtggtgtcttcatttgccaacctctaacctccccaaatttcagtaatgtgttagcacttcacaccttagaggaaacagaagcccacatttatctgccattcacctgacctttagccagtgtgggaacttagagctgacgtttgctttgactgaatatcaacacactgtaattattatttctaaacactaaaaataaccatgtgaatggtaatcagaatgcttgctgagcaaggacaaaaggaaagacgggtaaggtcaacttaataaaaaattcaaaagtgttttactatggtactttcccagatagcttttttttttttttttctagaaagccacagacagttataggatcaggattttgtggcccaatttggattgggtaggtgggtgggtaagggaagctcccacaacctcttaaatagttttcacatcatgatgtgtatattctagggtataaatatattttgcatttattcagcagattgctattagactgattttaaaagtattcctcagagaggtaagctaatattttcttgatgactcagcagaacttaaaaaccaggatcacttcctactgagggattttaaaacagcttttttccccccagggtactgctcatacacaggagggtatatgtgtggaatagagacagccctgcaaactgtcagagcagatgcaagggggttgggaaggagaagctgattcaattggtatgtaaacgtttgttaggataaaatcacatggagattcactcttcaaagctcacaatgagccctgattgcagaaggacagggcctgctgagctctgcctggctaaggttttgtcagcactttcattgtgatcttaaatttccacagctcataactcagctgtagaaaaagtctcagagactacaagactaacaagactcgaaaactacaaaaacttttggggttttttttagatggagactcaccctgtcgtctagtcgggagtacagtggcgcgatcttggctcactgcacccgccacctccggggttcaagggattctcctgcctcagcctcctgagtagctgggattacaggcatgcaccaccacacccagctaatgtttgtatttttagtagagatggggtttcaccatgttggccaggctggtctcaaactcctgacctcaagtgatctacccgccttggcctcccaaagtactaggattacaggcatgaaccaccgcacctggccaacactccaaaaatattttaaacatccatagtattaccggttcaaatgcttgggcaatttgatggggcatgaacttccctacactagggttgaaaagtgggagtttccagcatagagccttcaatgaaggggcacctccagatatttgttatctaaaacattgagttaaaattcatattttaaaaaatctaaaatatatcctctatgatgtcaatggaaaacaggtatttttaacaaagacttttggaataaatggtagaataagtaattgcaaaacactttgtcacatctttttaaagaaatcaacacagaaaagctgttacaaaaactatgtgaagtaagttttatttttttttttaatgttttgtgaacacaggagatctctctttcaaattcagtttggccaggaagtttgatagcaaagggagtgagtattgaacctttcagaatgagtgcagtgatttcaagtgtacaaatgcttggaggggagatcagataagagcaggtcaggaagtcggagaagtgcgaggtctcttactcaggccaagtgcggtagcacagccaaaccaggaacaggagggaatgatgtgaacttgatcctgaaacccaagggtcctgaaaaatcactccttgttctcatccagctacacacctcccaaagacaggctgcagtgtcttcatcaagacctgaaggaaatcttcattatttagtgtatattacaaaatataataatgtatcacattattacgataaacatgcagtgggcacctatccatggcaggcgctgacttgaatactagaaagtgagcatgactaacaccattcacccttgaagggcttacagcctcataagggggagcagcatatgaataagtgcttaagtggtcctgggtaggcccagaggtcagtggacacccaaagagagaagtgaccggttccacctggagagagtgagagaggatttgcacacactgtacctcaagctgagttgatagttgaagcagggaaaaatagaagagacaacctagggagagctcattggagaaggccaagcgcagaactggtaaagtgaaccaccatttaagggccatagtggagaaagagccagagaagaaaataagagagaggtgggtgtattggaatcatgtctattccttaacagtcctgcaacaggaagagcatggggatggggagtttccaaagaaatgcccttgagggacctgtggagatgagagctgaaaagagcctgatgggtctgacaattcagagaccacaggggcacacagcagaacacatcagtgcgaagtttaggaaataaatgaagaatgcaaattagaggagagggcatcgtggtagcaagggtagaatttctagactataaaggaaagaataaaactagtgaagtggcccagagcacacgttttaggacagagacataaaccgaatgtgactgtggtgatggagctgtgaaaagctggtcatgggagatgcagcaggagcacttttcctgcctcttccagcagtttgcagtaacaagggtgatgcccccagcaaccagcaatgggtggagctgcaaccagggcctgtgctccaagttccatcccaccgggaaaggacctcagtttggaggaattccattgccagtgatctttgctgtcttcacacagcgtgtggccttgagtgtgtgacttcacgacactgagccttggcttttctgattggaaaataattttaaagatctaaattgcagtgttgtgttagaacagaataaaataaacaatgtaaagcacctaagccatctgacaacggagcgtgcaccacctgcccatgtcctcctctggcctcctccttgcctgcctccaatggataaggggaagagcgccctcagcctctgtctaaatttatcagaaaagagttccctcattcacattctgtttctctcctaaatggatgtggaccaatttaaactcgtttcacctaaccttgaggtgaaatgttacctcttcctgcccaaggtcttggtctgggctgagctccttgccctctagagccagagctgactgcacctgctggctcctgtcctctcacccaggctgcccccaaggcctgaaacctcacgaatcttccagcaaacagcacttagactttgctctgtccactcacctatatttttagcacagaatacttttagccttgacatttttgaaaataatatttatgaggaaataagatacattttcttctttttctttttttttttaaatatattttttaagttccagggtacacgtgcaggatgtgcaggtttttatacaggtagcaatgtgtgccatggtggtttgctgcacctgtcaacccatcacctaggtattaagccccgcatgcgttagctcttttccctgatgcgatcccccacaccctcccctaacaggccccagtgtgtgttgttccctgccatgtgtccacgtgttctcattgttcagctcccacttataagtgagaacatgcggtgtttggttttctgttcctatattagtttgttgagaataatggcttccagcttcatccatgaccctacaaaggacacaatctctttcctttttatggctgcatagtattacatggtgtgtatgtaccacattttctctaaccgttctatcattaatgggcatttgggttgattccatgtctttgctattgtgaatagtcctgcagtgaacatacatgtgcatgtatctttgcaatataatgatttatattcctttgggtatatacctagtaatgggattgctgggtaaaatggtatttctggttctaggtctttgaggaatcaccacactgtcttccacatggttgaactaatttacattcccaccaacaacgtaaaagcattcctatttctctgcaacctcaccagtatctgctatttcttgactttttaatcatcatcattctgattggcatgagatagtatctcattgtggtattgatttgcctttctctaatgatcagtgatgttgagctttttttaagtttattggccacatgtatgtctttttttgagaagtgtctgttcatgttctttgcccactttttaatggggttgtttgtttttttcttgtaaatttgcttaagttctttgtagattctggatattagacttttgtcagatggatagacatcaacttcaatccattaaatgtgaaaactaatcttttttctcacaagctcatctgtatcatatgtgtggagatatttcctacagttctgggaaagtataggattcctaaaactggtggccatattttaatgatgttagaggcagtctgcactgagtgcatatcattaattctaataaatgagtcatcaaaagtcattatatttctttctattttctcatctctcaccctctctctctctctctctgtctctctgtctctacctctctctccatacccctctccatacacacacacaaacacacactcacacacacacacacacacacagagagagagagagagacggacccacaaatatacctggtgtaacaggcacagactttctcaagctgtaacacaatatttgcgagttataatgcctgatgacaatggcacttgtccccgccaccaccaccacctggaaaatgaaagaagtctgcaggttgcctcctccagtgagttttgaggctctcaatggaaacttgagtcaaaaaacccttgctggaaatcttgtctccaccacttagtaactttcacctgtggtgcactcctctacttctctgcatctgcttccttatcaaaggagtggggatagtaacccatacctcataggcaggcacctgggagaatttgctgagacaatgtgaagggtggatgctctgtctcatacctgatattggcaggtacccaagaagtatcttttcctctttgtcacatagggaatatttagctctgatgtgttagtacagatttcaaaggaacagaccatttacaatccacagtatctaccttacagccaaggcagcgctagcaaataatctcagaaaatgagtgaggaatacctcactgctttttcccttaaggagcaacaaaagaaagaggaaaagagggaaacaggggagagagaaagggaggaaggaagaaggaaaggaaaggagagaaggaggaaggaaaaaacctgaacaacttgaaataggaaaagtcagagaaaaaccccagaacaccgtgagttggttttgcctgcatgtcgtgaggccaccttgatgttccctcccttgctacttgtaaggacatctataggctgtgcctgcgccttgtgaatacaggagaaaatatgaacagtaatctgatataatcagaccccagaaaggcacttctggaaacactaattagattttcttcaaccttgtttaatttagtgagttctaggagaagatcacacctctcctaacactcataaagagaatttgtgaggaagattgtgtgcgcgtaatacctattcgatgctcgaggcaacctgttgccatagtaccaatcagatgctgtcttcatcgggggaatagaaattaaaagtaacagggcttgagtacaaatgtttttgtttgtccccatgaacagtgtgaatgttgggaaaaggagatctggtcttgttgttattttctggttttgaaacaagactacattaacatgtgtagaatatgaaatagtacaatgaatttagagaaacaaagaattcccaaagaagtgcattattcttataaatttacactatcaaaggatgtggaaatgccaaaaaagcaagttcttaatggtcagagtcagcagtgtcatctcagagccaaagagagctgtcagtggctaataacgtgcaaatgcaagattcgtctgaatgctaactggctatttttattgccttagaattctgatcttatattaagagctataaaatatccattgtgctttggggaacatctgtgcatctgggtctcataataaaagaaatattgaaaatcaagagaggtagcttgctatggagaaaaacaagagtacgattaacatgaaattcaggaaagtggttgcctgtgggaatgaggcggagggaggaagaagtttcatagacattggtaatatttaatttcttaagtggaagggcattttattctgttcaaaactgcacatagaaattgcctatactcacaataaaaacttacataaaaaggtggagagagagacagaaatggagaatgggaagtcaatggacagaaggcagtggattcaagccctgactctatgattctctagctaagggaatgagcgcatgtcttaccttggcagagactcagttttctcatcatctaatattttaatacaaatattaaatggtcccaacacccccttctagcttgaacactagccaactctatgtatatcacatggaatacaatattgccaaatgaatcatgttggggaaatactgtcttttcttcatgtaaaaacaaaaactcccacagtcaccatccagtcatccataacagcttactagctgtgtgtgagttactctcttattccaggtgaaccctcatgagtaaccctgctgttctttgagcagaattttggagcttctttttagaaggaagatatcattaagtcagtgatagggcttacagtctgggggtcagatatcctgctggtggccgggaagaagactccacactcttctctctgtcagctcatcatgtcagctcctctgaatgcaaaatatcaacataatgcactcaagaggcatgtcattatttcttgctcatcaattgtgcatcaaatgctgtcaggtgcttcatagtccatcccccaataccaaaaaattaccaaatttaccaaattacaaaaaaatacctctacttttcaggactaggatactcaccataccaattagaaatgtttcaaagaaatgctctttttagtttgcaacatcaggaagctagaaacatcctctttcctcatgcattcaacgcgtttttgcagaatgcctactgtgggcaagtcccatgctggctaccggtttctacttaatttctcagagcacagacatgagatgtgattacaacaaatgcgctctggggcattgcagcatttcccgggtgctggtgttcacttgttcttcagatttgtatgtccaaggagagcagatagaaccaggctgctgtcaccctgcttctggttttgttgcaggctggggtccagcggaatcaggatgcactttgtttggccccaaccagctcctcactccacccggagcatagggttccagggcatcttcgggtgggtcctggggcagaggccctcccctccagaggctgtgggagaaccgaccatccaggctggtgcaccaagctctgaaaactggaacagatttctcagcctttctgagacttcatttatttctctgaaatgggaaactacctcaagtgttatgagcactgtcaacacttcttatagcttattatgacatcatgcacgttaaggcattgagctcaaagccaggcacttaattctgactcaaaaacacatttgtgcttcctcttcctgttctaacataattaaacacacagtcccgtggcaaagggaaattgcctgtccctgctgtctgaatgctccattggttctgatgagagactgacttgagaaacattggcaacatctgtttctctcaaatatgtgctagcatccttgagaaatcataggttttaggcacacacttaaatgaaggggaataaggttgggcaccaaatgtgctgtggcatcctgggaaaaaaatcagaagaccgaagtcaacaggaagcaaatctgaaagcaattctgccatgtttcctatcataacccccttcaaaaagagtttagtgtaaggagtgcaagagtgcaagacactctcataataaccaaaattatccagcaaagacatgttcattttaaatgttgaaagagaaaggaaacccctcaggaaattaagtttgagttccatgacatctttcttcttatgcagacattgagacaacaacaagaacattcagtctgtttgagctttcagctactgtatttttccatttcattcattcttagttatttttaatgttttcaatttattcagagaactaataagtgatttattatgggaaactaagtagggtttacacccaaatgccaagagagaaactaaattctatccactaagtcaccaaaagaagtgcctcttatcaactcaccctgtgtgtttctaggacaggaacctgctactgatttcgcagatgtatctttgttgtctctagtaactgctctgtgcttagcacctactgttaattcacgcagttgacctataaccaaacactgaaaaggtgatgtatgcatttgataaaagagtcaaactaggtcatctctgaatctcagattgaaagtaagtaaaaccatgtttatttcagtttataaaatgttttattaatactctatcttctttggtggatctaatatttaggtaacagttttcctttaaaacaatttcacatctaagaataaattagatgctgatgcattaaatgtccgcttcaagagacttggcaatatatacattatatatagtcaaaaataaagtcaggaataaaaaatccagatttattggagatgatgaaaagtaattattttcatttcaagatgaaaaaattaaaattaaatatgatgtatttcagatcttagcttttatattttaccattctattgtcgattccaaattattttccttcgcctctttcttttaactgagaaaacttttatctttgttgccaaggcacataatttggaatcaacaaggtgtttaagtttctaaatatgagagatgggatttattagggaaattggctcacacaattatggaggctaaaaggtcccactctaggctgtctgcaagctgaagaaccaggaaagtggacagtgtagctcagccagggccaaaggcctgagaaccttgagggaccattggtgcaagtcctggagttgaaaggccatggaatctggacttttgatgtccgaggggaggagaagggtgtcccagcctcagaaaaggcagtgaattgacctttccactgcctttttgttctatctggacccccagccaattgggtggaagccacccacattgagagcagatctccaccactgagaccatggaccgacgtgctgttctcctccagaaacaccctcatagacataccaggaaataatgctttgccagctatccagatatcccttaattaagtcaagttgccacctaagattatgacatcgcactgtagcatcatttcatagaaacacttccccctctatcacatctctttctatacccacacatggaatgtgtattcttattctcatttcccaaattgagggtgcgggggcactgagatccaggaggttaaatgccaggactaaggggagaggccacatcaggatcagaaagagaccttatgttttgtcttccagttatgttgtgtttctattctaaagcttctcccaaaaaattaaatcttatgcaaattttaaatactacaattaaaggaaagagttatgtttgaaggctttataacattgtaattggagatgcctttgtcaaattttcccattttaaatggccaggaaaaacaataattatttttctgatgctgaggttttatatcttagtagaagaacttaaactatgacttgtattcaagtctaacaggaatagaggtaatgaatgaaagtagtcattgacctgggacaagatcactttgaacatgacactattatacaaagtgtaatatttatttttaaacaaccacttttcaaaagcagttgtgcatacattccaaagaataaaatgctagctactaggttttgagaagcagaataaaatatgatactgaattactgaagggtgataaatttgggccgatatggctgaggtggtttgttttagagtttatagcaataaaggtaatcaggtgattcttaatgttgccagagtactgcagtggaactactaaaggaaggagaaagggagggtatttaaaaagttcagatctttgattctggaaaatctcaactaggtattaattctattgataactgataagcatcttaagggggggaaattcgtctgttaaaaagtctgttacagaaggttgggtggatgcccaaataataccaagctttatcagcttatattctggagagtagttccatttatcaatacttgatttctttttagcatctggtttttttttaactattcaggattttaggtatacggtctcattaatttccaaaatattcttatggataggtgaattacagggagagtccaatgtgtagatatctatgtaccacagacccaggcacatttgggtgagtaaatgaatgaacacatgttcaaactaaaacagactgaggccgggcgtggtgtaatcccagcactttgggaggctgaggcgggtggatcatttgaagttaggagtttgagaccagcctggcccacagtgtgaaaccccgtttctactaaaaatacaaaaattagccgggtgtggtggtgcactcctgtaatcccagctactcagaaggctgaggcaggagaatcgcttgaacctgggaggcagaagttgcagtaagctgagatctcgccactgcactccagcctggatgacagagggagactccgtctcaaaaaataacaatgaaaaatgaataaataaataaaagagactgaaagcacagttgcatttgatgcggcctttgcaaagacctagcctttgatctacctaattacatctctgacctgaagaggtttcttatacatcccaagtctcatgtgcagtttctgattctcagtacatatagcaaagagcaacaggaactgctgggggcctagaagaaggacaaggagaaggagaggaaatcactcagctgagtatacggggaaccgttaagttaatcctggtttaggcattctgattatgtagaagagcaggaatttgggtgtttggcttttaattttttggaatttttaggcaaattcgcattataatttgaaatttgctaaaatgattgacagatattaaatggttaacatttctgaaatgatccaatttttctaataattagaacagtgttctaattgttcatgtattaatttcatttaatcctcccagtggcctttaaagttccattattatcccaatcttatatctgagtctgcttagaagattgggtagatcctttattatcccaatgtcacttataaggaaacagaggtgcagaaaaataacttgtctaaggttataggaagaaaaaggacagaaccaggattcatattcagacaatctggctcccgagacacagcatatgtacccttctacacaatacggcaaatcatgtttactcagaaatagtcccacgttctggcttatattttaatatattattagtaaggggaggcatcaagtgagaatttggaagcttaatctgcaagtctcccttttgagttgtcctaggtatcgtcgcatcatttttggacacacagaatgtgattgcagaaaagggagacactagaggtgaggacttttcgagagaaggaaacagcacatggcaaagcacaggacgtgtttcaggaaggacaatctgtcctgtgtgcctacaggtggtgaatgagggtcaagacaggagctcggaggctaagtttggaagaatgtgttggagtcgggtcttccttcaggcaggaaaaggcatgagcaaaaccaggaaaaacattttttcactttctgcaggaaaggaaaatgtgtgctgggaaaaatgtgtaagatagcaaatgtgttatttattttttattattttattgactgtgtttaacttgtcagattatggttagagtaagaatggctgcaggcttggaacaaaaatgtcctagaaatagtagcctactaacttaccatctgaactgctgaaatatttttaccaggggagaaaaaaaatagccaaacgttagattgagaaatggcagttccaagcaaggactctcctttttttgctgtgtttgtttttaaccgaatcattggctagaatcactcaaaaagctaagtttattctgactgggggagaaggtccctgaacacagtgaggtggagacattgacctacaaattaataaacagggaattaggaataatgatagtaaatgtaagctgtcaagaaaaccaacccaagccagtagctgagagcaaatccaatgtgcctctaaaagcatccatcagtctccaatgtgtgtttataaggcaatcattctgactctttagcaaatacactcaacttacaaatttcaaatatttttggcacccaaaacaggttccatggatgagctcagtgatttattctcatggctaaaaatacagcagggactcctctttgagaatggccatcgtaactagtgaccattcttttgaatggccttaatacaacaatagtgtagcctctttttttcaaagtaggtataatttttggaaaatgtcaagaaaatacagatttaagtcaggtaaagaaggatgctctacattggcaatatgctctaagggcagctaaaatttgtgattataaagaaagatataggagtcattgacaacatcatatgctggttctgaaggccttactattcctctcaggccctgcctactctccgcctcatctttcttgttttcccatcacaccccacttgacaaataccacctatgcaaaggctgcggacaggcttcagaactccagcctgtgtggacatctacttactgtttcctggggctcaccctgcgctcctcccattttcgtctggcacatcctccccttcaagaatttgcacatatatcacctcctttctgtgaagctgtctctgagcctccgcacataccttactcttcccttccccgctaagccatatgcttctgaaagtcaagcatcatgctttatttatcttcagctgtatctatagcttctacagagtacctagcccataagtattcaatatctactgaataagtgaatgaaataatttaattccagagacagctcagcaaagtaacatcatggaatagagtagatagagcaggcttccaagaaaattgctttgaaatatcggtcattagagatttcatgtgtacattttggtatatttgttttaaaaaattggatccatctttggagtctcaccttttagaaagtacatagcacattagaaatacattgcactcatatgcaaatattttgcttaacctgttagaaagaaccatgaggagagacattccattataccaacaaaaagaacaccaaacaaaaagaactggcaattaaagtgataggaataaaaatgtgttttatggctcctaattctttgtgttgtctttattttttttctgttaattgcttagatatttcatatgtataattttaaaaatccttttaaaatcattttatccaaagtgtatttaaaatgagtctgaaggcagaagacagagtctgaagccctgtgaaatggaatacacctgtgcctaatgaaatgtcaagacatcaaaatgcttatccattttgtaggacgaggagacagcaaataatcaccaccatgatctgaaacatccatgatgtttcatttagtaatattcacatcctcggggagcccttcctgggatcaggggagagtcttgcatcaccacctcgtgagttcctgggtccctcgcggagtcttccccagagtccactgcatgcatgatatccacacgggatgcagcaagcctgagagtccctgcaaagggagttctggccctgatcttttatcgtggctgcttgcttccagtagttatttagcacaccccacaaagtactgatgaaagccatttttataaaagtcttacctaatggtttggatatggctgagccagaaagacgttcattcaaataaccgccaggcagattgacacctgttgcaatgtgttcccgcgttcctaattgaggattcaataagaagtttctgtaggttaaagttctacccagtattgccaaaatggagattgggaaggtatttccacacctgctgccattgaaacaatttgcttttaatatatcatggaatgtagtagcgaagaggagataagtctgcagctggaaaaatgaagcctctggatccctgcattgtacaatgggaagtgggagtacaggccagtggacttaatgcacctcgttttaaattgacaggactagcttttctaacacatttattttcttttgtttttaaacagattttcatctaggaagaaacttcattataacatttattgtgtatcttagtccctcacttctaaaaaatccagatctgatacattgtatcatataacaaatgtctattgcttgtgcagttattaacaatactatatgttgcataaaatactatgcaagtcacagacactttatatcttagtcttaatgtggcagctttctagttattttagctgggctctctttgtctctttccctgatctccccagtaagcttccaggtccgcttctgtagtatcacacctggctgttagcctctgctaattaccagctgattgctgtactgtttttgacaacaccctgtgcataaagtaccctatggtctgatctgattaaagttgtaaggcattgcttgtctttgaggctgctctgactccaggagcactcttctcagccctctgggctgtccttggctctctgtaaaacctcctggggatctgccatttcactcttgctgtgactatcgtggatcaccttctttattgctcaccaccaagatctacattggttttgacagtgcccttaggcatgaacttccacattctctgttacagataaagtttgtcccctttggcagagatgctggagctctttcttcttatgccttgcctctttccctaggcagaatctgtgtactacttccctagggctagggctgtggtcagcaacctgcttctcccacaatgactcccctgctccattaactggggctctgggtaggaagggtagaccctagtcttctcagcttgctcctccccagaaggacatagaccttctgccctctgagtgagctggggctagggagaccagggcccagtattctcagccagctgccttgctactacaagtgggagactggtgggagaggggaaccacatcctcttggctgtacccacatgcaacccaaaactgggagtaatgagacaggccaatagcctgtccctctcagggtgaactgtagctctagactgagagccaagaggagatggagccccatctctgttcccactcagaatggaacttctgtcacactgagctgagagatgggagggtgatatgagcaggtcgtgacttaagtgtcactgtgtcttattgttctcacagagatttagtagattttcttgaatagatgcttcactacttggtgttgtaagttaggacaattatcagattttaacagtaattttttaaaaaataattttcagtagttaaatggttgtttcactagggagggggtctgctgggctcctaactctgccatttaggaagtcaatctctttctacttttaaatgtttgcaaccagggcagcctaaacatttaccttcttttcattgcaggttcagaacaatgtcatttaatattaaccaatttgttgttttctaaattataggtatcctggcatctcaacaagataatttccttttaaggccaaaaatgtcttattcataatgacatattctcaaaaggctgtttctggaataaaaaagagcaactttttactcttaaatttttactattgacagatgtcttgatccattcaggctactataaaaatataccatagactggatagcttataaatagcagaaatttatttttcacagttccagaggctgggaagttcaagatgaaagcacagcagtttcagtgtatggtgaggctggttcctcattcataagtggtgccttcttgctttgtcctcctgtggcagagagcagaaagaggggaagcaagctccctcatgtctctttgtataagggcactcatctcatttatgagggcgttacctccatgacctaatcacctcccaaaggccccacttcctaggaattaggacttccacgtatgagtttgagaggacacaaccattcagtccttagcaatggacttccttagctacatccaactcataggacaattaaaggatagtgagctctactaattccctattcagatctgttatcctcggcttacactcaagcatttaatgacacgtaattgatgatctctccactaagacttctgttatgggttgaattgtgacaccacaaaatatgcctgagtcttatgcctcagcacctcagaatgggaccttattcacaaataggttccttgcagatataattagctaagatgaggtgatcagggtgggggatcataatttaatataacaggtcttcttttaaaaaggggcaatttggacacatgaacacgaacatgcacacacagggagagagacacgtgaagactgttgtctcgctgccaccagctagggaaataccagaagctgggaaggaggcctgaaacagatccttctccagcacttccaaagagtgcgtggccctgcaggcaccttggtactggacttccagcctccagaactgtgagacaataaatttctgttgttgaagtcacacagtctgtggtatttggttacagtagccccagaaaactaatatattctcagcctgataggaaatgatttcttgctagctaatatgtcactccaagtttcctgtaacctatgcagaatttatataatgttcagaaggccccagattattataaaactaatattttacaataaagagcaatataagatgaagactacatactggctaatggattatatttgtctcgtggaatccatcagaaaatgattggaagaagtgcattttaatatgaaatttcaagggaagatggaataaatcaatggcaaatagtgaagaaggaatacagatataccatccacgtgagaaaaataaagtcagagctagattgttatctcctgtagcctctactccagagtctcgcaatcatttactcatttaacaaatatttattgagtacccccagtttgccagactcttgtagtctcagtgcttattaaacatctgtggaaatgaagtgaagttataagcctgtctttaagtccctggcaacacactcccttctctgcttagttactgctattttcaggtacttggaaacacatccgtgtcctcaggttcctagtgcctactggagcccacacagctaatatttctctttccccctctctgacccaagactcacgtcaatgttcctgcccagggctgattctaggttctaattgttatatggatgttgttcagaggcctctgaaatgcccctcagtcctaaggggaaatgctaacgggaaaaaacaaactttaacaaatggaaactggcccgtggttatctcaatttccagtaagtttgtctgtaaggccaaaagataaacttaacaacacatttgtgagcatgtggaggcttctggctaaggtttatttaaaaacaaaaagaaaatctatttctttctctagttaacttcttgaccttagatttctagtgatgttcctgtgaatctcatcaaaaaactgaggaagttaggttaatggtatcatttgccaatttcaatttaacatttatgattagcaatggaaagcctaataaatacaatttttatatcagaaaggaattacagtctttgtcctttatatttgctctttcattagaagactctgaaaagggttttttacaaagtaaatgctgcatttttgttccatcaacatacatcatagtttacatcaattgattgtttttctctaacatataggaaaccttaatgttgtaagtacctgtaaaaccgactcttagtaactttctccctccattagaagctgtatttgcctaagtttagactgtgggcagcagggctagaatctcattttgctaaagctcagtactgggcactttggtgttagtgtttgaatcactttctcacatactgattataaaacgaggttttgctttctccctgctgctgtttttcatgcaccatcttctggccctgaatcacctggcactggtttcttccctgtacctgggcagtggccttgacaatgactttgttcgctgtacattgccaagtgcactgggagatttacttacctgagagagacccagaatatagttttagaaaaaagagacttcaaagccattctcatctccttcttatcctgctaccaaattgttaaatgtaaaaataaatttcagttttataattggcaagttatatggtgagtttgattaaatgctttactctaaggaatcaaaaacttttacaacattctctgctgacatatgaaacacaaaaaaaatggtttgcattccttacaataagagaaactggatcaaaactacactaagatattcctgtaacattgacagaggtccgaatgtctcacaacattctctttctgggaggcagtgaagaaacaggagctcccatgtatggctgatgggatgccacatgaccccatggagtcatacctcagaaagttacaggtgcattcttccctggcccggaaacccttctcagagtctaccctaaagatacacctcccacaaatgaagtgatatttacacaagtttattcattgtagctttattataacaacaaaaattggaatcagcccaaatgtccaccactaaggaactagttgaataaattcttatatagctacacagtggagcataatgtacgtttaaaaagaaaagaaaaagagaaagaaatctgtgttccaattggagcaatttctaggatatattgttaaaaactgcaaaattcaaagaaaaatatgtatggtatatatcctttatgtgaagaaaaatacacatacacacacattcttatgtttgcaaaagcaaacactaaaagggtaaaccaaaataaagaatatacaaaagaataggaagtaggaatgaaaggatacttctctaaatatactttgttatataaatttgactttagaaatatatattttccatattcaaaacataaaaaacaaaatataactatacctaaaatattaaaataagcatatgaatttatctataggccaagttaatgacataactacaaagaaatgacttgtttcaaatgttttaaaccagtgttttggctatactaacttagtgagacatattctaaagaaaaatagagacgcaaagaagatcttacactttaatagtcaattttgtagttgtaatattactatcgatcattttgtaactctcctatatagggtgtaggatggtggaaataagtaattttgttaatgttgttaggaaccaaggctatcagtgtaaaatgaaggagttacaagcataagatgaaagaaggtaagtaaaaagctcattagtatagttcaagtttaacttgtcaggatgagctcatgatttttttcctgaagctttgtgttttgtatggatgtcctctaaaaaggcatggaaaaaatgacaacccaactgcaatgaacacaccaatagtcctgattgtcaaatgcaggcatcactcactactgagagagggctccttggaggaatggtgggttcccaggccaggggaggaaatacacaggctgagactggagcatcttactgtcccagaaagcaaagaggctaccaaagactcataggtcacattaaaagaaaaccaaagccaacacaaagggactttggccaaagatgagacaatgttttttaaaaagacaattaattaattgactggaacacattaaatatattttttaaaaagtacattcgagttactattaaaaattaaaagaggccgagcatggtggttcacgcctataatcccagcactttgggaggctgaggcgggtagattgcttgaggctaggagtttgagaccagcctggacaatatagccaaaccctatttctacaaaaagtacaaaaattagccaggtgtggtggcgcatgcctatagtcccagctattcaggaggctgaggtagaaggatcatttgagcctaagaagcagaggttacagtgagctgagattgaaccactgcactccagcctgggcaaaagagccagaccctttctcaaataaataaataaatatcaatgaataaacaaggaaaagttcaaaagaggggaagagtggaccttattcaacattttggaattaactagggtaccaactttttactccgaaagttggcaattaaaagttaagaagtaagcatttatcttgcctttcctgtaagcactgaatgcagggtaaccaaattcccctgttgatgaggggaagttcttattaaaaaaaaattcagccaataaatctggaaagaataatagaattagaagcatcatcattttaaaatgccaaataaaataatggatttagcaaggatcattaaatggatgaagccatttgatgaaagattgatgagaaacttcttgatgtgaagatcagactgtcttcgaatcataaaaagtgagacaaggtgtcatatgtctcctaaaataatgcactatgaaggagacatcaacatctcttcttcagaaaataacaaaaatataattgagttacatttcaccacaaagaatcaagcagaaaatcgtaaaatatgggatttctaaaggataattggtctcatttctcttctgaagtacataagaatagaatgacatatggctggaatatacttcttaagaaggaaggaaggaaggaaggaaggaaggaaggaaggaaggaaggaaggaaggaagaaaggaaggaaataagtgaaacaattgtggcaaaaatattcataatagttgaagctatatgatggctatatgggggcttattatactaacctttctgcttttgtttggtttgaaatcttagtaaaaagttaagaaaatgttttgttatatgaaatatagaaatctgggagcaatttggcctgctcaaccatccacaatacagttgtaggcagcatgataactggcaaggaagttagggccagaagtcatcaagctggctactagtttcagctgaaaatcctaaacatagaagttgagttggtaataataaacaaacgtcccttttaaagacattgagtcatcttaaagcactacccataaaacataaatgcctcctttttccaagtaaataaatgagatccagaattttctcttctttcaaaaagtcgagattgtgcccatgagcctgtctgagtaattcccttctgcccaagacagttcatcaccaagtggagctctagaatgatgcctttataggaacaatgaggattaacgatgaaagcagaccctgaccatgagaagtttaactggaaatgtagaacaaatgcaataaatcgatgtaagaaaacaaaaataatctctcaatttggtagccaaaatgataaaactcaactgcttttttgaagcccaagaaaacctaattctcaaaagaaaaccaaaccaatttttacattcactattaattttaactagctcaccttcattcagtctctcttggatattagttatgcgctatcgatataagaatgaagattggcatcttcattgatgattcaatgatgtctgcaaggagcttactgcctaattaggtatgtagtcatctgagtaactaactagaggaggtccttagtatttgaggaaaattaatgccaaagaagaacaagttacaatagctctcataggagccaaacctcatagagctaaaaaagttatctttattttgaaaaataaaactaagcattatgaaaatacatttgttttattatatttaataagacatggttttgacttacaccgtacactgattcatagaacaaataattacacattgatggagggtatgggcatcatcttatcaacagtttatatactggcatggcgaaatatctttcacttcctctttggctttcacagcatgctcataaagagagttatttaaacacacacacaagtttcaccagctattccataagcatttcttactcaattctcttcaaatcattctctctaggaggagctaccatgacattaattatcacttttagattttttcttcaattatctggccttcatacactgattttcacttttcttgcttgtgatttagagttccccagcatcaccagcatcggtttaatcaacttcatgaaattctccatcttttcatcttcattttgtaatcactttgcattgaaatgccatccaaaaatcagctaggctttccagcagatactaccaagatagtattagtcagggaggcatgattgagggagctaattgtgtaagtggtcaatttattgataatattttacttctctgtggagtgctataattataatgcctgggattatgaatattcaggtaatgagacctcttgaataatcaaagcaatagtgtgcaatctttccacctcagggaggtagcgaatcactgaggagctttatgaagtgattttgggagaaggaaaggaaagttaggaattgttcgaggaaactcctcaaataattgtgacaagcacctcttcccatgagaaccactgaggaagatggggcacatgctctgggagctcaagttgattggatcggggctcacgctgcattcccatggagaaagcagcacatgaatggacagtttgcaagcagagaatggaggcagagagagtccaggaaaggcatgaccatgaagtagaaaagtgaggaattgattgagaaatcataagtcatgtggcgtcatgagagcacaggatgtgtaccagggtgcagtcaaacagaaggctggggaagcagatggacccagcccacaggccatctagagagacagaataaggagtctggaattcatagataggtgatgggaaatcagtgagggtctttgagaggagaatggcctgtcattcacctgcagaaagatggtcattcaccagaatgtgtgggacaagtgggctggaaaagcaagtgatgaggacggagaacaagttgggaggcttttaggtagatggggcccatcttgcctacactaggtctaggtggaaagctggaagctgagccatcatccaggaggtatgacctaaggaacagtgaaaaaactgccttaaatcttagtctgttctggcggctacaacaaatcaccatggactgggtggcttcaacaacagacatttatttctcacagttctcaagactggacagtccatggtattgaaaaacccactgtctgctgagggcccactttctggtttacaggcagccttctcactatatcctcacatggaggagagcagagagagaggaagtgggttccctcctgtctctttttataaggagagtcatcccattcatgggggtccttcctcacgtcctgaccacctcctaataccatgggggtattagggttttaacacaggaatttcaaaaggacacattcagttcataacatgcccttccacaaaatgttttaccactgaccctgataatagtgctgctcatttttacacgactcaatctttctgggggctcaaggcctcttctgagatgcgtgtgctgtttggctggggaagagccccagtggcaaagctctgccttattttcacttctttatcacctggactgggtagatgccctgcaaacattttgttgggacagagggcaaggggaaggtttttttgtgttttttttttgtttggtttttttttttttttttttgcagaggatgaaatcaatgtcacggaaaacttggggtaattggggatcaatttgagagcttcagctggctaaagggaagagaggaatgtcaccagagtccccaagggatgggagagaaaaagaacagcccagaagaaaggacctgaagaaaagttccatctatttcacagtcatagttagagccggcatctctatcctctgtttcatttctcactcctggatattgactttaggacagggaggtaaagcggaactggaaatatttgtgtggtgatttcttcaaaggagaatggattctgaatgcaaatgttggtgttaatattggcattccagccttgtttgttttttaaaataaattagtgaggcttaacagtactttaaaaactaaaatcatgctttaaagactttacatgtatttacctttggattttccaactattgtaatgggctaaattgtattcagtataaaataaagcatgaaatctaccaggaaatctctttgaatatattttcccatgtctgacaataaccactgtcacactttcatttgcagggcagtagtttgcatagaacagtgtaagataaaacaaatttaggttaattttcaaagccagtctttttattcaaagatgagtatttctccacattttctctacgattgactggcctaattctatgtctgcacaaaaaagcagaaaacaaggcaatattccaggtaactcaaaagaaaattaactttttgcctcaattattctctttaatttcaagggaaaaatctttgagaggaagttttgtggacattcactgtacttctttggcagactctgtgtttgcgtaaataatatgagtagtatttaaactttctcttgccgcaattattctttcctctattgtgtaatctcagtggaaaagttttcaggaaacaatgcagggaaagccagagcccttctcactgctttattcaaaagattgccagctcctacctgggagcagcacaaccacattaaaacaagcatctgtctgctgtgggttaggttggggcttggaagcttgtgacctgaaagcaacaggtggccaagtggcacagtcaggaacaaccaggttgaatactgttagtgggctgtgaccttgcctccactggagctgtgcccttaacgaagttcaatgttttttttttttctaggaactacttcctgccactgcaccccaccacacatgcacacacacatgggtgcacacacaggaatgcaagcaagtgcacacgactcccaagcccgtgggtgcattctaagtcccattgtcacagtcagctcattttcagctaagcccttcatcaatggtcttccagcttcactgcaagtccttaaaaacctcggtgtcttggtccagtttcagatgctgattcagaccttagcagattctaggtaggactcacgggctactcagtgggagcctgcagccactcatcatccctgagggtgggaaccatccaagggctcctccagtcacacctctcaggggttaatctctttgacatcccccatgtatgtgtcacagcattatttgaaatcagcccaacccaaactgtcccctggctttagtgaaaatctatctagtctttttaaagaaatgtgataacagatacaaaatttgtttttatatacagaataaaaccctgatatccccaccagggatatgcgcactttcagaggatggaagggataaaactttcctctccttttcaaaacctccctctatctccaaaagggctgcctacagcaaaaagcgttcccagaagtagacctgaccccacacctgctcaccccagagcaactttagagagggaggtgaggaggactgccatgggccaccaagcaccctcgccatgcacctttgccccatccctacccacccaaatgagggagtcatcggaagttaaaggttcttgtttagatattggtccagggttgtcattctgcagatatcattttatatatttatgaatttctacagcagtctaaaatagcatgctatttaaaaatacatcagaatagctccgttctttgttggtaggattaaaaaataaggagagagcatccttcggtgaaaggaggatgagttcctccacacggtggaggagggcgtgttcatctttgcttgggcattaattggctctgcggctttagttcaatcacttcacctctctggaccttcacctttaaaataaagacactgagtaccaatcaagcatcagattaataacatccaggaggagacaagaaggaactggaaatgagtgaaaccagacagggttgtgaggaaacaggacttgatagcaaaactgaagacatttatatttaaaatgttaaagccaaataaaacatgttgacaaattcattgcaagggcagccaatgtgaccgtttccctggagagtttttaagattctcgttgctttcgaatattatcatctgaaaaaataatgttttagtgcatgtggagctctacagatatcatgtggttttctgcaaaagttttgatgtctgttgaatttcataatatttcaaattcaaaagtttagtattcatcatggcaatattttagtacaccacagcactgtatttctcattcctctgaatacctctaaggaagattttctggaagtagcgagtgttgttctttaggtttatcacaaagaaaaagatttatttctagtgggattggagcctctcttctgacactgacttccagtggggagtctggactttctacaatatttgtcccaacaggactgcatgccagagccaccccacactctccaggcttagcattttctgcgctcattatgtccacatgtacagaagatgaatgtctgctatggaaggaggcagaaagtaccaaaggaaaagataattcaccctaaagtactaccaacacttacagtcactctttctggaatgcgccagtagctaaacaataggtttgtgagctaacttcttcctgatgatagctcagcggttacaataactgtgtgagcagaatagtccccataatcttgatttctacctgattttattaaacctttcttgctgtttctctctgtcatttaaaatgcatgttcctattcccatccctaaccacatgtgtggaaatgcactagaaaccctgggttcttagaataagggcacagacaggaatccaagtctgtaatcccacttggcctcgacaaggaaactgttcacagctctgacatgggcgctcgtgccaatgcagccattgggagggcagcctggctggataatggcaaggaacagaccgaaggctttgtctgatctttcttctacataggagggctgggcaaggcgagttaacctaagaacagaagagaagaggggagtggtcagaagtaggcacgggagtccatcgtggagacttggtgaggctatgaggatgcaggcacaaaacctccaggacaggagcagcctgctcgctcacaccttggaagggagaatcagggagcttcagtatctccaggttctgcccctcgggtttctcccactgcccccaacatgctaagtgtatgctgctcttccttaaaaacttgcactcaagggcatctctgatgcatccatacctttgtctttctcagcacagttcagaaaggtggaaatctcaaaacacctataaaaactaaaggagaatgaagagaactttgtcttagagaacacaaccacacataagtccactttccaaatgacaggttttagatcctgaggaaactaacaggggtagcaacatctgttagacctaaaatcctctagctcatgatgggtgccactcctaagattcacatggcaccccaccatcatcagactccccatcccctagaaatgttctgccaaaatattgtctctctctgagaaatgctgaaaaatgtctagttcagatctacatacccatacctcccaggttctggtgtctggtgtcctgacgtgtctgaggtggatcctccgaggcaaggaatcgttagaccatatggagaagcacctagcagtacaggaacccaagtccctgctgaatcattttctctttgaggctgacacacagtgagaggaggaatccccatggggcggtaatgagggagtccaagtggcttgaggagaagatggcagagagacagcctgagcaaggacagctgagtcagcttctccccacacttccaaatccaatgatctaatctaaacccaaaaggtctccattcccacagggaatgaaaagctctagaatcctataagtgaagtcagcaatgggctgctgaataacacagacccagatatgttcacagactgcttccaaaatctggggtggtcgtgccttgccttccctcttccacgttgtattcataagattgcctgcctgtctgctgccctgtttcttaagagcctctctctccaggaagactactgaaggccttagtatcatgaatgtgctcagagaatttgagttcacatcttaaaggcagacacagtgggagaagccacaaatggatgatgtattaactcagacatacacacctagcacttgactcataggtacatgctgctcatgctgttccttgtggatgctgtacctgactaggtcaagtccaggtgactgccccagggaaagcatggtatctgggtcagtaaccgtggagacacgcaggcgccagcatttgcacactgactccccactttggaactgcagacattggtctgatgctttgtgctccacttgttccacctgcaaccttagaggacatgccggctgagctggcatttgttgtggctgtcctgaggacagctccctttgtgattgaaatggtccatttcctgccatctggtatcccagagcacacaaggagtgggaggcatgatggttatcatgaatcttcaggagaggaaaggaaagtgagtctatgtgaatgactcagttcctggaagttcactaaagcagcttccttgcaccagctaaggctgaggacaaagggagagatgcaatcactcaattttccagccggtggctagtggacctgctggagggctgtccacagctgcggctatagctccagctgaggctcctgcaatcctacctgcagaacctccttggggattagcatgatctgcgttccacagacaagcaagctgaagctcagcaaaggcaggctgcttgccaacaccctcagagctaaggggagaagttaggattcaagcctgggtccatctggggccaaaggccaggtcctttccattaaggcagccattcacaagtgttttgtgatcaggatcctcttttcactcaaagatccctgaaggacccgaaaaggcctttgtttgtgttggttacacctatcaattatcattacgatgtggtgatatcatatctaatctaatattatattagaaattaaaacaggaattataagtacatatttactaattcatttgaaattagcagtaataaattagcattacatgttaacaaaagtaaactactttatgtaaaataacttgactattgatacaaaaaaattaatgagaaggacatcattttgtattttcgcgaatctttttcacgtctggctaataatagatgattcttgtatctccttctgtattcaatctgttgcaatagcagtaggtagcctctagaaaactccagcggataagtcatggaaaaatgtcttagaattattataaaaacagtttttacttcaaagacccttgggaaaggtatgagggacctcagaggtctactggccacactttgggaactactgcactagggtacctgcccctgcgtggaggatagagattggaactgctctgtgctgagccctggctgtgtttgctctggggccaccttcacccatgcagaccaaacacttagaacatgaaccactgtgcaaataggtcttagtgacgttgctttaaggaactcaggattgaggtttccttcaaggacaagataccttctcactggccaatgtgggaccaaaagagtagccctgtcactcctatggtgttcacaaggccacacttcttagaaagtggggttagcaccctgtgggaggccacatgcacatccttccataccagaactgacccagccataagccccatccatttctgcagcttgtattcaaaatgatgagagacttttactatgattcaaattgttgctgtaattttcactgtgaaaatatggaccagtgcatgtcgtggggcaaaactgtgggcacttccttcctttgtcttgatcagggttaagcagagtgagggcagcattcaggataatgcccatcagagtgaatcttccagcaagagaagcagacaagggccacgggcaggttcacaagctggagccagatgaatggatatgaaaactaggcagggaaaacacagcaaatagaaagggagagtgggcccacagacctgcctaagtcagggtgtgcagccacactcagaaaacagacctctttcagctccgtccaggtcaggagcatcacaaatcagaatcagaaagggccaggagcaggctggggtttggttcccatcctacgacactcttcacagccacaggaggcttctcagatatcatcgcggacctggttgtaggttgctttacctagacaccattctgtccctgcagaatctaacctcatttctataatagagtacttgtacctattcaactttatcagtaattaaactaaattttgttgatttaaaaaatggtatgtcatatcagcttcaagcatctgcagatttctatgtacatcttttttaaatcacagttttcattaactttgcaaattttgcctttagggtcaaaaaggatctcttaccagccaattacttgggcttttaaatagttttcctaacattttattttctcgctttatagctaggctacttctgtgagaaagatctataaattaagtaagataagtgaattggaagtaactttttcaaactatgttttttaggcacctgtcagtgaaggacaaataaaaaataaatagacttacctttagaaaaatatcacccgaatgcagacaaccattagccttttggcagtcagccatcacgttatggccaccaattaagaaattaaaaggttgcagttccatttttctcgtcactgtattaatcactcaagtctgtattgagcatccactgtaagcaaggctggggaaagcaagatgcctgtcgatacagtttaaccttcccagtcttctgagggttcaaaacatgctgtcagagcttccactagcctctccccaccaactttcttctctgttcttcctctttttcttttcctccctctctccctcacttattcaacaaacattttgtaagtaactttagtagttagcaacaattttcttctcaataaaaagctttatggtgttcactgatgagacctggcaagtatcacatcccggaagctcatagaacgccagggcacacctggctgcaccccttccaacctgacctgaatatcgaccctgcatcactcgctcttctcaggcctctttatgacctcaacctgctatagccttggagaaagagaagagcagagggaaggcccaggagtagtttctgaaagagtctacatgtagatgtgtatgtgtgctttttttattaccttaaactctgttttgcagcatcctcagagtattcaaaatacgaacactgtttctcttggtatctgttaacattacgagggataaatgtgtatgtaaggagatagattagatagatgggtggatagataggaaagagagataggtagatagatgacagatgacagatagataggtagataatagataaggtagataatcacatgacacatagagtcactgaattttataataaaaaatattagagcacaatccctttgttccttgattacagatcaggaaatgaacccaaaggcttatttaggaaccatgatcagcagcaaccttgtccaaagccacctgtatgttgaactccacttctgccttgtgttttagggggcaatggtagcgtcatttccccaggagcttccagtctgaagaaagaacaagcagacaaacatccatttccatgctcactacagaaagatcgttgtgttcattcatctcgctaacccacttgttattttaatttctgtgatctataaatagtaagtccaacagttcacatgcctgaatctgctaagtctgagcatgccctgtttctcaatattaaggatttgaacaaagctcttaatttgtactactctggattgctgcttgtcttgctggctgctttttgtagaatatcaaaagaaaatagatatctaggggccaggagaaccacagtaactcttgccaaggcattcacctgtccatcatggtggaggtacaaagtgtgtttggattccacttcgctcgctgggtttattaatggtaactcctgcctgacaaagcgacaagcacggattacgtctttgatgctgcgttgcgctgcggctttatgtgatttgacatctttgcaaaatgcctgtcttgccacaacgaaaaaaatgtctggtacaatttgtgcaagaacttgatgccttaatacactagatgatttagacattcttttaaagtgtttctctgcttcatgggaatgaagagcaattttcctgagacaccagtgctaacccagctctcttaacacccgtcgggccagaggagaaaccctcccatcctctgtggaagtcaagtcgtcagtattgtcacagttgaattggacacatgtagcgaagaatcaggcctggcagcctggatgggcaagctgagaggggccagagagaggacatggaaatctaatagcagcagacaggagagctgctacccacattgggatttgctccctggaaagcttaaattatagtgatgttggcaactgtccacatagctgctgcctttcattatttgctttctgaaaacttcaaaagtctcatcaccttgtttatggtgaggagagccgagagacgcagcaggtcaatcacctcttggcttccaagattctatcagtgcagagaaacagcttaagagagaacaacattaaaacttgtcacatgtatggcatttgactctaagcagggaacagcctgccctgattagctggtgaggaatccgcagattccattgatggtagcacactcttgatactcttcaattcccaaatttatttgattttgaaatttcttcaactccctttgatagtccagactctaggagtctagagaaggaagtgagttgagaacacacttagtccaaaagagtatgaccttatcaaaacagagacattttacaatgatcatttcactgctgccacttcagtgttcagaggcctctgttaaaggagaatgtgtgtgatggaaataggcctccaaggcatctctgctgacttccttctctgtaagtgagcccttccacctgcatgcagaagggaccaacatctggaccccacaggagtgagcagcctcaatgttatgtgattccaaaccatcagtaaaacacatgtagattttatagtctcaaccaatttgcaattgatcagttgaccctgatcaatgatgagatgtctctgttcctcctcagcctctgagtgtatgaaatctgatctgagacatggcctttggataaagtgatttaacagtaataagacttgtaaaatttatttaattaatatgataatgagggcaatcagggaattaatgggaaagtttaactttggttgatctatatggtgcagttattgaagcctaagtgctccctagttgcatcttttcttccagcctttccattccatatcagaaataggggttaaaaaagtaatagtccctaccacctatcagcattaactgtgctcagagctacactcaaagcaccttattcaatcctcgcatcacctctatgaggtagatgctgtcaccatctcattgcacagatgagtctaggcctcacaagggctaagtgccctgcccacaatcccacagatcatatacataaatatatacatgcaactgccagaaaggcccgggtctgcctggccccggaaccaaggtcttacctacttcctgttctcctgccaaagaagcttcatgtagatgtcagcatgtgtgtcaacaaccacttgatcccagctccctcttttgggagctctgtgatttagggcaaattatttaatgcttctgagcctcatttgccctagctataaattaggaacaataacacatgcccattgttataaaggccaatgtctttggccttttggccacaaatgtctaatatgttatctgatgcatatgaatcactcagtgtctactataggaaagagtgagagaatgaatgaaaaagtgagactctaaggccttttacttctttagagagtcagtacagaaggcaggaagacagggaatcattattagctaacatattcaataagtacattgttggaactatccaataccttataggggttcttagtagaaaaggattcacatgtttttgtccttgttacccatgtctaaatcctggagccaggaaaccagaaacatggccaaggacagcgatccttctttttgcctctccagccagcaaaccccatcatggctcatcagaggtttctgtggagtcctaaggtggctgcaggactccaaatgaacaatctcaaaatcacagggagcctggggtgtcagggaggcagcctcccgacacaggccatggccagaaagaacttggggccagcctcgcatagagaggacttaggtttttaaaatgcagaggaacagaggaagaacatgtcgggtgtgaagcggggctttcgcactgcttcccaggaatcaccgccccatggagggaggagaaggaactccaggcatttgattatggagttacagtggtcattaaagcaattttcagtatcccacttgagaattacggacttagaagagctgcagtgtcacctacagggtcccgctgtccacgctgcctccgccggagtgatgaacctgtctgttgcacattcacgggcctgatgaactgagaggcagctccatgcagtgagcagagctggccctcgggtcagatgccccgggctcaacatcggctccaccggctccaccgcactcttttccccctgacacccggggaagtctctgagcctctccagggttcttgtgaggtctaagtaagatcacatttgtggagcactgggcactagaggtgctcacggaaaagaccgttcctaagaaggtcaagcatttcaaaggctgctttcttcttgttaaatatttcagttaagcagtctcattgaattttcttccatatggggatttttgcttttatttttgcttttacactttcagaagggagtatcattgtgtccattctttcatgggagacaaaacataagcaaagaaaggccttaaagagaccatgaaactagggcaacggatttcatttcatgaggtatttattgcaagtccatgtgtcactaacctgaagatgtgatcctactttcaaaggtatgcccaccacttttcttgtcagtgagtgaagacaggtggagcgacatcccagtgctgttccaatgcctgcccacaaatgtatgtgtccctgcagtaagcccctatcacacaggggaaaagcaggcaattagtaaaaaagggatgagaggttacagaagagccttcagggaaggttaaacagttttgagtgccaagtatataccaccagctcttttatctcattaatcctcctaacgacccttggaagttggtatgatcatcctgatttttcttccaataggaatgttgcccagagtttgcccaaatttacactgctaggaagtggcagacctagaacaaacaggaaacaaaagacaaagcatgactcaatcaaaaaaatgctggctcagaagttaagagtcctggcttcactactcaataattctgtatcatatctcaagatgtggcccagggaaccgcagcaggatgaggaagactaggtgtgggacagccccccagtgggtggtgcaggccccaaaggaacagacacaacccagaggggctggaagtccagagcgtcaggcagaagggcttccggactatgtggacacaatggtcctgaaaaagccctgaggtctcctggcaggtggcaaagattggcaaccaggcaatgagcaacccaagcttgtaggctattggaaggtagcagggccccaggctcaaagatggagccacaagccgggtgcggtggttcgcgcctgtaatcccaggactttgggaggttgaggcgggcagatcacggggtcaggagttcgagacaagcctggccaatatggtgaaaccctgtccctaccaaatatacaaaaattagcagggcatggtggcgtgcgcctgtagtcccagctactcaggaggctgaggtagaagaatcccttgaacccgggaagcagaggttgcagtgagccgagatcgtgccactgcactccagcctggacgacagagcaagactccgtctcaaaaaaaaaaaaaaaaaaaggagccacagcaccaggaggggagtggacaggggtccaggaggctctggtgtctaggaaggactaagatgctggacataggaccatgaggcacagaaacaagacagacacatggttgccaaagctgtgaaccaattctcaggcataaagccaaagccatgtgtaaaccctgtgttggagaggcgttacaggcctggcaggcagcaagcaggcacctgcctgccctagctctacactagagtttcttaaatccctcccctctaaggcacatttcacctgagcgagtgagaccgagcttgtgggtggtgagaagaaacttcaactgtgggagctgtgggcttttataaggacatccagacatttctgaccccaggactttgggtaaattatttaaccagagtgagcttcagtcagtaaatgaagaggcataatgtgatgatttcagtggcagcttgttgtaagaatctgtaagtggtaagactcaacaagcgtagagactgaaatgggatttgcctgcagaggtcagtggaacatgaaacagttttttttttttcttttttgacactgcctaacctacagtgtttaattttacgtgaactcttaactttgatttgcctgtcctaaaattggggataaaggaatgagttctttaggcatgctaaagtttaaactaaatatagcactcctatgcttagatggcatacatggcataaacactgaaaataaaaatctatggccctaggatctctttttaaaaaacctataggagaaaataaatagcttctgttgaattccaacagacaaagaacagagggtaaggaaattctgattgctgagaaagtggagaaagcacagctgcagaagaaactaaaacttaaatacttttgctgtagcagcctttctgcctttaatctctttaattgactgctcccagctacacagaagcacatcttcatctgtctgaaataaattgtgagaacagtctgactggagcagggagatgatggagaattgctgtatttctgtttgccatggctagttgattcctctctgtcatttgcctttaaaaaaaaaaaaagccttttgaaatggaaatggtaaaagttctccctctttcctgaagccctctcctcccatttcttgactcaccccccttctggctgcatctctcagacaacaccccatcctccactgctgctcgctgccagaaggtactccaatcggcctcatccttgtctcctcccttctccactgatttccgggtccatccactggctgtgatggctttccaagcatgtctgcatgcttggactgcagccctgatctctccctgggccatgagcccctattgggcagtcaagggtatttccatacaggtgacctgcaggagcctcacacatgtacaagaactaagtctataattgggttataatcctcagctccaaagcagctaccagagtctctccttccctgggcttccactggacagacgctccaccagcctctcagacacccaggctagtaaccagggccctttgtggactcacattcatccccctgtacatgcacactgtcaccaggccttgaagcaccgtgcctctgctccccatccgtccccatttgcccctgcctgcctctcccccgggaccctgatgggcctccctgccccaatctctcttacctaaatccacctcctgacatccaggtttcctccctgtaacacaggtgtctcatgacactcttctctaaaatttaaaagtagtacctgtggtctgcagaataaaatccacccacctttgtttggattcaaacccactttgctacaaactgtgttctaggctgttccccaacctgggctccatagagtgcacactgtgggcatgctgctccccacccttcccaagacagattgagcccctccagaccctcatgtcactgtgcattcttcactcgtgcctctgccaggaaggcctgccatcttctcacacgctctgacttacaaccaaatctttctcccttgcacttctgcatcacattgcctttacccctatttagtaattatttcacgtggtcttgtactaacattagttagcacaagggggctgcaagtttcttgagtagtgaatggtggtttaggaggcagccctgcagaagaaccctgggaacaaagcccaagtctaccactaatgagccctgcctggactcttgggcaagagacctcatccctgtcacctcactttcctgacctgagagatgaggatcataactgatttgacctcatcaaattcttgtgaggattgaatgtcctcatatttgtatagtgtgtagcacagagcctggcacatttacgtgctcagtgagcgtgagctttgatttttaaaaaattatcattgttattattcctcaacagtcaacaagcactcagtgagttttcaaaattgaattcttccaagaaaaggtggtcaaatccaagaactcgagtcacacgcagagaatctaagaatgatgtgaggttggaatgtttctgctggctcttcaactgaccacttgcctaaccctgattcccaaaacacgttgtggaaaagagatgagtgacccaagcccattgactctgtgggaatgaggtcagactcgtaaaggaggccagcattctcctcccctcccctgacaatcagcgtctgtcttccagctgagtgcagtggaattcgcgagagtgcctttgccctgtcaccaaggtggcgaagtggcccaggtgcagtaataatcactctcagtgggcgcctgagcccctcaggcccagcactgcctgacagcgctctgctgcagccacccatgaaggacagtgacgagaaatcctgtcagctaaagacaactaagtgctttcctgaaaaagaaaagcatcccttaaagatgctcatctgaggagattcacatttagtctacccaaaatcatgtatggaaactattcaaggaaacattatgccactttttaacctctttatggcagttgaaaatttcatagagcacagaatggaagtatttctcagatctgtggctggcagcaggaaaggggcatcagggtggacgctgatttccatggggtcctggagagatccctggactggtcactgaggggaagaagaaaggagacaggagggagagctggctcgtttgtggactgagcccaaaaccaaccgtttaccaagccccggtgctcatccatgcactgcgaaaatgtgaactcatctctctctaaagctgcagtgggaggggacaactctgagatttctaaagctcttttcagccacaaagttgtgattctattagccatcatgccagttcatagctctaaataaataaaggggaaaatatggctttgcttatttaaattttttttaaagccaaaatccttgaagtgacaatggcagagtcaaggctgacatccagggtcccaactcccagtccagtattcccttattcccaacatttgcacccggcgctgcggtttgcttgatgcacactgccccttccttcagtcttaccaggccatgtgactcccatgaaacagaaacattttcaagccctccaaaatttattcacaaaaggatatgtaaaacaatggaaacaaaaagtccttgaataccttcttgctagtcagcctgattcaaataggagaatttcagctctggcagcatcaagtgtgttaagaacaggagaacactctgagctgctctcacgtttctgttcccaccatgtgtgtgcaattcccgaggagcctcactaaagttggctacaccaaatgatttcctgccattcctgatgaacaatggagggaggagaatcatttgtcctttaagctgtcctagaaggctaagaagaaatttctggagctgtccaatatggctttgatgagaaagtaattaaagtcgccagcagaacgatcctcatgtttaagtcagataacaatgtcattgacagcaacgttctgctctgaagggcagggatggaagacaaatgaaaccagatttaccctgagtagttttattgacatccttcttgtgtccagttactaatatttagtccacaattatgcatatatgacattgttttactgattatttcctcctttttgtgagaagaaatgaagacaaagaaattagttgctctattgatcctacgacagacatatcttcacttttcttttctttttcttttttaaatggagtctcactctgtcatctaggctggagtgcagtggtgcaatcttggctcactgcaacctccacctcacgggctcaagcaattctcctgctgcttcagccctctgagtagctggaattacaggtgcgcaccaccatgcttggctaatttttgtatttttaatggagacggggtttcaccagattggccaggctggtctcgaactgctgacctcaagcgatccacctgccttggcctcccaaagtgctgagattacaggcatgagccactgctcccggcagtatctcttccatgacaatatttacttaaagtttctttctattattacttcctttttcgtggcagcaaaagagcatcctttaaatgtcctttaatataactaaacaagttttttaaatctctggttctgtttaagttctttaaaacttggtctgattttttcttgatgtgtataataaccagagagatgcattttgccactcaagcgatattgatgtagctcaggctcacaggtctcacttaatccaatcagtctcaccgctttcccctccttcctgtagcagttatattttatgtgagaggtaaccataacaaagtagtaaggaacaagagtataaaagtataacttcaagtaaaacattgctttgctacttattagttaacagtctgttaattgccaatgaagacaatctcattttctatagactttcaaatgatatgtacccattgttacataaactgtattcttttgataatcaaaatatagagatttgcattaatttatgatcacatgttataaaattccttcatcataaagaaataatgaagccatgtcatttattcaaggtttaactgtgtcttctacagtaagaaagagaaacctcaagcagagattatacttggaagtcagttattaatatgttaaaaatgtgtgaataatcaagggaaatgattagaatattaaatagaggccttgtctaacatcaagttgcctaactgttccttggtcttcaaaggcaacatttattcacatatttactaatcagatatttagtcagcttttgcttcttgcaaggcgcattcctggaacctacaggaattcaaaaagtaatagcattgagtttctgttctccaaaagttttatagactagcagaagaaatgacgagtggcctaagagagagcacccaataagatggaagccacagtttgtttcatatgtaatagattatgaattgtatatattagatatatagtatataatatatgtaagatatataatctatgtagattatatatagagatctctatgttgagattatatataatatatatataatctcagatgtactatattctatttaagtccagcccacaactaaggaaaggacatttcacaagtgcataaagaccaggaagtggagatcactagggaccatttaagaggcagctgaccacatatacgttatttttcctgtttaaatgctaagattcactgttgtgcctagagtgatccatgcaattttccgagccatctttaatgaaaagtctaataaggatgctggaaagaggacaagagtgctgtgtgtctcttcctctgccttctatctattattaaggaataataatttttcctccagcatctcaaagtagacgccacattttctacacattcatttaactcacaaagctccagaccaggcctttaatttctgtgccatcagaaagtaatgtggtattggagtgcctccaggacagagacctaggtgtgcaggatagctgtacatatctgttcttgtttcttgttcagaacatttagtcctgtcaaaacaggcagagtacatcttacatcactaacaatagtctgtgatcatgcagaggaaagaaaagaaatcttaaagacagcttgacaaagtgatgtcagactataggtactgccttttcaaagtcatgattttatctgagattattcagatcagaaatcaagggagagttttatccttcagaatgtctgattaccctgttaggttcatataaggcagggagggcaagggcacctcacttggacaggggagggttaagcttagacattggcagagactggaagaaagaatatattaatccatcagaaaaaccatggctgtaaaaagtaatgattatgtcagaagctaaatacataacagcaaagttatcttcatgtaatgtaggaaaagatacagatccttagacctcacctcacattcagcaagcgtttattgagctcctgttgtgggccgggtgctgagtctttggatagagaaaaaaaaatctgaatgtatgttaatgaactattgctgcaggaaacccatgtctccttttgtatttgcaaacgattaaactccttcgaagccactgttacagaagaattcctggtctccattatttttattttctaattttcaaacaattaaaacctcattagaaaattgttttaggacagggtgattatagggtgaaaaatacatagattatgcagtcatagaaactagatcattgtcttgcgagttaaaaactgtagacttgggcataaggcttcaattcatagagttatacgaattaaacaacacaactcttgacagtcttctactgcggtgcctggcgtaaagtagccttatggtatatggatgccctcattattattgataatcatcatgctaatcaaaacaatggtcacctggtgactcagaggaacggcagagttgaagctactgcagtagaagcaatatgattttgtctttaggagtaagtatagcactaagcaatatgaggtcatatttttccactcccgccataatttttaagtttgtaattaaagacctggtctggagccctgaaagttaaatgaatgcttagaactaggagaactctctaaagggaggcactggaagtgattaaagggctaaaaaatggagcaacgagaaaagtccataggtaataaagctacagagtatggaaaagagaaagctctgaggcttctaacttgggaaacgtaagactggttgttcttcattttatttcggtgatgttatagaagaaacgtctggattagcatagaaagtttcaggatctttgcaaacatatttaggccatgagtctaaattacatgctcaccatgtaatcttaccctaccagttccataccctgtgtgaaccatagcttcacagtctcattcgctggaataatagtgactgcagggtgctcaaggatctggccagatattacttggctgagatcagttttgctgatagaaagtcagtcgacatcaatatgctaaggtgatcggaggtggattgttctgggctgcaggaagagcttgactcattgcagaaggccagcctggctggaggatcacaagcaggggggtgaaaagaagaggacgatggcaggggacagtggccagggcccatcagtcagctcatttccatcaatggcgtttagctatattgtatctagccaaaagcttccaatctgattgtagccagaaatgtattttacctgataccacagcgattctctatgaatttaagccgtatgcccaagtctacagtttttaactcacaagacaatgatctagtttctatgactgcataatctatgcatttaatcccataatcactctgttcttaaaacaattttctaatgaagttttaattgtttcaaaattagaaaataaaataatattcaaacctgctctgaatattagagtcccctggggcggggttacatatcacattgcccagaccacacccagaccaattatatcagtacctctgaaggtgggagccaggcatcagaggtgttaaaggtccccaggtgatttaatgagcagcgaaggctgagaaccattgtcgtcgtgggtactagagaggcttaagtgaagaagccccacaagtgaactctagtttctctcttccctaaatacagcttttagaaggcatgtgggttttcccaagcgggcagtttaggaatggagtagatgatgccttacagcccattctgcacccagccacggtttaggagagaagtttttcttttcttttctttacatgctgtctaaatggccaagcatttcataaattggttaattcggttcacacaagtctattcaaaagggtacagtcgaatctgatgttctctggcacaaggtagacaaaaacagttgcatatagttgcttagatttttctgttttcaaattttggatagaatgcagatccacatatagatttagaggccggaggagaaaacaaattaattgcaaactggtcatcactctaacagactgacagcactccaactttcaaaaaagtgtagctgtagggtattatcattttgctggatgtatgtgaatcacaaaagtagaacaacatatccgatttcaatttaaaagtgttgcttttcatcttcaattacttgtttttagtttctgttcagaggtatcatcattatctgttaaccgcataacgaatgttcatgcactaccttttatgagcaaactgtagaaaaagtacagcactctggggacctagtatgatctagttggggagatcatcaccacagttttctgcaaggcagatgctgaatggaatttgagtggtattggctacaccaagaagaaagacaggaatctatcaggagctcgtgtcattcctattttgggagcccacagaaggtgtcttaaggtggatcccctgagaaagagacagcgatttgggtgcagaaaatttactgaggtgtgctctcagaaacaacacagtgagggtggaggaggcaggacaggaccagaggagctagatggcaatgttcttgctacagaggcctcagcccatccccctgagagggaagcctttcaactgtcccttattaaggcaagggggtgagacttcctatctacacctcgagtggccattggattagacacaggctgtactcatggagggggtgtggatagccgtggcagggcagatccctgagagggcattcagcttacagccatcagcagcaacagcatttcaagcctgacaggagctcctgatggttctctgcaaacactttcccatctcagtgaatggcaaatccattcttctagttgttcaggctaaaaccctttctgctattctagatttctctgtatgttttacatgcacatctcttccatcagcaaatcctgctggttttaacttaaaaataggtccagaattcagcatgcgtctcaccccctccgctgccctcatcctgatcctataactttgctcaggtcctggtagcctgaggtactggtctaaccggcctcccctcttctgccctgtcccctcagtccattttcaacacagcagcccaaatgattctgtgaaaacacaaagccagttcatctcactcctctattcaaaatccttcaacatcgtcccagatcttttcggaccctccatgacccaccattcagtgaggcacaggctcagtgatagcggctgtttcctctgcctggaaggcccttcctgacacctgtccagctcctgccctttttcaggcagtggcttgaaagtcgccttctcatcacgaccttcctgcccgtactgctctctgatgcttctgctctccaatttgccctgcttttttttttttaattagcatttacttctacccattttcccatacttttgttctttagatttgattattgactgtatttcccagtagaatatgagctccatcaggacaggcagcgctttctcctgctgcagttaccggttatctccaattacttacagcggtgtctgacatatgttccagcctcgaataaagagcatgaaaaccaagaagagggccaggcacggtggctcacggctgtaatcccagcactttgggaggctcaggcaggtggatcacctgaggtcaggagttcaagaccagcctggccaacatggtgaaaccccgtctctactaaaaatacaaaaaattagccggagtggtggtgggtgcctgtaatcccagctattcaagaggctgaggcatgagaatcgcttgaaccctggaggcagagattgcagtgagccaagatcacaccattgcactccagcctgggcaacaagagcgaaactccatctgggaggtcttccatgacacaacacctcattggtattccaatgtattgggcttatcttttaaatctgactgttctagactccatgattcaatacgaactactagttctaaccgttttcactttcatgttttgttgttactactgaaattgtattcaaatatttttaatacatgaggtaattgaactatctccctgaggcttttaacaggagtgatacattcttaagtagataatgaatcaataacatgatctcctgagacctagttagggtcctgctacttagcaaattaataatgaattgattcattcctcagcagtgtccagattctcagtctcttcaataactgaccattcttttcatcacttaagcttcaagaaagtttttgtttgggttttgttcagcttggttgtcattgcttactcgggatacttaagaaaattggatgggtagagtggagaaaattttggaactattactctctatttttcattagctgcttcttccaatttcttccttctgtatccaactcttaaacaacaatgatgacagctggtaacacaatgataaaaggactttgacgttaacagtgaaattcttgctgtttgatttctgaaataaggatcactccaacaattgttataaaaagccttggtatattcagtcaagtactatgacaaacatagaaagcacttggtttgttttgttttgatgtggtttgggctttttttttatttggatttgttgctactgtcttatagattaaatctttctctctaagaaagcaaaagaacaatgagctgagtcaaccccagtgaaaagattgtgcataaaaggaagccatgctatctttctagtctagaacaacaaaaacaaatatccagaaagatgtttagaaagttcctttggctgttaaaggactataaatcatgctgctataaagacacatgcacacgtatgtttattgtggcattattcacaatagcaaagacttggaaccaacccaaatgtccaacaatgatagaatggattaagaaaatgtggcacatatacaccatggaatactatgcagccataaaaaatgatgagttcatgtctttggagggacatggatgaaattggaaatcatcattctcagtaaactatcgcaagaacaaaaaaccaaacaccgcatattctcactcataggtcggaattgaacaatgagaacacatggacacaggaaggggaacatcgcactccggggactgttgtggggtggggggaggggggagggacagcatggggagatatacctaatgctagatgacgagttagtgggtgcagcgcaccagcatggtacatgtatacatatgtaactaacctgcacattgtgcacgtgtaccctaaaacttaaagtataataataataaatagataaataaataaataaataaataaataaaaaagaaagatcctttggctgttgttgctcagatagtatgataaactacacttttctatttggttatctttatagattgtgattactcttcattccttgtggttcagtgactaaatctgatgaataaagttgaaaaatgtaaggcagtggtaaataggtttctggaataacctagcaagtgctatgctactttcactttataacatgcttcccaaaataacaagtaggtaagtgaaattgactttttattcaagcttttagacagaattgaattcaagcccttgctttatttctctcttctaataataatagtgattctaaaaacacttccgcttgtaaagtgttctgaggtttatcaagtgctttcacatatgttatcctctttgattctcacaataactttttaaagagattaggcaatcaaacctctggtagattaagcaaatttcccagggtcacaaaacgattaatgatggagctaaaagaaagatgaaaacttatctttgaagtttaagtccagggatcttcccaccttgccatacggtttacttgctggaggcaagttcatagaaaaagaaactggatccaaccaatgggccatggagctgacctgcaaatgtcagctctccctgaagcctaatgcagcaacaacaaataattctgacactaagaggagacatccaggcatcgcaccttggcatctctctctctctctctctctgtctttccagggacacgtcaacagacaacaggcctgcatgcaataacagtcattgaaaattagctgatggtagttatttaacaaatttagggtataaggacagacactgaataatttgggctacacgcctgggttttagactgagacttgacaacaggctaaattgcaattcctccctcagtttgttacaataaccaagttcagtcttaattgacatctgtgtgtatagtgagtaaatactgatttcagtaattgtatttaaattgaactgagtctttggaagaaagaatgagacactagggaagcagctgcaggtggcaaatggtagggctcagaacaaaacgtccttggttccagccccacctttgtcttcgctaattcagtaagctcctgggagccatttgtcttctcacctttctgcacttacaccaaggagaagctgtattgatgtatgtattaatgtcccatgagctttaaggcataaaacaaaagaataactatggcctatatgtgctgaacatatacaagactaaaatattagtggttccatgaattgagaccatactaaataaaattacataacattgggactttttcaattcataaataaaattggcagtgaaaaaacattactagctagtagaattggcagatattcatcacctacaatgtgaggaattctatgctaaaagatataaaaaatataaagttgaaaagtacacagctcttacttccaatgcatcacaataatatacacactgcacaaataaaggcataattttacaaatgcaatacatacagtagacatatagtgttgtgtatatgggtagagcactggggatttaaaggaaggagagaatgcaataatgggagtggggaggctgagggaggacctcacaaacagtagaggatttgatttggtccgtgagatgaatattgcaacatgtactggctgcggaagtatattcgagactgaaggatgttctaaagcaaagctagtgaggcaggaaagcagaacagcaagtagtctacatcgaatcccagggaacacagcagtgcaagagcagctgagaaaggtaggctggaatcacgtgaaaggtggagaatgccagacgggtggtttattattaacgcctcagactttggggatagcatgagaaacttcaagcactggaatgatagcatcagagttgcacttcaggaaatttaattctgcagcaaagcataaaattggaataggaaaaaaacttgaggtaaagagatcagtgaagacagcattgcattcgtttaataagaagtaacaagatctaaatgggaggggtggcaatgggagaggggaagataaatgggtgatggattgcctgtctctgtgacatcaatacagatatgaatgtctttgagctctatggaactggcaggtaataggcttatttagaaatgacattaagtctaagacaatgccccatgtcaacatgtacattaataatatgcataatctattaaatcaacaacaacacacatcttgaaagttatcgtaaagccaaatcttgacactttttttttttttgagacaaagtcttgctctgttgcccaggctggagtgcagtggcacgattttggcttactgcaacctctacctcccaggttcaagcgattctcatgcctcagcctcctgagtagataggattacaggcgcctgccaccaagcccagctaatttttgtgttttagtagagaaggggtttcaccatgttggccaggctggtctcaaactcctgacctcgggtgatccacctgcctcggcctcccaaagtgctgggattataggcgtgagccaccgcacccgccagtacataatttttaaaaatagtagccagttaagtcaaaagatgctttatttgcctctgttatgcaataaaaacgtggcccctgcttattctgaagtgtgagccatctttccttgtctggcttactctattacttgatctgttacttgatcttaaaggtcagttttcacatcactttctttgggaagccatgactatccctcagattaagtgctccttctatgcacgacagtatgagcctcaacttatgttatttcttgctgactagaacaatttcttcattagactataaactccatgatgtctgggcatttgtccaatttgttctcaaacccggcaccagtctcagtgcttggcacataggaagtgcttaattaacatttcactgaagtagtaagtgctttctattgcaagacagatctttgaaatgcaccattcttgtcagacccagtcaaactcacaggttctgtctcatgagatcagcaggaaagcattgccacagagggtcaggaatagattctccatgaatcagttcacttgaaagacaagaggtgttagtttgtgtggatgggagcaaacctttcctttagtaactccattatcaagagcatccccacagtccctacataatccaaacgcacacctgggccatcccaggagcacagcttgagggagcttatctgtaggagcacatgcaactgactggcaattaatttgattttgcacctgcttcagatcacctcggggcattgccctgtaccccaggaatcagtttcttcaaagtacaactttcaaaaatgtaggcttgcctctcaaacaactacccatatttccatgaccaaaagtcatatttacatcctctatgcgttacaaaaagtacttgttttagacacacaggcagggtgccaagtagaccataaccataattgttatagtcaacattttttatagttaacatgagccagaatgtggacttaacgctttctagacatcatctcagtctattcacgcaatgattctatcagttggtactatcattatgcacattttacaggcaagaaaacagaagcacagagaatttaagaacctttccagggtctgcttttaatattttcagagataaatacaaggcatctaataaaaggcactgctaaatatcaacctgtcaggcactagcagccaacaactggcaggttcttctgccacgaacactgaggtttgtttcaaccacacgtcagtatcacaaagagaatatccacaagggaaaacaacctccttgtgtgtaattcactttggggaagctttgactcttctattcactgccaaattccttgaacctggcacgtgttaggaatgaaataggtatttgttgatgaatagagttcagtccctgtgaatgggacttcattacttcctgaacttcagcgtcactctcagtcactccaccctgttgcctattgcagatcacaaagcagtggaccacagacattttcattttccccttggcctctggcatagagttttacatttaattagctgccacggtttaaaaaaatggcatactttacgtaaaaatgtggatttcctaattcccataaaaaactggaacatctaaatctctgcctgtattctgtaatggtgacagctgtggtgagctgtgactgccctctaatgagcacactcagtttgccccagtcctcatcaagccctattgtcttaactccacatagaggccctcaataatagagtcacatatggtcttacaacctagtggcctcactgaatgatattcttttctgatccctggaggcacacagttggcttagacctagagtaactaagattccagcctagagttaggtcttccatgatttcaaagagccacaaaaaatgtagcatcaatgccaattctgggatttgaatgctcacctggaggttggcccctcaccgtttgggaatttagtcttccttagaatctgttcttgccccgttgtttgtttcattcaacgcactctcgtctagcctctctcatcatctcgatgacaactactaccctcaggctgataattattagattgagatctccagccttgatccttctgagcctcaggctatcacatgctacttcctttaacatcttcacctttaactcttacagtcacctcccaaatgagtatgttcaaagcagaaagtgcccattcttccatcatttcctcccctgtatcttctatctgttggagttagcccctccgttacccacgtgagaaacctgggtggtcccataatcttccccctctgagctcactgcattcaaaccctgatccctgatgactgtgtcaagctcattatctcttctccatttgccttgccacttcctggtgtgggcctcatacctctcagctgatcctctgtaacagccattctctctgttcaaggcttcttcaaatccaccctgcatggagacatcagagcaatcaagctacaaattaaatgtaattgagtgacccagctacttaaatgccatcagcggctttcctttttcactcagtctagcacgggggctctcaggggaagcacctccctctctaccccatcttcagactggattctcacattttacttccctcctcgttcctcaccaacaccatactgctttcagttccctgggtaaatcataaatgggtgactggagctatctctggggtgatataaacactaaataggcagagacttttgtaaggaaaacacttcttcacaaacatggaaatggaagtctatacttgagttgaaaagaatttaacttttcaaacttagatatggacaattgcacagagtttcttttgctttagtgatgctagctcaattccttttctccccactgcctttgcctggttaattgctactactgagtatttatgactctgctcaagtattttcttctcctgaagcctttcctaaaactcatggcatgctcacttgcgctctctctctctctctgtcacacatacacacacacacactcagaggctgggtttgggtttggtgcccttactgtacattcctttaaggttctgtccatacatttatcacggaacttaataagtcatatttaattatctttttgcatttatatctccctcacttaacttgtacatgcttaagaataaaggctgtgtgttattcttctttgatccccagaaccaagcagagtagttcaaaactgctaaacgaatgaatgaataaataagcaagcaaatgatgacaccagaaaacatatacacgagtcaggcattaaaaataggctctgatatttaggataaattgagccggaggcaactcaaccaccagtttgaaattagatgatatttttgccaccactaatcatgaaaccaacccaaactatgctaagaagttaagcagttgaatacattttgtatttgtctaaatgtcctagtataggcaacagaatagtgttcctcaatcagagagataaaattgatttttaaatattgactgactttctgtaaattcatagatgatgtaataacattgtggaataatgatttcctaccactgcctacagttgctattcacagcaaattatttaccagaatttccaggtaataaaagtgaatcaggtcagtgccacatataaaatatggtaattgctagtaacggtctcttagattattactgtagtactacattttgcattatataaacatgtattggataatagcagcattattgaatttgatgttcagcagttatctaaaaacacttataaatgatgctctactatacatagaatagacgtccaataactggaagaagttttctcaaagtaaaagtatattagatgattattcccagaaaagttaaaaaataaaaggatgtgttaactctaaagtatctatgtttagagctgggtgagtatgtcaaagttgatatatttttatggtattaattgaaaccaattctttaaaaaaaatttttttaatagagacaaggtctcactatgttgcccaggctggtctcaaacacctggcctcaagcaatccccctgcctcgacctcccaaagtgctgggattataggcatgaaccaccacatctgaccctggaaccagttattaattaaaattttggttactggcacatatataacacaaggggaacaaattctcaccatttctctaaaattaagacaacagaaagagctatttgtaatacacactctgaatagtaagctctgtgtaattgtccatatttaattttagaaagacttgttctttcaaactaaatagtagacttttatttcaagagcaaatctgcctcaacagatgtcttacttccaacagtgtctagctacttaatggttatatcattccaagtatatcatttgtttatttatccaacaaatgtttattaatcctttgtttcccagtgtgtaaaggtgaaaaagaggcagacaccactctcttatagtttataatcattaccctaatctgcagatgagctcattgagaccaacactcagggtctcacgatgaggctactacaggcagtctccaagtacagattatcatttgcgtagttaaaatttaattaaattgtattgagacaaatagaatgttatataacttttttcagtctatgggaactggatgtgatttatacaactttatgtgctttaaaaatatttgtaggacttctgcatccaggaagatgtagtatacatgcatatcctatttttttcactaagtaaaactaaaaaccctggacattatatataaagcaaacataagaaaactctgaacagtatagagattagcaagaccagacagggacttttggcgcccaatgatcaacatagcaaagagttccctgagttttctttttgcctcatatgtttcagatttggggatgacgtctggcaacctggtaatcccatcaatcaaaaagcccccaaaaagcctgcgctctctagccaaatgaccaggtagagagacatcccagcaagacagtagacttttagacagttgccactctactccagccaaacaccacagaaaacacttcccaccctcatttacaccgccaaggctaagcaaggagctgacttccaccctggtcaggctataacgagtcatcccaaaccgcaccggagtggtgttagagaagaagtccggactttcatccctgctaggcagcgagtctgcttttctcaactcccccgtgtgtcacatgagactgcatggggagcctgaacttccacgcccatccagtggaaaccagggagcccccctacttcagtgtagagtcagcaaaacctgtgcaggacttctatgccaaaattataaagcactgacgaaagaaagtgaaagggatctaagtaaataaggagacataccatgttcattaattttaagactcaacatagcaaagtcgtcaattcttcccaaatggatgtgggtttaatgcaattcctatcaaaatctcagcaatagtgtttctagataaagacaaaattattctaacatttacatggaaaagcaagtgaactagaatagctcaaacaattctggatgaaaagaacaaactagtaggaatcaatttcaatatagctacgtaatcaagaccctgtggtattgctgaagaaacagacacatagatcaatggaactaacacaatatacccacaaatatatagacacacaatatacccacaaatatatcaaactgatgttttgtgaagatgtgatggcaatttaatataataaaaatagtctttccaacaaatggtgctggagcaactggacattcataggcaataacaaacaaaaaccttcagcctaaatctcacttcttatacaagaattaattcaaaatggataacagacttcagtgtacaacataaaactacaaaacctttagaagataatactgatgaaaaccttggggatctagagcaaagagttttaaacttcatagcaaaagcaaggttgataacaaaaaaaaaagaaaagaaatattgaggtcgggtgcggtggctcatgcctgtaatcccagaactttgggagccaaggcaggagaattgcttgaggccagcagttcaagaccagcctgggcaacatagcaagacctcatctgtatgaaaaaaaaaatgttttaaattagccaggtgtggtgacatgcacctgtcataccagctactctggaggctaagctagtggggcactgaggtagaaggatcacttgaacccaagagttcaaggttacagcgagcagagcacagcactgcatttcagactgggtgacagaccaagaccctgtctttctggaaaaaaaaaaagaaaagaaaaagaaagaaagaaaaagaaaaattgctaaattgggctttacaaaacttttaaacttttgctctgcagaagacactgttaaggggagaaacaagctatactacagactgggagaatatatttacaaaccacacatctgacgaatgactcatatctagaaaatataaagagctctcaaaactcaacaataaaaaaacccaaataatctagctgggacatgggcaaatgatatgaagagacatttcaccaaagaggatatatagattgcaataagcatatgaaaagatgctccaaaatcattagcttttagggaaatgcaaattaaagctacaatgaaatattactacttacctattataatggttaaaataaaaaatagagataacatcaaatgctggtgaggatgcagagaaaatgaattccgcaccaccccacacacattgctgatgggaattaaaaatgatatagccactctggaaaatagtttggcaatttctttaaaaatgaaacattaaaatagcatatgaccaagccattgcactcctggacacttatgctagagaaattaaaaatatgtccacacaaaaacctgtgcatcaaaagtcatagcagctttatttgtaataccccaaactggaaacaatctacatttccttcaaccggtgcattaataaacaaactgatgattcaatttatataacattcttggaatgctagattatacaaatactgagcagacgattggttgccagagggtaaatatggggtaaggatggagggaggtgttgtggctgaaaacggtgatggaaatattctgcttcctgattgtatcaatattaatactccagctgtgctatcctactatagctttgtaagaggtcactatgttagtgctaggactgtcttagcaaagtatcatagatggtggctcaaacaacagaaatttatatctcactgttctggagtgtggaagtctgagatgaaggtgtaggtaaggttggtttcttctgaggcctctctccttggcttgtagctgcctgtcttctggtgtcttcacatgtcttcattctgtatcagtcctataggattaggactcacccttgtgacctaattttaacttaattacctctttaaagcctcaggcttcaaatagagtcacattctgaggtactgggatttcaacacacgaatgtggggcaacagacacaattcagttcaattcagcccctagcagttaccatgggcagggaggcgaactgagtaaagggtatacaggatctctccatattatttcttacaactgcatgtgaactcacaattatctcaaaatgaaaagcttctttagaaaaagatttgtaaaggagtttgattaactaataagtcaaatgtagtggaagtggctggaccttaactggagaagtaattagaatgtgctcacattgaagtttagtcttttccctgagataaaacaaaatgtcagaagagggaaaaaatatctaagtgcctctgtttgctttatgtatagagagaagctttttagtgatgttaatagacataatttatttaattcccaaaacatcattaggctgtacaactccatgtatacattgaatgagaatttatttcacattaaagggaattcagaatcaaagttcaaaatgcttttaaatgccagtatttaataatatcagtaactacaactaaagatcaattatcttcaccttcagtttttccaaaaaaaagagatttcagaaagcagattatctttagcttgaaaactcatgttgttcctagtaatttgagcatcaaatgtataaacctgtgtttatgttatcgcagccgattctttgttagcatttatcaaaaacataagacagatagtgtgtacaacttctcaatttctcagggtatttgactactatcactacatgcagtcatctgaaatcagacgtttcagttcctagcataaatacattttatgtatatttttgtcatccgatactaccttctgtattttttctcaactgtcttcttgaagaagctaacaacctattcaagaaaaattcacccttatcagataagactcatttgttggggttactcaactgaactattctagcatctgattctttcttcatggactggaagagcaaacccattgatcattaatccaatcctgctcacataatattacgggttatagcatttagctcttcctagcatctgattctttcttcatggactggaaaagcaaacccattgatagttaatccaatcatgctcacataatattgtgggttatagcatttagctctttctataatttcaaatgccttctctctgtggttgtaaattttatccaggagaaggctcactgcaatctgagcattggcttgtgtgtgtgctgggtggctggggcaggaggagggttattcactgttgcaatgtgtagtgaactcagaagccaggccacctgggttggaatcctggctccaccgtttactagctatgtgactttgggcaactattttaacctctctgcatttgtctccttagctgaaaaatgagggcaattgtagcacttacctccgaggggttttctgaagattaaatatttgtaaagttctttaaatggcacctggcaggaagtaaatgctgtgccagtgcaggcctttagtgcccctgtgctgcagtaaacagcctcctccctgtatgatccttgcatcgccagtttgcctttgtcttccattagaaaaagacagatagtgagagcaaggcggtcttcataggaattgcagtgatctttaccataggtgagtggtggatcattgaacatatctacacattaaatattgctttgtaaatatgaaaacgttttgaagaaagaaatctgaggtttgcagaaaattccatttaccagaggaattatgttagtcatattcctattgctcccatttcttctgggaggccttcttgtctgccttcctgaaccttattttcattaactttttcccaaaaaagtctacgcttggccctctaaaatctaggctctttccctgcttgatcttacctttccttctacactagaggagaggaaaggaaaggaagatcatggaatgcatgtttcaatgtggggccttctgtggccaccaaaggcctttctgagtaaagtagcaggtggggtagggtcttcactcatgtcctgctctcgtgatcatggcctgccctctgtgtccagccttcaaggtggcaaactggcttgtaaaggagtatcacttttgtgtagtttactttatatattttaaaatttaaacctgaaattcaaattcactttttaaaaattcatatgacacttttttcacagtaacaatttttttcccagcccaagaattatttcttatcattcaaaataccaagaccaaaatatatcacagaggaaaagagctaactatctaaatgcaattggtttataatttcttaaatactagttaacaaacaagctgtgccttggaactataacacaccaaggagagaatgtgttttcattaatggcataaagtaatagtgagcctatacagaagtcgctaaatgatgacattacacataggatttagttctgtgcattataattgtgaccaaacaatagttaatataggaagagataataataataaatcattaacttgggctctgtttacttttttatactctcattttcaagattactgatttaagtgtagttttctttttatgggtctaccaatggtcatttgtacataaagagaagtttcactttctatgagtctatttcacccaagaaaaaaggcattgtcacctcttcaaagggaaaaacattccttaaacaaatgaaacctttgaaaaggcaagtataaccaaaaagatcgaagaggagagaagggagctaattgtcttgttatgtacgatagacacagcaagtgtgtattaaatgagtattaggaggaagggttgcagagcaagaatctagttctttgcctataatcccagcacttagagaagctgaggtgggaagattgcttgagcctaggagtttgagaccaggctggacaacatagggagatcccatctctacaaaaaattaaaataaaaaacattaactgggcgtggcacacaggcttgtagtccgagctactcaggagactgaggtggaaggattgcttcatagccgaggagactgaggttgcagtgagctgtgatcacaccactgcactccagcctgggcaacagagcaagaccctgtctcaaaaaataaataaataaattagctatcaccagagaaaaatcaagttcaagataaggtgcttcactctttatttttaaaagtttacttattaaaaaataagtgcatatgtaaaatgtggaatatgaccacctatatatacattagagaaaattaacaatgacccagaatgtaaatctacagcatattttctctctgttctctaaaacttgtaacctaattgaattagctacgaagggagtctttgtagtttaaccttattcgtagatttgaattagtcttaccaaaaagaattaaattcaacattgaaaatattttatgtaaaaatttaatatgagtttgaaaaccttcatcttgattgttcttacttgataccaatcgtgtgtgtgtgtgtgtgtgtgtgtgtgtgtgtatgcagaaatggcaatcaagactgtttagatattagttaattggataaaatccaatcacagaatacaagccagattgaaaatgagagtccatcatgggattggtgatatggagacaaaagctacacctcattaacatgcacagaataaacagtcctgagattttagttttatcattattatttatcatacaatgtttgcaaacagagtctcctgtggatatgctggacttctgtgagtaaatctgttaatggtaatgggatttccacccactcagtgtggtaaagattaataccactgtgtttcgactttgctgcttttttatttgttagtggacaaacaatttacttcagagctccttcacacagttacactgtgcctgctgattgccccagagctgtccttgtctgtcttcaaaggctacacaggggcacacatggccagctctcccttccctgctgtgccacgtggggttcaccctgcagcccatcatgcaactccttactccacaaaaatcagcaatgcttgggtgtggagttcactacacacacacaagcatgcctgcagtcacttctgaaagtctaagaaatgttcatgcttttggaaacagggccactcatacacacacaatggaaacagaggtcttggctggtcaaaagatgcccccacttgtctaccagattgtgcatgaatacagcttttgtgtcagctgctcagggctttccaaagctgcatgcattttgtccaggttaaaacattcagtccgcttatagggctaatatattagcttgctgatacatttactaggattagtttgaatcgttgctccttattacccattgtgccctagaccaaaggcggagtctcttcccttagaattgagtacaatgaaggaaaacatccatgaggggcagaaaggagacaagtttgaagcttagggcatctctcagaccctgtgagtaccctaagggtactcacaaagatcagcataaagggtccagcatatgactgcagtggtaggaaaggaacttcaaggccaatttcaccctttttatagctttttatagccctttttatagctttgcctacagctagacctaataggcaacctctttttttttttatttttttatttttttttaattttgagatgtggtcttgctctttctctcaagaaagagtgcagtggcatgaacacagctaactgcagcctcaacctcccgggctcaagcaatgccccttcctcaccctcctgaatagtgggaccccaggcatatgccaccacacctaattttttaaaaaatttttattgtgataaggtcttgccacgttgcccaggctggtcttgaactcctgggctcaagcgatcctccttcctgggcttctcaaggtgttaggattatagtaacttcaatctaatcaaaagatatactcagatataagttagctgccctgaaaccctccacaggattttcaaaggactgctagtgttccatctgaagacggaaagacacattccctgcaacattttctgcacagtgagctgccccaaacaagctgccctgttgcaaatcacctttcagtacagcatattttttctcaaacgctgcatatttattaagcacaccatttttcctgcgtatggaattctgttctctctcaatgttaatctttaatgtacaagccatcttatgattgggtttcaaagtgaaccatataatatattcaatgaggaacatttttcttattaagactaattaacaggttctcgattcccacaaatgcctaggtgctttacagtgattctcttttcaatgacaatatttagccaaccaaaatttaacccttgagagtccttcattaccacagtcaattaaggagtgagtcactgatgttacatctctgctaagaatagtctgcagatgtgcttttaaggaaagaggaatttaaaaataaatgtatttgacaagttcctgatcagatgcctatatttacctcaaccaaattagaatggtgttgcacagaagttgaagtttatcctggaaaattcctaacatgtgttcaggtttgacctcagaagtctttttccattacttcggaaaaacatttggacttccttgggccatgctttttcttataactcaaagaggacttttcttcctgtggtcttttggcctccaacctcacagactgacaatttattgtgaagtaaatgtcatcagaaatagctcggtgtcatgtctctgtgaaaggagagcctcgctggcaccaggcacgggattcaggggcaaccaccatgcaaatcacttctcttcttggagcctccacttccccttctcaaagccaaagtgttggacttgattatctttatggaccttttgagcttcaagagttgattgatccaaatatcacagagggcccggtagctggttccctgagcccaaagtctctacattctgaggggggtctcagacacacattgtatatgcacagcatgttttgttacttccattgttagttctgcccgatcgagttttctaaacaaggaaatctatgttatgaaaggtacgggatttgccgttcctattcagaattcaacacagagattgaatatgtgttcttcatagtaaactaatttttaaatgtttttgttaaggaaataagttctgcataaaagtattaataatctcatatccaaactgaatcaagagatgactttagcaaactgcttattcaattttcttttatatcttttttattttattctttttaatttatttttatttttcaccatgttggcaaggctgatctcgaactcctgacctcaagtcatctatgttccttggcctcaaaatgctgggattacaggcatgagccactgtgcctggcctcaattttcaatattaagggaggaggtttctaccccaaatcagatttagaagtttacatgtgatttttgaatcagggttaagtagagatacagctgacagtctagggattctgacctactctcaagggtttacaacatgagtccaaggcttccctcactctaattacgttcctagctacctacatggtcagtgttagagtcctgtggttaaaaacctcaccagtttcccaaaaatcatatggatctgagaatgtgaatgatataaggagacgtagcaaacactcattgagtgctcactgtgtaagctgcacaatgctagttactctacatacatagttttatttattgggaggaagtgttgcatactggtatagatatgggctctgaaatcagactgttcttgttttgcatgtggctcacagactggcaatggtgatttagatatgtgaacaacaagaataagaaatttctaaaaggaaacattgagtgagctgcaaaaagcagaaaaagcagcagtgtaaataatcatggccatcttttaaagaaactagggaattgggtgagaccccagctacaccccttcaagggagttagggcctgtgcaggtcctccaaacaaacaaacaaaaaaaaaaaagaagaagaagaagaagaagaaagaaagtaggaacaggcagaaacaagatgaatagattaaaactgaaaaggttctggaagcaatcatgaaggaagacgtaacagccagagttcctgtaagagcaagagagggtggcttgagaatgactcaatgagcagggctctaggaacacattaccagacaaaaaaaaaagttaactaagtcccaattcaattcaaaggggaacacctagagaaatgcactgaaatagccttgcatgctcagggataatgactcataataggcttcttcctggcctgaagattatgaaaatatggaaataagagataaaacacaaagagaggattgtggtagctcatgcctgtaatccaagcactttgggaggccgaggcgggcagatcacaaggtcaggagttcgaaaccagcctggccaacatggtgaaaccccgtctctattaaaaaaaaatacaaaaatgagccgggcgtggtggtgagcacctgtaatcccagctactcaggaggctgaggaaggagaattgcttcaacctgagaggtggaggtagcagtgagccgagattgtgccactgcactccagcctaggtgacagagcaagactccatcttgaaaaaaaaaaaaaaaaagagagagagacttataaaagaagatgccaagaaatgagactgcctaagtcaatttaaagaagaaattggtgatcttctatgcctgacaatatggcttattatataaagaaagaaaaccctctggtatgaaaactcataaaatgttatataaaatatatcttaaaatattgagacatagctgagttggcaggaatataaggacaagagaggctataaacaacaggaaagcactatctggagcaacaagtatgatgctagctttcacttggagagcatctgttcatttctattgacagagaaactgagttttaatgagcccaagtaatgcaggagaccaatctgaaatacccacataaagccagaacctcaaagtgtgggaaaactaggacgggggtgaggggttggaaatgaaggaaacagtcttgcatagggaccttgcgtaattcagcctagactctgagtacagaagtaaataagattaaaatgtcttttgtgagaatttccaactacctgctcactctgacatggacatgtgtcttaagttcacattgcttgtgtgaccttagaatcttcaagctaaaaaagtaattgaatgtaccatgggttgatttttatccccaagcactcatcagaagcaaacaaatactctttgaaaaatgcacattaaatccatgcctcaaataatgcccacgtataaagtcccaaagaagatgcgctccttcccaatcaaaattctctaaacagggaattctctaaagagacaaaattctctaaagggaacagaccaccatgagtgtgaggcagaagacctcagcaacagattggcaaagtcagcagatactggatctattagattcaaatataaaataagtattttaaataaagaaatgaaagcatggtgcaagaataagaggcaatcaggtagagtagggacaaatacaatttctgaaagcaaaacattgaaaaactaaaataaaatttgtatgtgtagattaaacagcagattagatatagccaaagaagtaataggtgaaggggaagagaaatctgaagaaatgcagcacaaagagacaaagacatataaaattatttttaatgtcaaaatacatagatgatagagtaaaaagggttaacatatatttaattgtacttccagaaaaataaaataaaggaaattagagataggctatatttgaagaggtaacagctaagaattttttagagttgattaaagatgtctatcttcatactcaagaagcctaattaatcttaacaagaataaatcaagttaatccttaagtagacatagtagcgtgaagctgcaggacgccaaaaaaccaaagataaatagaggaatatagggagctgtaggatgcagagaaggatgaagccagatttttacaaagaaatgagttttgttactaacagctaggctctcaagaacagaaatggaagttagatgatgtcagaatagtatcttcaaagtgtggagaaattttaaaaaactatcagcctagaagtgtgtatccagaatatagtatgttttagttacaagagtgaaatatattttcataaaacagaacagaaaatttaatattaacagacctttactaaagaaacataaaatatgttgaactccaagtagaatgattctataaaaaaggtagaagatgcaagaaggaattcagtgggtgcaaggatgagagaagattactgtgtaggtaaatctaagcaaagagtaatggtattaaaacaattttaaaaagtctaatttagggagagttagaatttaaaatagatataaattcctccaaaaataatagcatattaatctggacagaatgatcagacttaaaaggagttatgatgtgggaattatttgggaggtgggcaaatattctgatttagaccttaggttaaatatgcacatgaagatttctaagacaatctctaaaagaatacaaatagagtgtataacttccaaactagcagcaaaaaaaaatggaatgagggatacattaatcaatcaaagggatgacaagaagagcagaaaacaagagcccaaaagagtgggcaaatataaaatgtaaattatatagtagagatagatataaatatattgaaaataacaatgattgtaaaggaactataatcacaattaaaacatgagagcaattaggctctttctacatctacaataacaataataatgatcctaaaacctaaggattcaaaaagattaaaaggtaaaaatatgattaaaaaagatagctggtacaattattcaagtatcaggaataaatagaagctgtcaaatacaacacagctagtcacggtggctcatgcctgtaatcccaatactttgcagagctgtggcaggaagattgcttgagcccagaagcttgatcccaaaagcttgataccagcctggacaacacaatgacacctcatctctacaaaaaaaaaaaaaaaaatgtttaaaattagccaggcatgctaatgcatgcctgtagtcctagctactctggaagctgaggtgggaggatcacttaagcttgggaggttgaggatgcagtgaactgtgattggactactgcactacagcctgggtgacagggtaagaccctgtctcaagaaaaaacataaaaaaataaagtacagcacattgtcagtgatagaaggtaattacaattaaaaataaataaatcaccaggaaaatataacagttctaaacttacaggcatttaataatataccaacaaaatataaaaggcaaagattttcagaaatatgaggagaaattgacatattttaacacagctctcagtaaataatagattagtagataaaaatgaggaagtatatagaatatttgaaaaatgcattttttaagcttgatctaacaatggacatatggggaacattgcactcgactccataatacatgttattctagagtaatgcatggatcatttatgacaacagaccaaattctggaccctaaaccaagtctcaatatatttcagagttggtttcacacagatacatttctttgactacaacattctgaagttataaattaattaaaaaaatataacttaataagcattggtcagttaaaaggcataattctcaacacaaacagaaatcatgaatcgaagtatagagcataatgtaaattgaaaaataatttggatgaaatgcaataaaagcatgatatattattacttatgaggtatagctaaaacagtgtttagaagaaaacaataagtttaaaaataatatattggaaaaagaagaaagactcaaagttagtgagtttggtatcaaattaggaagttaaaatagaaaataataagcccaaagaaaatagaaaaaaatgagattataattatgaaaacagaaataagtaaaatggaaagacacaatacaaaagattaacaaaaatttttttctttgaaaataataacaaattgatcaatacctaacaatgatgatcaaaaatttaagaggaaagcacaaattttaaaaagaaataaaaaggggcattaatatatttgctgaagaaaagatattactaataactttatgcctaaaaatttgaaaacttggttgaattggacaaagttctggaaaaatacgtattataaaagctgattcaaaatgaaatagataccactttatactcagtaggatggctaagaccaaaaagatagaccctaacaagtgttgagaaggatgtgaacacattggaaccataaaatatcaatgctgggagtgtcacctggtgcagttgttttggaaaacagtttgaaacacagttcctcaaaaagctaaacacagaggcaccacacgagccagcaatcccattcctagatatacgcccaagagatttgaacacatacgtttcagaaaaatttgtacattaaagtgcattattcataacagccaaaaatagaaaaaaccaagcatctgtggattgatgagtgaatgaatcaaacatagtatagccatgcaacaaaatattacttagccttagaaaggaatgaagtactgataaatgccacatggataaaccaggaaaccatcatgctaagtgaaagaaaccagacacaaaatatcaaacgttatatgattccatttatatgaattgtccagaataggaaaatccaagacacagaaggtagattagtggttgcaatgggctagagagaaagaggcgtggggagtgactgctaatagaaatgtggttttttttgcagggggtgatgaaaatgttctggaatttggacaacactgaattgtacactttaaataggtgaatgtaatagtatataaaatatatctcaattaaaaagggcaatggaaagcctaaatgttccataatcacaagaacattaatcactacattcaaatctttctaaaaagacatcagtctcatttggttttacaagtgaattctataaactttaacagactttttataggtaagaaagtgaatactacacaactaatttatcatgctagtataacactgatatataaaacagcaaaggaattctaagaaataaaaattataggacatgtttcctatgaacatggacacagaaattataaataagtattaataaactgaatactgcaatgtacaataagagccaaaggccagtatcaggttaatacttttgaatatatattactatataatatccacattaacaaattaatggaggcacatctcaatagatgcagaaaaacttctgataaaattcaacaaccatgagtgatttttttttttaattccacagcaaaggtcctgttcaatgattgaggttgtttaaaaaatccttaagagcaagagacatagggattaggaagaaagaaacaatactgtttgtttgtagatttataatcagttacattaaaaaaaaaaaaaaaaaaaaaaaaaacagaaggaggggagcagtggctcacacctgtaagcccagcactttgggaggccgaggcagatggatcatgaggtcaggagatcgaaaccatcctggccaacaaggtgaaaccccgtctctactaaaatacaaaaaagagccgggcatggtggcctgtgcctgtagtcccagctactcgggagactgaggcaagggaatcacttgaatccaggaggcggaggtttcagtgagctgagattgtgccactgcactctagcctggtgacagagtaaaactccgtctcaaaaaaaaaaaaaaagaaagaaaagaaaaaaaaagaaaaaatcaaaatgggccaggcacaggggctcacacctgtaattccaacactttgagaagccaaggagggcagatcacttgagctcaggaatttgagaccagcttggccaacatggcaaagccctgtctctaccaaaaatatgaaaattagccaggcataatggcacacacctgtagtaccagctactcaggaggctgaggcacaagaatcacttgaacctgggaggtggaggttgcagggagctgagatagcaccactgtactccagcctgggcaacagagccagactgtctccaaaaacaaaaaacaaaacaaaacaaaaaagactcctgcctcataatacaaaacaaaagtaatttcagatgaatgaggaaataaaatatgaaaagcaaaatgttaaaaccattaagagaaagtataggaagcgaactcaggatatggattaatctctcttaaaattacagaaaatgaaaaccatacagagagttattaataaattcaactacattaaaaatgagtactttttctttcatcaaaagacttcacaaaacaggaaagagaagtagataaacagtagatatttccaggaaatataattggcaaaggattagtatccagaatatgtaaagaacttttaataatcaattaaaaaggtgaatgatttgggcatttcacagaagaggaaatacaaattactaataaactttgcaaaaatgtgctccagcatttcagcaatcatgggaatatacatcaaaatcattttcagcaagttgaaaatttaaaagttacacaatgccaagggttggttagtatgagtagtgacagggactcttgcgtactgctaatgggaatgtatgttactttatgtattttatgtactatcactttagaaaataatttggcatcatctattaaagtttaatatacacagccccaaaactcagcaattctttttctatgcatatgcactagagaattcttacacacacatcactatataaatacaagatgattcatagcagcattatctataattatgtatggcaaaacaacctagatgtccattgattgtaaaaaggaaaaataaaaattgtgatatagtcatatcatgaaatcctatactgccatgaaaatgaataaaccacagctatattgacatgtatgaattttgtttttttgtttttgtttttgtttttgttttgaaacagagtctccctctgtcgcccaggctggagtgcagtggtgcgatctcggctcactgcaagctccgcctcccgggttcatgccattctcctgcctcagcctccctagtaactgggactacaggtgcccaccaccacacctggctaattttttgtatttttagtagagacggcgtttcactgtgttagccaggatggtctcgatctcctgacctcgtgatccacctgcctcagcctcccaaagtgctgggattacaggtgtgagccaccatgcccggccacatgtgtgaatgtttaaaacacaatgttgggtgggagaggcaaattacagaagggcactatactttgattattttatatgtatttaattttatataaagtgactatatgaatatgtctgccccattaatatgagagttttcctgaactaaggaaaactcgcaaaatattttctccctaagagaaaaggccctagaaatcagagtttaaaatttctggcctgaaattatgtctgctagggtaagtttttagaccatgaacagataaaagtggtttctcagagcatgtgctgtctagggcgggagattagggtgggatccttcccactcagcctgctgattgggcactattgcccctagtcaaatcagaagatacaatctgtccctcctccgccacacacaaaaagcctttgagagaatgagaaaaacaattgtaagagtaacggttaccacagtaagagtagcaacaaggttatttcaggcattgttattcatgtacacaggtgttcagtacgaagccttgctaaataggctgccatgctgtcagcaatgccagctgcataagccaaatctcctaacagaaaaggcctccgactgcatacttctgagaatcttccaaagaaaaatctccttgtgctgtgtgagccatttctgtctgaagggctgattgatggagtgagccaatgagagattactgttcccaacctgtagcctgtgtgctgctgcactttgtcctcctgcctcactccactccaatacttagctcagcccccaccctgaaactatagcgttattcccaggaaggcagaaaaaatctatgctgaaagttcaactcaaccatcacgtggaggtacctggcccagcgcaaactaaccttggagcttttatccacatgttacaatgtgcataacatgggctcaacctcagcaggcacagccattctgccagggttttggcgctgggagacgaatcaaaaactttaactgactgatttcttttttttttgacacagaatctcactttgtagcccaagctaaattgcagtggtgcaatctcagctcactgcaacctccatctccagggttcaagtgattctccagcctcagcctcccgagtagctgggattacaggtgcacgccaccagtcctggccaatttttttgttgctgtattttagtagagatgaggtttcaccatgttgcccaggctggtcttgaactcctgagctcaggagatctgcccacctcggcctcccaaagtgctgggattacaggcgtgagctactgtgcccggctaactgaccaatttcaagaggggatcagtagtagttccattgcgaccagcttgcccaataaagtttaggggacagtggctttatgttttcaccatcagacaaatacctacacaatgacaagcaaaacctttgccaggcagtatcttctgaaagagattcctgcagttatccaaggaaatagccacttaggtcaatggacgtttgcagagtggaagatagttttcaaagagcaaacccttacagaaaagcaatagtgcctgccccaaatgtatgtttattgtcaaaaacctcaatccctctttttagaaaaattggatagggaaaaattcattaaccctagagaagtaacttagtcctatctttcacccgatttttgtttgaaatgatggtatagcctacctgattgggaaaaaaaaaaaaaaaagcagaggttaggagtgaggaatgaagcaactaatagtaaaaatacacagatctagatggtgaaccagtgatctggacaggacctttatgatctgccagccaagaaaccatcaaagctaactgtaggaatgtgctgataattaaaaggtaggtgagcacaaaagaatattagaaaccattctatgtggcaagactgaaaagaggatatgacttcttaataaattagatagaaagtgagagccaaatccatgcatcattccaaagttgagatcacagaaggtagatgcaccctagggctcttggtagatggacactacggctcccctgagaggggagaaagggaagataacacacacagactagcttttcaaaaaggttggctaagaaagaaaggaaagaccccacataataacaggggtggaagtaaagtttccattcaacaagtgttttgattcttttacactgttttgtacagctatgttagtgtcactatctactattatcattattctttcattaagagtttgtggagtaccatgaaatgatatctgtccactactgtataatagacagccctgtagtcctcccttcacagaaaagaaaccgctaatcaccagcagttctgttaaagattgcaataaaattcaggcaagacattttttcttgagaacttcatttttagagtactgtattttctaacctgtagaattttaagggacagcccataaattccttttctttctagctgaagaattagaagtctgagactggggaatttgagacttctttaagtcagttttgatgcttggtttattaaaccattcgttttaaaggaacgtaacattaacctctcacagtaaattgtgtctgtcaaatactttgatatgatgtcagttggcgagtgaatgacactgagcccccaccctcactcctgagattgagtcagccccagttacaaagcttgctggcaagcaaactgcctgtcaagtttgctaaaaagaacagcaaaagtgggaacagccaagcttgtacaattttgcagtttctttctttctttggtatatttttaggttgccaggaatcgatttcctcttctatgctttataagtttctattcataagcctggcaatttattaaacttcattttattcatataaaatagtcactgctctggaaaagagtgactcaataaagcgctcttcttcccatacacctggacttctagccagagaacaagatgcggtgtgcacaagtaccaatcaatgaaatgaaaaacactttatgaaaaacaaagcttagtcttgaaaatctgaacatttattttacaagtcgctgattgaagggatttttgcaatcaaaatgaatccaggcaaacccatgctactggattttgattaattaagccaaaatctgcacatctgcgtaatgtctagctcataagtgagatggttttaatcagtgaggaaaatgtggtttggggaagaggctgcaggtggagtttgctaactagcacattttatttatttttctcttagtgggtttctactctttagtaaggttattataatccttggttttctggtttcctgcccactatttatctctcccactaaagatctcccacatgccctgcataacaataatcaactaaaatgcagtagtcaacctggtaggctgaagctttgcttcatagaacagggatgaagctagaaaccacattttgtgcattatgtctattcctagcttcgtaaagaaccatggtgaaccagtcaagacagccatgtatacaaataaagaaaattattacaaataaagaaaaataaagagagtgttactggaaggataagcaactgcctgtagctctgtgattgaggccttacatatctaaaagagcattttgcattgaactcttccagtagccctaaaatccaatgttatgacttattatataaatagtaaatgacttgaacttttagtcatggtggtattaagagattagcaaatcctctcaggttaaaaaaaaaaacatataaaattgtcgaaaattgaccaaaggtgataacaaattgagatatttattctagatttatttatttatttatttatttattttattttgcattcattctctctttatatagactctggttctagaaacaattcgcctgcagccagctggctggactatttacaggcccattgcgggctgtactttggccacctcccggcacggtgctcagctgtgacgccgaaataagttagggctggccgggcggtgcggggcagggactagggctgtacacacaagtgctgggggctcggggcctcactactgccgagggccgggccggggctgtaaacatggccagggctgccctgcccacccctagtggtcggtaacgactggaagcagagcagccaggcaaggtcgggaggctcaggcgtccgacagtcagctctggatccggtccacccactgctgggctgagggcacgtcctgggcacaaaagtcgtaaacgcgaggagttgtcttcacgtcaaagaaggccttctcatccacgctcttaggggcacccatggtggccatgccaggtgccacagcctccacctccacctccaccaggtcgatgacacccttgcactcagtgtccacacggtggtcgtagtagcgtagctggtgcttggtcttgtctaacatgaaccagcgggccttccagggcttcatgaaggcccccttcttgtacagagtgccctcgtaggacctgttctcactctcagctgtctggaactggctgtaagggtgctggtgctgccgcaggcagcctggcgggagccagatgcggtcgagcctctattctggtcactctccaggctgaggctcaaggtggagcccacgggttcctcctgcaggtacatacccagcgagcagcggtggtgaggtgcggtggacactaggagggagctaggggtgccacgtccatctggccgggcttcaaggcgccatgcagccttcacgcggtcccaggtgtccttccagcgcttagcgggtcggctcagctctgtctccaacctctgcaggcgtgagatggcgtcaggctgggctcgggggcagctgtggtagcagggccacaccacacagcacctgctctggggagcgcctccgtcaaaccgttcttcctcaggggctcagggggttccccgagccagttcccagtcatagggagggccctcggccagcatctcctcagcgcagaagtcctacactttcaggttggacacgttgctgtagggccgcaggacctctgtgtcctcgggtgcattcatgtagttgtggaacatggctgtcctcttgctcatccggtccacacagagacctgcaaggcagctggctcctgcgctgccccttctcctcgtacagcagccccagctcaatgtgctcatagtcagagtccagtaggaaggtctagaaacagcgggacacgtggtggtagccgaggaacttgagatagaactggctgaactcaaactccatggggaactgcaggtggagctggtgtaggcagtccaagaactacaggaagatagtgtgaagccgctgctctgtccagccagaatgtgggctcccccgtggctgaagcgatgactgaaggacagccactccttctccaccagcaggtggaacccctccagcgttcagtagaaggggtctgagaacagctgcaccaaggataccacatgggtggtgatgtcccagccgtcctccaggcccatcagcacggaggaacttgagtccaggagctcccccctcccagcaccgacacctgcagcagcttgtggatctgaatcagccactctgagtcctccagcaagcgcaggaaggagactaggctgggctcagcagtagggcagcccaggacacatgccttcagcagctttttgaagctagccttcacctgccgcgcctggaataccttaatgggcaccagctctcactgctgcaaggggtccggccgcacattcttgagctggcctttgtccccgaggatgtagagggctgcttgctgtggccacaggaagcccgggtcgggggccgggggacacccgttggcctggggtggggccatcgcctctctgccagctagctgggagcccacattggcaccaagcccactgctgcgcccacaggtccagacactgcccccacttacctcggggtgcagtcagtctggatgccgccgccatggggttagacagagtggtgaccctggctctggggctgccaatgtgactccccacgtgggctgaggagaagccgctaagtgtgttgcgtccggacgcactggagtagcggggcatggagctgacaacagcctgcaggtacttctcctgctccaggctactcgagtctgcctggaactggcctggagaaggtgcgttctgggccttaaagagtccgactacacctatgccgtacaggcccccagaatgcagcagtactgccttggaccgccggatgcgccagcagacaacggtgaagcggttctggcggtagcagtaggacacgcgctgcagggcgttgtcctggacactctggggcacgatcagcagccccgggtacctgcggtagatggcatgcatgcggttgaccagagaaatgcggaaggattcagacttggcccggctcaggcggctgctcagggggcccaggccaaggcactgatagtcgcggcagcaagccctttccaccaggaggctgctcatggtcatgccgtccgagggcttcaaggctgaggacggggtcagtgtgctgggctccagctcttccgacactgagatctcctcctcctggtcctcagagggcggctggctccagtgctcctagctgagttggggttgtacttcttgcgagtgacatgctgccgcccgatggtcttcttgacgttcttaaccaggttccaggacagggttctgagggaaggacccttgttcttggtgactcggggtggctggccgggtgtgtaggtagagcccagggtgaaggagaaggtggccctgacatccggtgtgtaccgcagcttatgcagctgcttgcagaagagctcggcactgtcagaccccacctcctcatcaaaggccattttcagcagctggaatgtgcaggagcgcagctgcagcccgtcctgcaatagctgatccaaaggggtctggatgctgatgcatttctccttggtcagcgcggccaccgggaaggagcggaacaccaccttctcccccaccagggggtctgtgagcatccccgtgaagatgacccggtacgtagtgaggaagagggcgccctcagctgggagcagtgctggccaccccgcactgcccgccctcgcaccctcctcacgcccatccggtggcaggtagatgcgcaggccatccagcacacactcctcaccagacagcaggtgcagcctcaatagcttgggtttctagatgggcatcagcctccggttctcccgctgcaccgcctccagggtcttaatgtttatctggacgatgtctggcaccatgacatgcagccccttgaggtggtcactggtgaccccactctctgtgcagaccttgtccacaaagcggttgatgaagtggaccacagccccagctacattgcaggtctctctgtcctcaaagccgctccccgtgtcatagctctcagccacactgccagccatgctgttggggaccaggctgttgctggtgctctccaggtcacccagctcctgaagcaggcggctcttgctgctgtccagaggcagcaggaggtagctcacgcagttggtatagtggatggcctggctgaacactgtgctctcctccttctgcatcagctcctgctgcttctcaccgctcagggatggccacaggcaccactgctcagaagccacttctagggcagagtgctctctcatcctcctgggaaggtgcctccccaacctcctgggctggggcctgatcctcggtgggctccaggtaaaggacccagatatgagtctgcatgtcccagtagaacacggcctcccagaactgtggcatgctccacaccacgtgctcctgcacagagctgtaagagaactaccttaccccttggctccgcttccaggaaggctgtgaccagaggcagcagagcagccgagatgccatgcttgtccagagaagtgcagtcctgcaggcagcagttcatcatactgatgacaaagtcaaactgctggtggtccaggaccacccagttctgttgcacatgcaggtacagttcccgggtgaggcagtggcaggcagctcaccacttcagggccctcagcacagctaggagcagcttcttggcctcaagcatcttcccctcaaacacgtgggagatgcagttgcccacgacctccagctgccctgggctcttgacctgcagcctgctgcacccatccagtagggcagtcatgcggggccctgagggccctgtggtcctcctcccagccttcatggctaggggtgcaccttgcatcttggcctcagcctggtccacgatccactgcatggcgccctcatccagccaggggaagggccggggcgcccatctcaggtggctgctgtcacccggcctctgcatgttgtgcatcgccaagtctgggtacaggttcttgttcttgcagagctgctctaccagttcttggatgtgatgcaggactcattgggggtggttctcatccacccacctctgtgccacatcgtgggccaccagctcatcaaacaggtccgtggggcagtacgggaccccacactccaacacaaagagagcaaaggccatgccctccagcacattcatcaggaaattgtcctccaccagcccacactggcccaggaaggctgccttatggaagcggatgacaggctccgggtgaatgcacacgacgtgcaggcaccagagatagccctgcagcagctgatggaagagccgcagctctttgtcctgcatattcaaggaggagggggacgtcatgggtggagggaaggcgaggtcaaccaactccagctccgggtccaggaccattcttagaacactgtgcgtctgactctgcagtggctctagcaagggtggaatgtgcacacactcagggatggtcaccgtctctccatccagatcagctacaatcacgtctagcagctcctgggtctctgcctggaaggccgcattgaccccgattatgaagggcgtgggtgtgctgagggcctccagcagctgggccggcaggatgggcacataggtgaagctgtatctgagaggaaacagcaatgccaggaggctcctgcaggcatcggtgagctgctggtagctccgggacaggaagagaacctcgtgctccatgagggtggcacagaccaaagacagtacgttggtgatgcccagctggcggaagagcaggccacgctgcagctgctgatgggcagggagtcggccagtggagtctggatgacctgccggtcaccagcccccaaataaatcgtcctctactagcccccagccaggggcacggtgcacgtcagcaggttcccaattacgttccctgggaacacattcaggccctccacgtggacggcatagatgaggccgaggctgttcctgaacacctccgcatggtcaagtcgcgacacaggtaccagcgtctttggggcaaacatctgggcagatgggcaggctctgtgggcgacaggtgcgtaaggcctccctcatcctcctcttcctcccactcagtggcatccttagcgcgtgtcgtttcctgctcccagaaggtcaagcagcacagtagtggcgcccggagttgatgtcggtgaggacagcaacaaagaaggtcggtggattcctctcgggacacatctgccacccgctggactggcaaaacagctgggggaatgggttggcctcccagtccttctccgggaagaactgcagaatatggccctggcctttcccactcccgcgcgggtgcggcctgaatgccaccagcaggaagtagtctgtgatccgcgccatggggagggacgctgggcgggctccgcggctcggggactcgagggctgcgcgctcatggcccgggcctggccctggaccgcacacccgggacaccccgggttcgctccgcggcggccgcagcggctgcggctgcggcggcggcccgggctccagacaccatcttctcagccagctggcccgcctggctgttcttgaaaatgttatagagcttcaggtaaaggcagcaggaatctgtggccctcttcgcaaagactacctccatccttcctccccctcagtcagtaagaacagtaattttaccaacctgaagttcaacacggaattcataaactttggtgctagagggggctggctcaattgggcaataggtcaaaatactatagccttcctcgctaaaagtggaaactcagtaggaaacaaaaaaagaaagaagacttgtagcttttccagctcaagtttacaatcacagttacaagtggtagaccaataagaaattgaatagcgagatcctggatatgatacaaccacagtaggattagataagatcaccacacatttctggcctgcagataaccaatgcatttgtgcaggtgagactcaagaaagccaggtgggaaagtaaggccatggcagacttgagaatgggaggactctgaatgtgcttcctgacccacacaaagatcagtcatcaggaggtaggagctttatgggttcaaggtgcttgagaaaaatctggccaaatcttgactgatctctgagttatgcagacaaagggacaacctcaatagctacatgtcatggggaagaaagattatacagtttaaatctatggaaattacttaatcaacaacaacatcctcagaaaaattagtcagaattcagagttgccataatatattatctaaaatttccattttggggcaaaacaattactaagcatgcaaataattaggaaagtgtgatccatactcaggaaaaaaaggaatcaatagagattgactcagagtagcagctgggtgcagtggctcacacctgtaatcccagcactttggaaggccaaggcgggcggatcacctgaggtagggatttcgagaccagcctgaccaacatggagaaaccctgtctctactaaaaatacaaaattagcctggcttggtggcatgtgcttgtcatcccagctactggagaggctgaggcaggagaatcacttgaacccagcgggcagaggttgcggtgagctgaggttgcgccattgtactccagcctgggcaacaagagcgaaactctgtcttgaaaagaaaaaaaagaagaaagaaagaaaaagaaaaaaagaaattgactcagagtagacctagatgatatatgtggcaaacaaataattaatgaaacgcatgatgtctatgattccataaataatctttagagagaaatagaacccaaatattggaagtgaaaaagaaccaaatagaaattccagagttgaaaagtattttcaatatgaagattttgcttgttatatcaacagcaaatttgagatgaggggagaaagaagcagtaaactgaaatatagttcagtagaaatatctcaatctgaaaagtacagacaattttttttgaataaacatagcatcaaaggcatgtagggcaatgttaagcctaccaacatatgtgaaataagggtctcagaagtaaaaaagagaagggaaggggaaaataatttatgtgaaaaaataatagataaaatcctccaaaatttgatgaaaggctgtctacaaatattaaaagctccacaaacctcaaataggataaacatatcagaattcacacctagacacatcataatcaatgactgaaatagaaatacaaagagaaaatcttgaaaaaagaaaaaaatgactcatcagatatggaaaaaaatatgattaatagctgacttatcattataaacagtgaagaccaggaagcagtaaaatgacatattcaagtgctgaattttttttccttttcttttttttttttttgagactgagtcttgctctgtcacccagactggagtgcagtggcacgatctctgctcattgcaagttctgcctcgcaggttcacgccattctcctgcctcagcctcctgaatagctgggactacaggcgcccaccaccacgcccagctaattttttgtatttttagtagagatggggtttcaccatgttaggcaggatggtctcaatctcctgaccttgtgatctgcccgctttggcctcccaaagtgctgggattataggcgtgagccaccgtgcctggctttgctgaatatttttaactgtcaaccaagaattctgtgtccatcaaaactattccccaaaaaataaaagcaaaataaacacatttccaagtaaatgaaaactgagaaaatgcattactagaagatttgacctagaagcagcactaaaggaagaactttaggcttaacaaaatattcccagcagcttaggcttaataaaacattcccagacagaaactaaagttcacggggagaaatgaagagcactggaagtgataaaatgtaggtagattgaaagacccccttttccacttactttccttttgaaaatagacattttaaacaattattataaaactttattgttaaagttttacatattcatacacacacagttaggtttatggatatgtgtgtgtatttatttatgacggtaataatcaaaaaagaggaaagaaatggaattatattaaagttgctgtattttactggaattatgttagcattaacctgaggtagaactacacacaaaaaaaccataaaacgttactgtgagaaatttaaagatctaaatgaaaggagatataccatgctcactgattgaaaaacattattgttaatatgacagtcctccccagattgatctacagctgaaactcaatccatacgaaaattccaggagcattttttcatagacatagacaagccaatccaaaaaaaaattatttggcaatgcaaaatacttagaatagcctaaacagttttgaataagaaatacaaatttggtaaatgtatatttgaaatgagatagttcccttgaccccttcatgagtcttgtgaaggggttggcttgtttactcagcccacaggtctcaacccctcatgggaggggaagcatgcaggtgagcaggtgcagaggctaggatgagtgcttctgggcaaccagcaggagcagaactccatatggtcccgtggcagtgtctaggagttacccatgacccctggagttacagtatgcccttttagttttgctatccgtggatggcttaagtattagacagctcagtggagggccactgtgacagccttttgcacccacacctgggaccttgtccagcatccaggaggagtcaggttgcatgaatgaattgaaggatggtaaatgcagaagattttattgccaatgaaagtggctctcagtgggatggggagctggaaagggaatggagtgggaaagtggtcttcccctggcgttcagccgggaatgtccccagacaaactcttctctgaggtcctactgtcaagctgtccctctgaagtcaagctgcttctcactgacatcaagctgctgcttctcttctctccttttctgctgcactgctttgcccctctgccagtggagcctagggtttatatgggtgcaggatggggagcagggcaggccagggtggttttggaaaaggcaacattcaagggggaaaacagaaatgcacattctcactttgggtcacaggtccaggcttgagggggagacctcaccagcgaccccacccttttctacctagtacctcctactcatatcacactgactaattttgatactaaccataaagctacagtaatcaagagtgtaatgatattggagtaataaagacagagaaataaatcaaaggaacagaatatagagtccagaaataaactcttacctttatggtcaattgagttttaacaaagaggccaagacaattcattagaaaaggagagtaatttcaacaaatgatgctaaaacaattaaatattcatgagaaaaaaaatgatcataaacccttggcttatattagacataaaaactactccaaaatagaacatagacctaaatgtaagtaagagctaaaactataaaactttagaataaaacatagaagaaaatctttctggccttaatttaggcaaaattttacttgattggataccaaaagtgtgactcattaaataatataattggaaattgaacttcataaaaattttaaaaatctgcttttcaaatgccaactttagaaaaataaagaaaaccatagactgaaataagatatttgaaaataacatatctaataaaggacttgtgtccagaatatatcaataactcttacaactcaataatataacaaacaattcaataaaaatagataaaatgtttgaacagacatttcactaaaaaaaaccaaaaacacatacacagaaattgctcacaagctcatgaaaagatactaaacatcttttagtaactagggaaaagtaaattaaaagcgcacacccactataatgactgcaataaaaaagattgacaataccaggtgttggcatgaatgtgaagaaactagaactcttagccattgctagtgatgaagtaaaatggtacagtcactttagaaaacagtttgatggggttttttaaagttaaatattaataatattaatgtatgacccactaattccattcccaggtaacttctcaagagaaatgaaatatgtctacacacagttttgtccacaaatatttctagcagaattattcataatagccaaatgctgaaaaaaaaaaaaaccaaatgtccatcaactggtgaatgcataaacaaaatatagtatatttatacaactggatactattcagcaatacaaaagaataacaactgatagatacaacaataaaatgaacctcaaaaatctggcaaataaaggaaaccgtacgcaaagactacctattgtattattccaattctaaaattctaaataataaaaaaggcaaaaccacagtaacagaaagcagatcagtggctatctgaaatgggatgggagtgagaattgactgcaaacaggcatgagggattttggagtgatagaatattctcaaatcggattatgacactggttgtgccactgaataaatttgctcaaaatcattgaaccatatgcttaaaacaagtggatattatggctttaaattatgcatcaataaggctgttttagaaaccaatagatatttatcaaagaaaataaaaacaaaaagtatgggagggtggagccaagatggctgaataggaacagcttcagtctacagctcccagcatgagtgacacagaagatggatgatttctgcatttccaactgaggtatcgggttcatctcactagggagtgccagacagtgggtgcaggacagtgggcgcagcgcaccaagcatgagccgaagcagggtgaggcatcgcctcacccgggaagcacaaggggtcagggaattccctttcctagtcaaagaaaggggtgacagatggcacctggaaaatcgggtcactcccaccctaatactgtgtttttccaatgggcttatcaaacggcacaccaggaaattatatccctcacatggcttggaggttcctacgcccacagagccttgctcattgctagcacagcagtctgaaatcaaactgcaaggtggcagcgaggctgggggaggggcacccgccattgctcaggcttgagtaggtaaacaaagtggcctggaagcttgaactgggtgagcccaccacagctcaaggaggcctgcctctgtaggctccacctctgggacagggcacagacaaacaaaagacagcaataacctctgcagacttaaatgtccctgtctgactgctttgaagagagtagtggttctctcagcacgcagcttgagatctgagaacgggcagcctgcctcctcaagtgggtccctgaacccggagtagcctaactggaaggcaccccccagtaggggcggactgacacctcacaaagccaggtactcctgtgagacaaaacttccagaggaacgatcaggcagcagcatttgcaattcaccaatatctactgttctgcagccttcgctgctgatacccaggcaaacagggtctggagtggacctccagtaaactgcaacagacctgcagctgagggtcctgactgttagaaggaaaactaacaaacagaaaggacatccacaccaaaaacccaactgtacatcactatcataaaagaccaaaggtagataaaaccacaaagatgggggaaaaaacagagcagaaaaaccagaaactctaaaaatcagagtgcctctccttctccaaaggaacacagctcctcaccagcaacggaacaaagctggacagagaatgattttgatgagttgagagaggaaggcttcagaacatcaaactactctgagctaaaggaggaagttcgaacaaatggcaaataagttaaaaactttgaaaaaaattagacgaatggataactagaataaccaatgcagagaagtccttcaaggacctgatggagctgaaaaccaaggcacgagaactatgtgacgaatgcacaagcctcagtaactgatgcgatcaactgaaagaaagggtatcagtgatggaagatgaaatgaatgatatgaagcatgaagagaagtttagagaaaaaagaatacaaagaaacaaacaaagcctccaagaaatatgggactatgtcaaaagacctaatctacatctacttggtgtacctgaaagtgacggggagaatggaaccaagttggaaaacactctgcagaatattatccaggagaacttccccaatctagcaaggcaggtcaacattcaaattcagaaaatacagagaatgtcacaaagatactcctcgagaagagcaactccaagacacataattgtcagattcaccaaagttgaaatgaaggaaaaaatgttaagggcagccagagagaaaggtcgggttacccacaaagggaagcccatcagactaacagctgatagcttggcagaaactctacaaaccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcattaaacatggaaaggaacaaccggtaccagccactgcaaaaatatgccaaattgtaaagaccatcaaggctaggaagaaactgcatcaactaacgagcaaaataaccagctaacatcataatgacgggatcaaattcacacataacaatactaaccttaaatgtaaatgggctaaatgctccaattaaaagccacagactggcaaattgggtaaagagtcaagacccatcggtgtgctgtattcaggaaacccatctcacgtgcagagacacacataggctcaaaataaaggcatggaggaagatctaccaagtaaatggaaaacaaaaaaaggcaggggttgcaatcctagtctcaggtaaaacagactttaaaccaacaaagatcaaaagagacaaagaaggccattacataatggtaaagggatcaattcaaaaagaagaactaactatcctaaatatatatgcacccaatacaggagcacccagattcataaagcaagtccttagtgacctacaaagagacttacactcccacactataataatgcgagactttaacaccccactgtcaacattagacagatcaacgagacagaaagttaatgaggatatccaggaattgaactcagctctacaccaagcagacctaatagacatctacagaactctccaccccaaatcaacagaatatacattcttttcagcactacaccacacctattccaaaattgaccacatagttggaagtaaagcactcctcagcaaatgtaaaagaacacaaattataaccaactgtctctcagaccatagtgcaatcaaactggaactcaggattaagaaactcactcaaaactgctcaactacatggaaactgaacaacctgctcctgaatgactacggggtacataacgaaatgaaggcagaaataaagatgttctttgaaaccaacgagaacaaagacacaacataccagaatctctgggacacattcaaagcagtgtgtagagggaaatttatagcactaaatgcccacaagagaaagtaggaaagatcgaaaattgacaccctaacatcacaattaaaagaactagagaagcaagagcaaacacgttcaaaagctagcagaaggcaagaaataactaatatcagagcagaactgaaggaaatagagaaataaaaaactgttcaaaaaatcaatgaatccaggagctggttttttgaaaagatcaacaaaattgatagaccgctagcaagactaataaagaagaaaagagagaagaatcaaatagacgcaataaaaaatgataaaggggatatcaccaccaatcccacagaaatacaaactaccatcagagaatactataaacacctctacacaaataaactagaaaatctagaagaaatggataaattcctcgacacatacactctcccaagactaaaccaggaggaagttgaatctctgaatagaccaataacaggctctgaaattgaggcaataattaatagcttaccaaccaaaaaaagtccaggaccagatggattcacagcaaaattctaccagagatacaatgagaagatggtaccattccttctgaaactattccaatctatagaaaaagagggaatcctccctaactcattttatgtggccaggatcatcctgataccaaagcctggcagagacacaacaaaaaaagagaattttagaccaatatccttgatgaacattgatgcaaaaatcctcaataaaatactgacaaaccaaatccagcaacacatcaaaaagcttatccaccatgatcaagtgggcttcatccctgggatgcaaggctggttcaacatacacaaatcaataaacgtaatccagcatataaacagaaccaaagacaaaaaccacatgattatctcaatagatgcagaaaacgcctttcacaaaattcaataacgcttcatgctaaaaactctcaataaattatgtattgatgggacgtatctcaaaataataagagctatctatgacaaacccacagccaatatcatactgaatgggcaaaaactggaagcattgaaacttgtgcctttgaaaactggcacaagacagggatgccctctctcactactcctattcaacatggtgctggaagttcaggccagggcaatcaggcaggagaaggaaataaagggtattcaattaggaaaagaggaagtcaaattgtccctgtttgcagatgacatgattgtatatttagaaaaccccattttctcagcccaaaatctccttaagctgataagcaacttcagcaaagtctcaggatacaaaatcaatgtacaaaaatcaaaagcattcttatacaccaaaaacagacaaacagagagccaaatcatgagtgaactcccattcacaattgcttcaaagagaataaaatacctaggaatccaacttacaagggatgtgaaggacctcttcaaggagaactacaaaccactgctcagtgaaataaaagaggatacaaacaaatggaagaacattccatgctcatgggtaggaagaatcaataacatgaaaatggccatactgcccaaggtaatttatagtttcagtgccatccccatcaagctaccaatgactttcttcacagaattggaaaaaactactttaaagttcatatggaaccaaaaagaagcctgcattgccaagtcaatcctaagccaaaagaacaaagctagaggcatcatgctacctgacttcaaactatactacaaggctacagtaaccaaaacagcatggtactggtaccaaaacagagatatagaccaaaggaacataacagagtcccagaaataatgccgcatatctacaaccatctgatctttgaaaaacctgagaaaaacaagcaatggggaaaggattccctatttaataaatggtgctggaaaaactggctagccatatgtagaaagctgaaactggatcccttccttacaccttatacaaaaattaactcaagatggattaaagacttaaatgttagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaaccaccatcagagtgaacaggcaacctacagaatgggaggaaatttttgcaacctactcatctgacaaagggctaatatccagaatctacaatgaactcaaacaaatttacaagaaaaaaacaaacaaccccatcaaaaagtgggcaaaggatatgaacagacacttctcaaaagaaaacatttatgcagccaaaagacacatgaaaaaatgctcatcatcactggccatcagagaaatgcaaatcaaaaccacaatgagataccatctcacaccagttagaatggtgatcattaaaaagtcaggaaacaacaggtgctggagaggatgtggagaaataggaacacttttccactgttggtgggactgtaaactagttcaaccattgtggaagtcagtgtggcgattcctcagggatctagaactagaaataccatttgacccagccatctcattactgggtatatacccaaaggattataaatcatgctgctataaagacacatgcatatgtatgtttattgcggcactattcacaatagcaaagactttgaaccaacccaaatgtccatcaatgatagactggatgaagaaaatgtggcacatacaccctggaatactatgcagccataaaaaatgatgagttcatgtcctttgtagggacatggatgaagctggaaaccatcattctcagcaaactattgcaaggactaaaaaccaaacacctcgtgttctcactcataggtgggaattgaacaatgagaacacatggacacaggaaggtgaacatctcacaccggggactgttatggagtggggggagggggaagggatagcattaggtgatatacctaatgctaaatgacaagttaatgagtgcagcacaccaacatggcacatgtatacatatgtaacaaacctgcacattgtgcacatgtaccctaaaacttaaaagtataattaaaaaaatatatatggataagcacatttctttaccatcttactatccatataatcagttgccactttggtttaactctttccatgtaatatatgatgtatcagaatgagttgaatcaatccactatgattggagttttaggttgtttctggtcttttatcagtaagtgattctaaaataaacatccttatacatttattttttgtttggatatctgattaatacctcaggataaattctcaagattgggctaagttatttgattaaaaaatttattagtttttgattttgcaaaacaaattaccacagactcagcagcttaaaacaacacatgtttgtgacctcacagtttctgtgggtcagggacctagtcagggcttggctgggttttccactctgtgtctcacaaggctgcattcaaggtgtcagccagggctgcaatctcatctgggcacagggtccttcccaagctccctgtggctggcagaatgcaggtccctgtgggtacagaactgtcagctcctagagctcagtcaccattctctgccttgtagccatctccacaataggaaaatgtgtgtctccaaggccaacaggacagcatctgttcctgcttggtgtcacttgcctccagactcttttttaaagagctcatttggttagaccagccccactgaggataatcttccttttggttaactcaaagtcaaatgattaggcactttcattacatttgcaaaatctcttaacctttgccatattctgtaacacaagcacgggagtgctatcccttcatatccacagtctctccctcactcaaggggagtggattgcacatgtgtgtttactgagttgggagttggcgagggttgggactgggggccatcttagaaatctccctcccacaaagaatttgcaaatttattaagatttatgatttaaattgccagattttctgaagaacgtttatactccaccggtaaagtgctaatttccccaacactgggtattatcattatgcttaatctttgccaaagacaggcaaatgttgttggcttggaaccactgggcaaagattgtgacagtgagagaacaagtattgaattctttgattaatagtaagattattatggcctttggcaagttttgcttttcttttgcaaatgaccagtccatttatgtggttgttttcctctaagggtaattatctgttacttgttttttaataacctcatgttgaatattcagaatattaactatttatggtttctatagtattttctttcagtgtcttaaaaattgggttacagagacttatgccatgtaaaaatttttaactttcataatcagatctattaacatttatggtttcttttttatgctttaacatatttttgcactgtttatttctaaaaagagagaaccatataaatcaaataggatttccagtttccatcacagaagacaggaactatagagtgggaaatcttgtacaaagatgtttctcataatgcattgcccatccatcttctgattgttatgtaaaccaattcttaacctaaggtatccagccagagagatgaatgtatcattcctctaaatgacttggtcgtgggaaatataccacatcattctgttagctttcaggacgcagcgtgtcaacttcaattatttttttcatttcttgtcttggactgtcagtttacagctctgagtatttgaaaacagacagaagtatgaagccaactttttctagagtatttagttttaatcttgagttttatccccatctctgagcactatttccatgttatatctaattttttttcttaatatgggacctaaaacatgtcttatttaaaaaaaatacattggataatcaagaaagtatgccttttaggcaagatctcttctccctgctgtattaaaaaataatgatgaaatatttctgtgacagaaacaaaatcactttatatctattaaaaagttggttcaaatctctccttttttatagatgaatgaatcataatataaggatataagtttcttaaaccttccttgaagtctcaggcattaaatgtcctcatctataaaacgaaaaagtgaaacaagctgatctctaaggtccagtgaaatctaacactctgattcgtcttgatgtttgacttgaggttttctgcttatattctttctttgcccttttcaaattcccagtctaaaatcttgccttcaaggtttttcctcttttcattttcagattctgactatgcattcttgtaaaacattccattgtcacttccaagtcaaatattcaaaaccaaactcttgctatccctctcgaactacttggtttccatatttattggatttgtaccacagtccttggtatgcaggcatgaaaaaaggaataatttttcatcatccttccctcgccccatagctaatcagtatctaaggacagaatatttctcaactgcaacatctgtctccctgcctttttccaattcctccaaacacattagttctgagctgcagtgtgtccctccaggactcaatgttgaaaattctttatcttcttcaactttcctgatacggtaactccacaacactgtagccaggttgacattcctatggttccctattttttgttagattaagaacaatggcaatgaaacccctctacaatatgtctcagtctggcttttcacacttctttttgtcttccccatgcttatgcccagtgtcttagcctcccaagatccttgctattaatatttcctcattacacactatattttgccatttcctgccttttagggttgattttgaatttctattttcagtgtttaaagtttctgtaaatgttgggatattgactttagctaaaacaaacaaaaaataacaagtaatcactttaaatctgtatcctacttccaagaaacaatattttcattggtgccaaaataatatattccatgttagcataatatagcagaacttaaaaaaaattaaaaatctatgtagaagacaatgaggatagagtgtgttagagctgtacggaatcttgggaggctctattccaatctccaacttctaaggatcagggaagccagtagcctgactataagctatgagctaactaggaacaaatcttgtactaaagatttgaatggttttctattgctcaggaaactaccgaactctgccctttaacaggacctggtcaatcattcactcaacaaacaggttttaagtgcctgcaatgtatcatgtactgggtcctaagaggtgaaatatttaaaatggccccgctttctaggaatgcagtcttggagaaggaattacacatggacaaataagtgcaataagaagtgccatgatagaaatggtgcattgtagacacaaaggaggaggtactcagctctatctgatgtaatgggggaaagtaaaggttttcatagataaagtaaccctatcggcttaatataaaaagataagtaatgttcacaagggtggactagcaaggaaccattattaccgaaggcacagaagcatgcgtcagataataatattggggggaaatgcaaacaatttagaattctagaagttaaggtacaagacgaggtgatatggtttttggctgtgtccccacccaaatctcatctttaattgtagctctcataattccctcatgttgtgggagggacccaatgggagataaatgaatcatgggagcaatttcccccatactgttctcatggtagtgaataagtctcacaagatctgatggttttataagtggaaacccctttcacttggctctcattctcttctcttgtctgccgccacgtgagacatgtcaccatgattgtgaggcctccccactcatgtggaagtgggagtccattaaacctctttcttcttacgttgccaagtctcaggtatgtctttatcagcagtgtgaaaacagactaatacacaagatatatcaaaatcaaattttttaaagcaaggcaagcccccagttgtgaagggacttacatgtcttacaaagaagtttggaacaataactatcattatcattattattagtgagtatgtgtcagcttctcattataatttatggatccttcctactgatcactttctatgatcactataataagtaatttactttgacagacaaggaaactgaggatcaatgattaactcacctaaagcaacatggctattaaatatttcagccaagattcaaactcaggtccacctgatttcaaagctagacatgaatcacactataatcctcaccttgagtctgtagacaatgtggcaccatcaggacattttaaataaagaagaaatgtgaatagacttttgtcctggaaaggtctggcaacaatatagagttgcaccatccagtacagtagccactagccacattgaaaattaaataactatttaataattgagaattcagtccttgagggcagcagccacatttaaagtgttcagtacctacgtgtctggtggcagctgtgttggacagtacatgtgaacagttccatcctcacagaaagttctatcaggcagtacaggtagacaggaaaagtaaagagttttgtgaggtggggtgaggaaagtaaagagactattacctaggacaagtaggaaaggattagagacaaaataaagcactaagagcaatgagttaagcctgtgtttcccaaagtgtgactgcccacccttttcccctcaaccagcagcatcagcacggtgtggaaatttgttagaagtgcgcatccatgcagaatctgaaactcggagttggggcccggccatctgtgttgtaccaagccctcccagggattctggtgttcactaacatgtgaaggccatggatttagaggaaggaacagagctgtaaagcatggtacagaaatatagacaatttggaggccagatgcaaacatggatgatatggtttgaatgtttgtcctctccaaatctcatgctgaaatgtgatgcccagtgttggaggtggggcctggtgggaggtgattggatcatggggcagatccctcatgaatggttaacaccatccccttggtgatgagtaagttcttgctcagtgagttctgggaccttccccaccccctcttgctcctgctcttgcaatgtgatgtgccagctctccctttgccttctgccatgactggaaacttcctgaggcctccccagaagcagatgctggcaccacacttcctgtacagcctgcagaactgtgagacaattaaacctcttttctttataaattacccaactttaggtatttcttgatagcaatgagagaacagacacaaacacagtggtgcatacaggagaataaatctaggataactcctggtgggttgatgaataaaagagagatgttcagagggaaatgataatgaatttgagtttgaattcctaagggacattcgagtatcatgatcctgttcagtgtcagcctggaaatcaggagaaagttctgggataaagatacagttttagggtcactgggattagatggtagattagctaggaatggaggggataggtagctctcaatttttttcctgcataaatgataatcatctgtgtgtctgtaaaggatgaagggtatatctggacttagatacaattctccacatgctagttccttttctctctgattcaaggagtcatttcaaaatgcaaattcagtcagatagatgtgaatatgttctatttttaaaaataagtgatgaacatgcattgttatgctgactattattagtatgtataacttgtcaaacaagatacccagaatcctaaagtgtacagagggaaacgagaccaggtctaagggctgaccccagttcagtgagtgttggagtgtggctgcagcagaggaaccagcaacaagggggagaaaaatggtcagagagagggatggggtcctgcaactccagagaggagcacttcgtagacaaggtgatgcgcactgtcatattccagagagatttgtaagacgaaacctcggatttcgctattctgaggtcaccactgaactttattcaaagtcatttctattattagggataaattggctgatcacctcaagaagattggagtattctgaagaataatggggggtgaggaaacggaggcaccacaggtagatttatgctttgcactattacttggttacagaagcgttgtcttatgttctcggcatcttacagagattttagtgaaacaggtcttctaatttttatactttccctacccagggcctcagcataagtatggcataaaggggctagcatactatgaatacgattaccccacccactaatattgatccattggtcctggacaatgagctcaccttagtcctccattcacccaattggattgattcccttctagaatccactctctcctccagtcttccttggcctgcctcatacactttagtgacctctccaaatccttagagtaaatatagcttcagctttaaagctgggaccttctctgcaaaaaataccttctgtatagttccttataattgacctggcctaaattaatcctcacacccatcctgtgaaggaagtaggaaagtgttattgttcttgtttagtgggtgaaaattgaggttctgtgatagccaatatcttctcccctcctaagtcacaaagcaacaaccctatcttatttattttactaatttattcattccacatttttccatgaaggatttcaggtacagggcatctgaaaaataataagtagaatgtcaagataacttgataaagtaacatagatattcagctgctaaatctccacataattggtatagctgagctttaaattttgttctaaggtttttggcagccaaacagaaaggcagacactgtcaattatgcagttcctattttcaaaaaggaataagtgtgccagtttctcagaggcaccaaagtacatccttgtcttagttctaaaagaaacttcagaaccatgtctttgcatatggaccatttctataaacaagtgtagtgaaacacatcttatattggctataatggtttactttggtaaaatttcacttaaacccaaagttacaacagattctctttccttccttccttccttctttcctcccttctttccttcttttcttttctttttcttccttcctgtctctctccccaccccaccttcctccctccttccctccctccctctctctgtctttccttctttctttcaatgagatattgttctgtcatccaggctagagtgcagtggcacgatcatagctcattgcaacctccaacacctgggctccagtgatctcctgcctcaggctctccagtagctaggactataggagcacatcaccacacccaactgattttatttaattttatttttatagagacgtggtctcgctatgttacccaggctggtcttgaactcctggctcaagggatcttcccacctctgtctctcaacacactgggattacaggcatcagccaccattcctagcctaaaacagacttatcaacagaagcacacttactaacttactgatcactgatggacagttaccacaaagacataaaactttacatattgggctgaattgaatttttatagttgtgactaaattctttgcaccaattagcacatattcctggagtatgctctctctatagagagttaaaaatcaggtagcctttctaactctctacatatttgtatacacactgtgcacacacatatacacacaaagtctaccatcttaaaagaaaaaagtataaatatttttctagaaaaatctgtttctgagttttcaggaaatactcattggcttcagtgaaatgtcatctagtattttaagatactcctggaacaaatagatactcagatgattagaatatagacaaaaattgggggcatttaagttattattggagcagatgctgagtatccatctcccctgactctcaggcactgatgatcactaacatttttaattaatcacaaatccctatggatgctaatgaggctctgccaaaatggtcctttccctcacacagagtgctggaggaaccatgcacccaatgctttattcccgtatctcattaggtaatctatatctggacacccaggcaccacattatcagagtgttcttctaaaactgaatgtttgtatgcagaaaaccagtctgttaaaatgcattaatgaacacctgctggccttagagtcctgagcaaggaactgttccagaatattaaagaaacaaagtcattcgctctgtcttcaaggagtttaaatcctgttggagagacaaaatatactgacatgttatacaactaaaaacaataacctaagaacttataaatacatgcaaaataatacaataaatagtcagtgatactaaatagtacacggataccaaggcagtaggtaagggaaatgactgctgataaaatggagagtaaagtggtgacctctgcccccatcagttcatacaaaagtaatgtgaaatggcacccagatgcagagagcaatgttaggtagaataatagccgcactatatgtgatggcccagggttgtgggcaggtgagccaaattacacaacatacaggggaattccatgcctgaaaatgtggattgtcttatttcagaccagcgattcataaatgttttttgcttattttgttgttgttgttgttgttgttgttgttgttaggctatttggggtgatgggggaaggtcttgctctgtcatccaggctggagagcaatggtgtgatcagatctcactgcagcctcaatctcccaagctcaagcaatcctcctacctcagcctactgaatagctgggactataggtgtgcaccaccatgctcacttatttatttatttatttatttatttatttatttatttatttgagatggagtctcactctgttatctaggctggagtgcagtggcatgatcttggctcactgcaacctccacctcccacgttcaaacagttctctacctcagcctcccaagtagctgggattataggcgcacaccaccacgcccagctaatttttgtatttttagtagagacaggatttcactttcttggccaggctgatcttgaactcctgaccttgtgatccaccctcctcagcctcccaaagtgctgggattacaggcatgagccaccacacccagcctcacactcactatttttctaattttctgtagacacagggttttgccaattgcttgggctggtcttgaactccttggctcaagtgatccattcacttcagccttccaaagtgctgggattacaggtgttagccaccgcacctggctacctcataaataatgagctcttagttcacttagggtacttgaaaaacatgctgatatcgggatcactcacagacagtctaattctgtgggtagtaggtagagcctcagaaagtacattttcacagttctcccaaggatagagttagtctaaggaccccaacatgaggcccactgcctaatgcactaacccaagacccagtcatgtgtgacatgaaggaaaagccagtatcagaattcacagggcgcctgactgtctttaggaagcagtacctgggaagggataggaattctagaatgctccccccagaggtcaaaatgccactcaggcaggaaacggatatggttttaatcagtgaaattgcatgttagaaataaacacatctgagccaagatggccgaataggaacagctccaatctacagctcccagcgtgagcgacacagaagatgggtgatttctgcatttccatctgaagtactgggttcatctcactagggagtgccagacagtgggtgcagcacactgagcaagctgaagcagggcgaggcattgcctcactcaggaagtgcaaggggtcagggagttccctttcctagtcaaagaaaggggtgacagacggcacctggaaaatcaggtcactcccaccctaatactgcgcttttccaacaggcttaaaaaatgacacaccaggagattatatcccgcacctggctcagagggtcctatgcccatggagtctgctcagattgctagcacagcagtctgagatcaaactgcaagatggtagcgaggctgggggaggggcacctgccattacccaggcttgattaggtaaacaaagcagccgggaagctcgaactgggtggagcccaccacagctcaaggaggcctgcctgcctctgtagagtccacctctgggggcagggcacagacaaacaaaaagacagcagtaacctctgcagacaaaaatgtccctgtctgacagctttgaagagagtattggttctcccagcacgcagcttgagatctgagaatgggcagacttcctcctcaagtgggtccctgaccccgagcagcctaactgggaggcactgcctggtaggggcagactgacacctcacacagccggatactcctctgagacaaaacttccagaggaacgaggcagcagcatttgcagttcaccaagatccgctgtcctacagccaccactgttctgcagccaccactgctgatacccaggcaaacagggtctggagtggacctctagcaaactccaacagacctgcagctgagggtcctgtctgttagaaggaaaactaacaaacagaaagtacatccacaccaaaaacccttctgtacgtcaacatcaacaaagaccaaaagtagataaaaccacaaagatggggaaaaaacagagcagaaaaactggaaactctaaaaagcagagcgcctctcttcctccaaaggaatgcagctcctcactagcaatggaacaaagctggacggagaatgactttgacaagatgagagaagaaggcttcagatgatcaaactactccgagctacaggaggaaattcaaaccaatggcaaagaagttaaaaacggtgaaaaaaaattagatgaatggataactaggataaccaacgcagagagtccttaaaggagctgatggagctgaaagccaaggctcgagaactacgtgaagaatgcaaaagcctcaggagctgatgcgatcaactgggagaaagggtatcagtgacggaagatgaaatgaatgaaatgaagtgagaagggaagtttagagaaaaaagaatacaaagaaacaaacaaagcctccaagaaataagggactatgtgaaaagaccaaatctatgtctgactggtttacttgaaagtgatggggagaatgcaaccaagttgggaaacaccatgcaggatattatccaggagaacttccccaatctagcaaggcaggtcaacattcagattcagaaaatacagagaacgccacaaagatactcctcgagaagagcaactccaagacacataattgtcagattcaccaaagttgaaggaaaaaatgttaagggcagccagagagaaaggccgggttacccaaaaagggaagcccatcagactaacagcggatctcttggcagaaactctacaaaccagaagagagtgggggccaatattcaacattcttaaaaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcactaaacatggaaaggaacaaccggtaccagccactgcaaaaacatgccaaaatgtaaagaccatcaaggctaggaagaaactgcatcaactaatgagcaaaataaccagctaacatcataatgacaggaccaactccacacataacaatattaactttaaatgtaaatgggctaaatgctccaattaaaagacacagactggcaaattggataaagagtcaagacccatcagtgtgctgtattcaggaaaaccatctcatgtgcagagacacacataggctcaaaataaaaggatggaggaagatctaccaagcaaatggaaaacaaaaaaaggcaggggttgcaatcctagtctctgataaaacagactttaaaccaacagagatcaaaagagacaaagaaggccattacataatggtaaagggatcaattcaacaagaagagctaactatcctaaatatatatgcacccaatacaggagcacccagattcataaagcaagtccttagtgacatacaaagagacttagactcccacacaataataatgggagactttaacaccccactgtcaacattagacagatcaactaaacagaaagttaacaaggatacccaggaattgaactcagctctgcaccacgcggacctaatagacatctacagaactctccaccccaaatcaacagaatatacattcttttcagcaccacaccacacctattccaaaagtgatcacatgcttggaagtaaagcactcctcagcaaatataaaagacagaaattataacaaactgtctctcagaccacagtgcaatcaaactagaactcaggattaagaaactcactcaaaactgctcaactacatggaaactgaataacctgctcctgaatgacttctgggtacataacaaaatgaaggcagaaataaagatgttctttgaaaccaacgagaacaaagacacaacataccagaatctctgggacacaatcaaagcagtgtgtagagggaaatttatagcactaaatgcccacaacagaaagcaggaaagatccaaaattgacaccctaacatcaaaattaaaagaattagaaaagcaagagcaaacacattcaaaagctagcagaaggcaagaaataactaaaatcagaggagaactgaaggaaatagagacacaaaaaacccttcaaaaaattaatgaatccaggagattgttttttgaaaagatcaacaaaatcgatagaccactagcaagactaataaagaagaaaagagagaagaatcaaataggcgcaataaaaatgataaaggggatatcaccaccaatcccacagaaatacaaactaccatcagagaatactataaacacctctacacaaataaactagaaaatctggaagaaatggataaattcctcaacaaacacactctcccaagactaaaccaagaagaagttgactctctgaatagaccaataacaggctctgaaaattgtggcaataatcaatagcttaccaagcaaagaaaagtccaggaccagacggattcactgccgaattttaccagaggtacaaggaggagctgttaccagtccttctgaaactattccaatcaatagaaaaagagggaatcctccctaactcattttatgaggccagcatcatactgataccaaagcctggcagagacaccaacaaaaaagagaattttagaccaatatccttgatgaacattgatgcaaaaatcctcaataaaatactggcaaaccgaatccagcagcacatcaaaaagcttatccaccacaatcaagtgggcttcatccctgggatgcaaggctgtttcaacatacgcaaatcaataaatgtaatccagcatataaacagaaccaaagacaaaaaccacatgattatctcaatagatgcagaaaacgcctttgacaaaattcaataacgcttcatgctaaaaactctcaattaattaggtattgttgggacgtatctcaaaattataagagctatctatgacaaacccacagccaatatcatactgaatgggcaaaaattggaagcattccctttgaaaactggcacaagacagggatgccctctctcactactcctattcaacatggtgctggaagttctggccagggcaatcaggcaggagaaggaaataaagggtattcaattaggaaaagaggaagtcaaattgtccctgtttgcagatgacatgattgtatatttagaaaaccccatcgtctcagcccaaaatctccttaagctgataagcaacttcagcaaagactcaggatacaaaatcaatgtacaaaaatcaaaagcattcttatacaccaaaaacagacagagagccaaatcatgagtgaactcccattcacaattgcttcaaagagaataaaatacctaggaatccaacttacaagggatgtgaaggacctcttcaaggagaactacaaaccactgctctatgaaataaaagaggatacaaagaaatggaagaacattccatgctcatgggtaggaagaatccatatcatgaaaatggacatactgcacaaggtaatttatagattcaatgccatccccatcaagctaccaatgactttcttcacagaattggaaaaaactactttcaagttcatatggaaccaaaaaagagcccacattgccaagtcaatcctaagccaaaagaacaaagccagaggcatcacactacctgacttcaaactatactacaaggctacagtaaacaaaacagcatggtactggtacaaaacagatataagatcaacaaaacagaacagagcccttagaaataatgccacatatctacaaccatctgactttgacaaacctgagaaaaacaagcaatggggaaaggattccctatttaataaatggtgctgggaaaactggctagccatatgtagaaagctgaaactggatcccttccttacaccttatacaaaaatgaattcaagatggattaaagacttacatgttagacctaaaaccataaaaaccctagaagaaaacctaggcaataccattcaggacataggcatgggcaaggacttcatgtctaaaacatcaaaagcaatggcaacaaaagccaaaattgacaatgggatctaattaaactaaagagcttctgcacagcaaaagaaactaccatcagagtgaacaggcaacctacagaatgggagaaaatttttgcaacctactcatctgacaaagggctaatatccagaatctacaatgaactcaaatcaatttacaagaaaaaaacaaacaaccccatcaaaaagtgggcaaaggatatgaacacacacttctcaaaagaagacatttatgcagccaaaagacacatgaaaaaatgctcatcatcactggccatcagagaaattcaaatcaaaaccacaatgagataccatctcacaccagttagaatggaaatcattaaaaagtcaggaaacaacaggtcctgtaaaggatgtggagaaataggaacacttttccactgttggtgggactgtaatctagttcaaccattgtggaagtcagtgtggcgattcctcagggaactagaagtagaaataccatttgacccagccatcccattactgagtatatacccaaaggattataaatcatgttgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaagctggaaaccatcattctcagcaaactattgcaaggacaaaaaaccaaacaccgtatgttctcactcataggtgggaattaaacaatgagaacacatggacacaggaaggggaacatcacactctggggactgttatggggtcggggcatgggggagggatagcattaggagatatacctaatgctaaatgacgagttaatgggtgcagcacaccaacatggcacatgtatacatatgtaacaaacctgcacattgtgcacatgtacactaaaacttaaagtataataatgataaaattaaaaataaataaataaataaacacaactgcaaacctgaatagaaaagtattattcgatgattcatttactacccagtagactttactggatgattatatgttggattttgtaaaaaataattgaactaaactctttgaacttagaaaggagtccaatatacactcaaagggttataataaaatggaattgtttgcatgaaatttgctaactgataattttcattgaatgtattttggatttccaaaacagaatttttatttttcattatttagcaggcctcaattagatatgtttattttcttaggttaaagactataataatttctgagaaaccttatgccatgctattatcaattatatttttaaaggcttttcaaatttgagatcttcttaccctaggcactttgcaaatgaatcattgttagccctgttcataataaactgagaaaattactcaaattctctaagtaaatgaatatgagtgcaaattgactgtaggctcactcattcaggtggtggtagacattcatcctacatcctcagggcttagtgttctgtattgtttgggaaaaaaatgggtgtataattaggaacccggattccagacattaatctgatcaattttttcagaccacatctttcacccagcatcatcacttcttattatatttctataatttcaactacaaactttttctaaactaagaagatttagtatgagcttccttatagtatagccctaaggtagctttgcaactgttatttaggaaatgaaaataaaatgtggtcatccaagaattttaaaaataagcaaaaatgcaaagccaaaaaggcacatgttaatgttaagagagtggtatgaaacattaaatttggctagaaataaggttttcgttgcaagaagtaatgagaaatggggctggaaaactgaattgagccaagatatgaaggatttaacagccaatttgatcccctcactcatgggtgatcacggatgccaggtggaaacacttgaaaactaaacaacacccttcaaaaataatacataggtaaaaaatgaagtctcaagggaaactttttaaatacactgtactgaataaaaacaaaaatacaacatataaaaatgtatgggacacaggtatagcagtgctgagagggtaatactaaatgcatccattagaaaagtgaaaagcctctcccttaaacaaaaaaaaaagtagaaagggaacagcaaaattaatgcaaaacaggagggaggaaaataataaaggtaagagaagacagcaatgtaagtgaaaacagaaaaatagagaaaatgaaatgaaatgaaatgaaaatgaaaagctggttctttgaaaagatcaataaaattgacaaacctctcacgagactgacaaagaaaaaggagagaagacaaaatatgcatatcaggaatgaaataagaaacatcactacagaccatacaatatccagagtgaagcaagagaataccaggaataacactactctcataaagcacttaggtgaaacgaaccaattccttaaaacacataagctaccccaactcacccagcatgaaagagatgacttgaatagccccatatctatgaagaatattgaattaataattttaaaactccttaaaagaactctccaggccaagaaagctttactggaaaattctaccaaatgtttaaataattaatagtaatctacacaatcatccagagcatagaaaaggaagaaacattttccaattatttttatgaaactcatattaccctgactctacatgtaaaacaatgcaaaaagaaaactccagattaatatctctcatgaacatagatgcaaaaaccattgacaaaatatttgcaaactagaattccacaacatttaaaagagaatgatacaccataaccaagcagggtttgtactaaggatacagtctgattcaatatttgaaaatcaatcaatgtaatccacctgattaacatgccaaagaagaaaaattacatgacatgatgtttaattttatgtgtccacttgactggaccacagggtgtgcagttatttggttaaatattgttctgtgtgtgtctgtaagggtgcttttgggtgagattgacatttgaatcattagattgagtaaagaaggctgtcctccccagtgtgggtgggcctccttcaacccactgaaggcctgaatagaaaagaaagattaagtaagaaagaattctttctctttgcctgtcttgtcactgggccattgatcttctcctgtcttcagacttggacttggactggaacctacatcactggcgcttctatttctctggctttcagtcccagactgggactataccatcagctctcctggatctgacttctcagcctccatgattgtatgagctgattccttatcatttctgtttctctggagaatcctctctaacacatatgatcatatcaactgaggcagaaaaagcacttgacaaaattcaacatccattcatgataaaaattctcagaaatctaggaagagaggagaacatcctcaacttgataaatctacaaaaacctacagtttacaatgtactttatgattgaagactatatgctttttctgtaaggtcaggagcaaagcaagatgtcctctgtggccactgttattcaacatactactggaagttctagacactgcaataaggcaagaaaaggaaataaaaagcatatactttgaaatggaggaaataaaactatccctgtttgcagacagcatgcttatctgaacaaaaaatcccaaggaatatacaaaaacaaacaaaaaactagaactaaaaagttcagcaagctcatagaatataagataaacatagaaaactgaattatatttctacttgttatcaataaacatatggactctgaaatgtaaaatataatactatttacagtcactcagaaacaaaggaaatacttaggtctaagcattttgtatttttagtagagatggggtttcaccatgttggccaggctggtctcaaactccttacctcctgcccccctcagcctccaaaagtgatccgtctgccttggcctccgaaagtgctgggattacaggcgtgaaccaccgtacccggcctaagtgtttctttttctactggttatagagctggctactgtactccttctggtttctctccattggggtggtcagttgcccactggggcacaggaaaggggttggcttctgttgagggccccaggagctaagtataaggatgttctgggattggaaaaaccagtgctgatcataatctcaaaagactcaatctgaatgccataagcccaaaaacataattctggaaaatgtaattttaattttgttcttaaaaagcatttatttacattcttaaaagggaatttaagaaacataaaacatgaaagaatactacttcataggccactttatacagtaaaatagatacatataaataatcacatataaatttttgcaagcataaacacccaggaattctaatgacagtcacacaggtataagagctatgaagagatgaaccataaaaaaatctgtcagaaagtgaggtataagtgcgcatcactttggtgcataattgtgtgcacccagctttatagctacagtcgtctgaaatattaatatcatgacagaaaacctaagtcttttgaccagatctatcaaaaacctcagtgagtcacccctgcatatgcagtcacccaaagagctgagctgtcaagaaatagtatcttttacaaccacagatgcacaaaaagaagatctctacatttattgaggaagttttaatgttcttatatacaaagtcaacaattgtgataatgtactttcctgaagtcaaatttgcaaaaattgcatgaaacaaattagaactctctaaaagtctctgcacaattatacctccagcatcagaaataacacaaagatgatatatatggcatagccagttggcattatgtgtgaaggggcagaagtcatacacaattgaatagtttggcaggagagatttcttgtattttttgcctgtgttttcacttgatctttgaaacactcactgcacttgtatttggatagtggttggggcctacaaattttgtaggtatatgctacccatttgaaagtctggtcgctgctcagcaattaagcaattttccaccttcacagcaccaataataattagcttttaaacttttatctttcaccattaagtaccttcatacacttaacttatcacagtctttttgtgagggagcaatttcacagatctcttttattgtgttgtaaggaatacggtaagaaggaatgaaattcagtttccccaataccaaatttgtactagtcagggttctccagagaactagaaccaatagaatatgtatatagagatatgagaggggatttattagggaaattggctcacacaattctgatgactaagaagtcccatgacagactgtctgcaagctggagaccatgggatggctgcaggatggctgaatccaactcagatggcctcagagccaggaaatccaatgatgtcactctcagtccaaggccaaaagcctctggacctgggggacaggtggtgtaagtcttagagtctgaaggccagtgagcctggagttctgatgttcaagacagcaggagaaaagtctgccccaactctcagagaaagaccaattcacattctttatttgttctctatgagcccacagtcagttggctggtgcccaccaaaattcagggcaggtctttctccacatagtccactcagactcacacactaattgcctctggaaacaccctcacagacacacccaaaataatgcatttactgggtttctagacatgctttctttttttttttttcttgagacagagtcttactctgtcacccaggcttggagcacagcggaacaatcctggctcactacaacctctgcctcccagggtcaagcgattctcatgcctcagcttcccgagtaagtgggattacaggtatgcatcaccatgcccagataacttttttgtatttttagtagagatggggtttcaccatgttggccaggctggtcttgaactcctggcctcatgtgatccacctgcctcagcctcccaaagtgctgggattgattacaggcgtaagccactacctagttactccttaatccagtcaaaatgacacctaaaattaaattcacgagtcctcccattgtcagcctggcacccctacacattgtcttaaaacatacttcacttccaagtaaagccaatagcagataatagttccgcttaacatgatgccaccatcccaaatacaaccaaaaatgcactaatcccttccacagaactctgctttcaggatttccaactctggaattttaatcattcaggattgtacatggggaattttagacattaagaattttagacattagtgcttttgatcattctgtatttcaacatacgggattatggcctttgggactgtctttcaggattatgatcagcagcagattgtaacatgtaaaaagtcacggacaatgagttactcctacacacctattagaatggcagaaatccaaaatactgacaccaccaaatactgatgaggatgcggggcaacaggaactcttattcactgctaagggatgtaaaatgatgcagccactttggaaaaactaaacatgctcttatcatatgatccaggaatcacattcctagatatttactcaagttagttaaaaatgtaaactcctacaaaaatgtgcacacaaatgtttacaacaactttattcataattgccaaacctggaagcaactaggatgtcctttgatagataaatagataaactgtggtacatccagacaatagaatattattcagcactaaaaagaaatgagctatcaagccacagaaagacttggaggaattttaaacgtattgtactaagtgacagaagccaatctgaaaagacttcatattgcggaatttcaactatatgatattctggaaaagaatggagagaataaaaagaccaatggtggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccggggtagtggcgggcgcctgtagtcccagctacttgggaggctgaggcaggagaatggcgtgaacccgggaggcggagcttgcagtgagccgagatcccgccactgcactccagcctgggcgacagagcgagactccgtttcaaaaaaaaaaaaaaaaaaaaaaaaaagaccaatggttgctggaggttagggggctgacaaggatgaatagatgggacacaaaagattctcagagcagtaaaaccactctgtatgatactacaatggtggatacatggcattatacatttgtccaaacccataggatttacaacacgaagagtaaaccctaatgtaaacagtaggctttcgttaaaaataatgtattcatattggctcatcaatgtactgcatcggtaacaaatgcatcacaataattaatgcaagatgttaataataagggaaactggcagaataaggctatggaaactccctgtactttctactcaattttcttataaacctaataccgctctaaaaaatagtctattaattttttaaagatgtaacttaatagtaaccatgttaccctttcaaaaactgtttgtcaattttgctacaaaagagaatttcaagtatttatctgttaagaacaatagttacaacaaaaacatggagatatttttgcaaattaaaaacccgtggagagataagtttggaaacaaacctaggacttaaaagatgaagtcctggctcctcatgttgtgttactttaggtaagtcagttaccctcttagacctcagtctaacacttttgttatttaaaaaaaaaggattattatgatgcatcaaatattttatactagatctattcacttaatatatttatgtttaagtatctcgtaagtaaaatgaattatttaaacattttcaaattctacataattcctagatatatgtcacccatgaatataaacatatattttaaattatatgaactaggtaagtcatcaacatgaaaatcaagtcaaaatcaattacacattaaattggttacagtatgtatctttaacttaccaccaccatctatcttcaaatcactttatgccacttgatgtataaaaactttataatagtatacttctgctttcccctcccagcctttgtgctattgccatcatacatttacatgtgttataaacccccatggtacattataattgtttttgcctaaatagttatgttttacataaattgaaagtttggagatccattttatatttacctaatctttaccatttctgacactctttattactttgcatacatccaagtttgcttctaatatgctttccctacaacataaactgtctataatatttcttatgagatcatttatagtgccaatctatggtgacctaggtaaagaatatgcggtacctatacccatggaatactatgcagccataaaaaagaataaaatgatgtaaaatgatgttctttgcagcgacatggatgcagctgaaggtcattatcctaagtgaattaccacaggaacaaaaaaacaaataccaaatgttcttacttaaaagtaggagttaaacaatgggtgctcatggacataatactactaggggagagagggaaggagaggggcaagggttgaaaaactcaccattgggtactatgcttagtacatgatgacaggatcaattgtaccccgaaattcagcatcacgcaatatacccaggtaacaaacctgcagatgtaccctctaaatctaaaagttgtaactattaaaaccagaaaacctcacttctcacccccaaaaaatataaaattaaaaataaaagacgctgtttcattgtctcctggcttgcattgtttataatgtcagcagtcatctttgttcctgtgtacgtgacatgttttttttaattacttttttactctgactacttttaagatttttttctctatcacatctttctagcaatttaatacaaagtactttggagtatgtatagtgtgtgtgtgtgcgcacgcgcatgcttgtggtttgttttttctgcttgtggtttgttgagaaccttggtttacagtttcctcaaatttagaaatgtttcagccattatttcttccaatattttttctgccccccccccacctttatgacattccagttacacaagtgatagacagtttgctattgtttcatagcttactgaggctcagatgggtttttccagcctttttctctctgtgcttcagtctagatggtttctattcctatgtattcaagctcactgactttatcttatgaggtctaatattctgttcttccaatccagtgtattttttatttctgatataacatttttcacctttaaagtttcatttggctctattttatatcttttctttcctcatgatgtccatgttttcttctacattcatgagcacatttataatagcagtttttaaattaacacttgctaattccatcatctttattatttcaggttatgtttctatcggctgatttttctctgggttattggtcacatttttctgtagctttacattgtccatgattttttattggatgtggcatatttggaatttgaattttgttgtcttctttgaaagagtgttgaattttgtcctggcaggcaattaacttacctgtggatgagcttgatgttttgggggcctcttaaaacactggtagggcacatctggagtatcttttattctaaggctagtttagctctactttttaagacatagccttctggggtcttttctgaatgctccaggtgttcaatgggctcttttatgtctttgggggtttgtttgtttgtttgtttgtttgtttgttttttattgctggggagaggagggggaacagagtctcgctgtgttgcccaggctggcctgagactcctaggttcaagtgatcctcccacctcagcctcttgagtagctaggattacgggcacacaccacagccctggcttcttttattttggatggtcaaaacgtacagtatcacaaccgtatgtaagctctgagaattgttccgtttacaactccccaggagtctatttttgcctagtttatgcatacatggcagagcattcaacaaaaaactcaagaggatgccgatgcaggtttctggaactttctctttgcaccactccctgctctccggtattcttccccacaaagttcagccatctcagctctcctgaacactgacatctgcctttttcagagtaatgctctacttgaattccccttccctgtgccacagtttagaaggtgtctccaggcaaagagccagggcaattgctggtctcacctaatttattttctttctatttaagatacaggcctgttctgttgttcagtatctgaaattgttgtctgttatattttttccagttgtctagttgtttatggaaaggaaaaaaattcagaaccggataatttgtccatgctttatatatttagtaggagtttcaagaatgtctttataatgggccagattgtctcaaaaattacaagtatattaaacactaaatatgtatatgtttcttcttaaccccaaaatactaagccatgattttatttctcttaaacatttctatatttaattctgaattttactgggtttaaaagattctcacccattaaggaaaacagtcaccatccccattaactgaaccacaacactgattgtactgattgtgttctaggcagtcctgaggggactcactgagtactctttgtgattgccatgtccatgatgccatcgcttagaagaagtgccacttggcccacattcctgaatgcaagataaacacattaattcttctgtctactcacagcagtgctcaactccaactccagttgatcgtttgatcagattcttcatttgtttggttcctaagatatagacatgtctttctttctgtcttaaaaggcctttaaattccatggaatcctgcatttttttcagtctcgtgatttacagatgatgtattgctattcagttgaattttagatctctctcctggcattatcaaacttgcagccataacatctgaggtcactctctcagcaccaggggccttgtgaatctgtgagcactgtgccagcacagccttacaaagctgtggctcagacagggcagatgtgatcctcagtagcagggcaattgtaactatgccaacaatgactctttgggtctgggggaaagtttctgtctatccacagtggactctagaggatagtgtgggccaagtggatatagtattggttcattcagaaaaatacaaacttctctaggtatctcaagctagaaagtgatttaaattaaggaattaagagacaaaatgtgggagctaaaggagcaaaaattgggaaagttggtggtttccaaagatgagaaacatcagaaaatcatagcatcctaccaggagtaatgcccatctaattcctcatttctcttccctgatacagcatgtgagctccagaaagcctgggttttgctagctatttcctctgcaggcattatgctcacctccagaggtactagaactgctggcactattgcaatagtctgtagtcacctgcctctgccataagcagggtagtttctatcttcttcccacatttaatttgttatgagtgcctcccattgccaacaaggaatcccaactgagcacaaaatctggcaaatgcagtttgcaggtttccagccacagtggcttagggaagagtataaaagagcaagtatgggtctgtagctatagctacattaaagctatggctttaatgactctatttttgaaaagcctgacacataggaaactctcaaaaaataactgtggtttctgttatttttatttaataagcagtggcatgaaaagtcaacctatatctgggctaaccatacaggaacagactgtaaagatgactgtgccctttacccaatagtgctacccatccacacagttctcctttttccatttcaggaatggataaaacaatgattgtattgatttcctgctcactgtggtattaattgcttgtggtccccaaacacaatgtaagttagtaatcttcgtatccatccatttgttataggatttttggggtgtcacttcaccagctggaaatctctgtggctagtggtgcctttgcccgagttttgctctgtcccactgggctcattctgcccatttggcctgtcaggctgcgtttggctcatgctactggcctagatcccacgcctgccaagggcaagccaggcacagagcagcgaggggtgtatgagtggagtgtggggtccaggcatgctagctgctgctgcagggtgggcagctccaggtgccaacacaggcactggctccctgtgagggcacagctggaccaggcacaccacaagcagcacccacagctggcactagggaacatagtggtgcccacaagcttggagatgccaggaaccacagggctccaaagagggagtcacagccctggcttggggagttcccaggtttgggctccccaaagagccacagctctcctcttcttttcttcacccacaacatggcaagcaagaggcatgtttcagccctgtttgtgttacagctcttttagccccgccattcaatgggtcccaagttcttgtcctgcatccaggaagaatgaggtatgcagagaagtggagggcgagcaagacgaagaggagttttattaagtgatagaacagctcagaggagacccaaagtgggtagctcctctctgcagccagggtgtccaacgagtgttcagctctcagcagagagggtaactcctctctgtgagcaggtcatcctatcatcgtttcagttctcagcagagagtgccgctcctctctatagctggttgtctgtcctttctccatcctctctttgagtctggctgagtctggggtttttatggacctcagacgggaggaagtgcatgctgattggtccatgcacagccatgggtggccatgggcaggcccagggaaaagcactacaagttccccctctggtctgcaggactgactgccctgcccccaggcttcatgacctccccagctggaaggtggggcatcaccaggcacatgcccacttccacccaggaacctgtctgtctcctgccactgttcatggctcccaggctgttcatgctgaggggtgctggcaggccagcaccaggctgtcctcaatacctgcttggcctccctcccacgcttgtcagtgcccaaagtccagagcgggctgaggtagcagggagctggcatgtcagtgctgcctcgagcatgtgcacacccagccaggcttaccagtgcctagacttggcccagacttgtcccctactttgctctgagattggagtgggcactgaccacagggagaagccaggcagtgagagcaggtgcttctgagcctgctgcaggtagcgagggccttcctggacccccaagagcacagagatgcctgggtctggagctgcagcagagtggctacagctgcacccaaggagctcccgccccacccactcagaaggagcagggcttccacttgtcccagctcctgctggctccatggagcatgaacccccagctgtgcttcctcacagcctgtggcaggtgttccaggttcttgctgtgcccctctctacccattcctccgtgccctaccacattggcacgcagctcagcccagccccatcacagtggcttccagggtcgtgggctccagggggcctcccaggggtggatttgaggattgtctccttcccccccaggccctccccacagtggcggtggatgatagtagtgacgtagggccagggtctggaggagcagaggctctgggcaagggagtgggtcccacccagctgcgagaggttggattgggggcagctcagtcgactgccttagggatgcaaagcacaggagacccaccactgccactactgctcccgcagctgcttctgctgccactgctactgcctcttcgctgcagctggtggccactccagatggcctgcagctgccatcacattcacagtgaaagaagttttttaccaaatgtatatattcacacacctcaaaagcaccatatgagaaatattttagaaaaattgcctcaagcataacatcaaggtcaaattaacttgagactatgaagtcagcaatgtttgcttagaaattaattcagtcattcagtcaaagctcacctgctggctgttgccaagagggctttgacgatatggtctgtaaggaagtgggacaccgtaggcatttgatatatgttaagtaatagtaatgagggcaataagtactcgcatactgagtggagggagctgttcgggttaagaagaatgcttctaagctctaatgcttaatggataaagattaggactctggaaacctttctatagtcaacagaatcattgtctcttattcaccctggctgccaattcctggaccagggtctgataatgcaaatatctctttaaatagcagtctaaaagaaaactcatattgtgtttctttaaaacaaaaaaaaaattaccatttgagccaaccagatacctgggcttaaattctgattctgtcccttacaaaaggagagatcttaagacagccaacctctcagagcttcagtttactcatctaaaaattagggcattgataatacatttttaagattgcacagtgcttctcacataagtaatgggtattcttataaaaccaatctgcaattacaggcaactttggacaaatttcttctttaagaaactacagtgaaaacctagattccctcccaactcccctgcaaaaactatgtaggcttttgaatgtgattttatatttgaatctctatatgttatatatcctacaagtgcacctcagacaaaacactgcatatctaattctggttgaggtgagcaattcattttcctagttcaacatttctcaaatatttgacatattttcataaattataatcccatcattagaaagtaccatttaacagatcagaatttattcaatatatctgaatagttctaggggaaaataactgtgtcaaatatccataccagcctacccaatctgtcccttcagtagtgatctccaccagaaaaatgaagcctgtaagatcctgcccaggagctccctaatcctacacctcaatgtccggtaaatacatccatcctgtgtgcattcaggagagattcatgctgcaatacactttcgtccatgaaaatgtctcttctcttcactgatctatgagaaatatttttgagctgtaaaagcaaactcctgaaccgtatttcccagatgtctatttaacaaactgccatttccctattacgctaagcacttaaactcaacactaaaagtcaaataagagattgaatataaatgtatatgtgctgatcaaaatacaataatgaaaaaggctctgataaggactctacaaaatttgtgggaggatttgtttgtgtgtgtttttaatatgtttttaaatgggccatcataacaggcagcttattgattatatttttttgacgtttataaagttgggaaaataataaccaataattattgaatgtttattatatgtgtctgttctaaccttttgctttattaacttatttaccctcaaaacaatccagtgaaataagtcccattgttatctttattgtcttcccaagaagaccccacttcagaaaatgtgaacttcattcttctagttgttcaggcaagacctttggcatcatccttgagtcttcttgttcacaccccacattcaatccaaattcaagtaaacaaatgcaagtgtcaaagacaaatgtgcaatgtatatttctcctatttcgagcctgctggattattccaatgaccttactgacctccttgcactagcccttgtccctgcagtctagtgaccacacaacagcctgggattcttgtgagatccaagccggatcctgtcacctctcttctcaagagcccctaataccttcccacctcacaccgagtgaaccccaaagtcctcatgctctcctgcaagaccctacaccagtggcccgggatctcccagactcagatccccatccccgctgctgttccacactcagccctctggtcacacccactccaggctggccccgaggattagggagggagccagaacaggggtgcagggcctggctttgcagggctccgcttggggtttaagactactctttgttgctgtcttgatattcttaataataaaatatctctgaatgtgtgtttgctaagaaaagaccaaaagagcctcagctggggaccacacacctcagcctcccatggcctaacctccaaggatgggctctggcagccgctgcgccctaaggcccacctgtctaactggactaacccggtcccactgctagggaagacggatccccatggtcgccttccgtcccagagtgaacctggacagggcatgcagggggtcaggtcatgtgcagagggtcaggatcgtgcatgtccctggcacctctgcttggcccgtgcagcaggctttgtcaccagtcctgtccaggcaccgagcgcatcctagcaggaaggttacagtctccaggggtcacctggctgctgtgaaacggggtgatgcagggccgggcacagtggctcacccctgtaatcccagcactttgggaggccgaggtgggaggatcacttgaggtcagaattttggaccagcctggataacatggccatctctacaaaaaaatacaaaaattatctggggccagtagcgtgtacctgtagtcccagctactcaggcggctgagtcaggaggatcgcttgaggccaggaggtcaagggtgcagtgagctctgatcctgccactgcactccaccctgggcaacagaatgagaccctgagagagacagagacagagagagacagagacagagagagagagaagctcactactttatgtctatatccctagcattggatacttgcaatggaaattcatccaaattttctgaaaaactgagtttccactttgtagatgaggaaattgggactcagagaagcgaaaggacttgactttctaggatccatccactcccaggcagtctgcctcaggggcaagatattcaaggccgtaaataaagccaatttatctgctgacatttcaatcaaacataagatgaaatcctccttttttcatttggtcttctcctggttacttgaggaaacgttaacaaatatcttcagaatccagaaagaatgtcgactgacttctagatagtaatcttatagaaactataggcaccaaagttaaacattaaatgtgaaaatatgaaacccacaggctatgctaagataatgtatggggaagcactatgaaatttgacattaaggtgacattatcattattttaaatgcctggagcatagaggtcctttaaagaaaggggttattaacatgttccttaaatcaatgcaacttttctctcaatactatttatcccactgtttgaaaatcatttcccacctaccatgtgacacacatcagatagtccttgggaccccaaggacagagttattccactccagagggcttcatttttgcaaaaataatgactggcaaatatcttttctggtgttattttagaaaatttacaagttaggaacctgaaaagtgttccagaagtgtggtctgttaacaggcagagagaacttgttctcctcacatctgcagtgacctattgtgagatggcccctgggactgatcacgccactgaactgagacttgcaaagatgatgaaaagaattcaaggcaactgactacagcagcttggcagagagagccgtcacacactaataatactaatttggtctttatttttatatttacacagcagtcggctgaatatccagctgttgcgctgtctttagcaaacagttctcctttctgattttgctttgttttgtttgggctatcactgtaattcaggatggagcctggagattttcctccagtatgtgaatttctcaatccctaggtgtgccctccttgtgtctatatgaaacagagtatgcatacctcttgaaagtaagaggaaagaaaataatagccagtgtcaaaaatgttatcacattcattttcttctttcaactcttccatcttccttctctagagcttgagagcaaaggtgagaggaaatggttttactgcctgaaaggtgtcctcgaaatgctctgtgctgcagggaggaagggcacgatgaggagcaagctactcagaagttctgggaaaagcatctgctccttcaaattgggccaaaaaaaaaaaaaaaaaaaaaaaacaatgtaacaagaacattgcagcaacaaggaaaaaataatcataatccttgaattccccttgttttcctggctttattttttctccatatttctgcaagtgtaagatatcttcaccagtattgaaagccatattcttttctcaaaggtccagatgacctatttttctccctgagattgtcatcaaagataggtgaatgtcattatgatgcttattttaccacattgacaagatccacccattattctctaagcacttattaagcagcatgttagacatacagctaaaagacaaagtagacaacagtccttctcatctaggatcttacagtctagctcaccacaggagacccttatggaaattactaaaccaccctcctctgtcctcttccaaccctaatctaggaaaattgtatgacaccatcactattccctctcatgggaagactgatcacttatgggggcaaagagaagacggaaaccaacatttgctgaaccttctggtgtctgacagggacacgctaggtgcttttgtatttacaatctcatttaaccctgcaaaacccctaaaaaattaatgttgctatccctattccacaaatgagaatgctgaagctctgcatgccacggagctataggtagaaccagcattcaactctagttctaaacccaggttcaaaatacagcctttgccattatacacacatgcctacaagtaactaagaatggctcttcacccaaaagatatgtgctggcaagctgatagatagaaacaggagagatgcaagatagagttacttgagtttcaaatttacataactctggagccctggcaggtaatcagttaagtagaacagacaggtgtaatactgtagagaatgccgaggcttgtggcagattggagggactagtcaatgtaaagcaacaaattcaattttttaaaaaactttatagaaacctaaatgtatctggtgccaaattagtactcagcgacagtgtacaacttccgcttgaactgttaagtttattagaaatagctcctgattgtttttattgtagtaaaatacatgcaaaataaaatttatggtttgatattatgtatattttacataacatgttaaccatttttaagtgtacggttcaatggcattgagtacattcacactgttgtgagacattcactaccatccatctccagaaatgtttcgtcttcccaaactgaaattctgtacccatcaaacactaactgttaattctcccctcacctccagcccctggcaaccaccattcaactttctatctctatgaatatgactactctaggtgcctcatagaagtggaatcatgccatatttgtctttttgtgactgacttatttcacttgttgtaatgttttcaaggttcatccatgtagcatgtgtcagaatttccttcctttttaagactgaataattttctattgtgtatgttgtaaatacatacatatatatatatatatgtaacattttgtttatccattcatccatcagtaaacatttgggttgtttccactttttggctattgtgagtaatgctgttatgaacatgggtgaacaaatatctttttgagtccctgctttcagttcttttgggtatacagtcatccctcagtatccacgggggactggtcccaggaccccctgggatagcagaatccacaaacgctcaagtctcttatataaaatggtgtagtatttgcatataacctatagcacatcttcccatatactctaagtcatctttaaattacttacaatgtacaatacagcgtaaatgctatgtaaggagttggtataacatattgtttaggggataatgacaagaaaataaaagtctgtacattttgagtacagagacaaccatcctcttttttcaaatatttttgatccatgaatcttttcaatttgaaaaatatattttttcaatgtttttcaaatatatttgaatccatggatgcagaacccatgggcaaagagggctgactatgtatccagaaatggaattgccagatcatgtggtaattctatgtttaattgcttggagaactgacatactgtttttcatacgggatgcaccatttaacattcccaccaacagtacacaagtgttcctatttcttcacattctcaccaacacctgctattttctttttttttttaagtaatagccatactaataggtatgaaatatgaaattatatctcattgtggttttaattggtatttctctaatccttagtgatgttgagtatcttttcatgtgcttattggccatctgtgtaacctctttgaagaaatatctgttcaaattcctttgcccatttctaaattgaattttggggtggggaggttgttattgagttatagtttttttttaatatatctttatcagacatatggtttacaaatatttttcccattctatgactgtctttttactctgttgatagtatcctttgatgtacaaagatttacattttgatgaagtccaatttatttttttcttttgttgcctatacttttggtgtcatacccaagaaatcactgccaaatcaaatatcataaagcttttcctctatattttcttctaagaattttctacttttagtttttacatttaggcttttgatccattttaggtaatttttgcatgtggtgtaaggtaagagtccaccctttttgcatatgttttcccagaccatttgttgaaaagactttcctttccccattgaatgtcttggcaatcttgtcaaaaatcgtttgaccatctatgtgggggtatatttctgggctcactcttctatttcattggtctatttgtctgtctttctgtcagtactacactgttttgattactgtagctttgtagtaagctttcaaatcagaaattgtgattcaaatttttttttcaagattatttttgcttttctgggacctctgtgattccatacgaattttaggatggatttttctatttttgtaaaaaatgtcattgtgataggtatttctctgagtctgtagatcactttgggtagtattgacatcttaacaatattaagacttctaacccatgaaaacaggatatctttccacttatttatggcttctttcatttcctttagcaacattttgtagttttcaatatacataccttttgcttctttggttaatttataagtattttattctttttcaagctattataaatgaaattttttcttaatttccttttcatgtttccattacatgtattgcaaatatattcatgttgtccactgttagcatatagaagcacaactgattttatatttattttttatcctgcaactttgcaatattgacttattagttctgtcatgttttttgtggaatctttagaattgtctacaaattatgttatctattcagagataattttaattcttcttttctcatttgcatgtcttttatttcattttcttgcctaattgctctgactgggacttttaatactactttgaagagaagttgcaaaagtgggcatccttgtctttttcttgaccttagaagaaaagctttcagtcttttaccatcaagtatttttttagctgtgggcttttcgtttatggcctttattatgatgaggtagtttccttctattcttagtttgttgagtttttttaatcttgaaatagtgttaaattttgtcaaatgctttttttgcatctattgagatgataatgtggtgtgttttccccctccattctgttaatgtgctgtattacattaattaatttttatatcttaaatcatccttgtatttcaggaataaatcctacttggtcatggtacaaaatccgtttaatatgctactgaatgcagtttgccagtattttgttgaggatttttgcatcaatgttcataagggatattggtttgtagttttcttttttgttgttgttgttgtttttgttttgttttgttttgttttgttttgttttgttttgtttgagacagagtctcactctgtcgcccaggctggagtgcagtgatgcgatctcagctcactgcaacctccacctccctggctcaagcaattcccctgtctcagcctcccaagtagctaggattacaggcacaccccaccacacctggctaatttttttttttttttagtagagatggggtttcaccatgttggccagactggtctccaactcctgatctcaggcaatctgcccacctcagcctcccaaagtgttgggattacaggcgtgagccaccgttcccagctgtagttttctttacttgtagtgtttctatctggctttggtataaaggtaattcttgaatgaagtaggaattgttcccttcttttcagtattttgagagtatttgagaaggatttatggtaattcctctttaaatatttggtaaaatttaccagggaatccatcagatccctgggcttttctttgttagatggttttgcctaacagatgttatctccttactagtgataggtctgttcaaattttttatttctttatgattcagtcttggtagattttgtatttctaggaatttgtccacttcttttagattacccaattctaattggcatacaactcttcatagtattctcttataattctttttacttctgtaaaattcgtagtgatgtcccaacttttgctactgattttaataattgaggttctttttttttcttaatctagctaaagattttgtcaattttgttgatccttttaaagaactaacttttggttttcttgattttctctattgtttttctattctctattttatttctgctctaattattattatttcctttctccggcaagctttgtgtttagtttgttctactttttatagttttttaaggtgtaaagctagattattgatttgagaccttatttttcaatgtgagcatttatatctatagatgttttagcttagcattgctttgctgcatctattagtttttgctgcatctattagtttttgctgcgttgttttttcatttttatttgtctcaagatattttataatttcccttgtgatttcttctttgacccactggttaagagtatgttgtttaagcctgggcaacatagcaagacttcatctctactaaataaaataaaataaaataaaatagccaggcatgatggcacacacccatagtcccagctacctgagaagctgatataggaggatcccttgagcccaggagttccaggttgcagtgagctatgattgcaccatgatactcctgcctgggcaacagaacaagaccccatctcaaaaacaaacaaatttttaaaaaataaaaataaagagtatgtagtttaatttccatgtatttgtgaattttacagatttccctctgctatttatttctagtttcatctcattgtgatccgaaaagatactttctataatttcagtcctttgaaatggtttaggacctgttttgtggcctaatgtatggtctatcctggagaatgttgcatgtgtgcttaagaaaaatgtattttctgctgaagtcctctatttccttattaatcttctttttggttgaacaacctgatttttaaaaacaggaaaactaaaacagatactaagatacatgaagtaatttgttttaaatcaggccatgtccatcatgacaccaaataatcttcctatatcaaaatatatatttgaacttttaaagcaactttttcaagagctgtcatatgtggtcatacaggttctgcactgctcaacataaatgtgtgcaaatgctttaacttctaactggcagtagccaccattttataactctgaagtaattgaaagacagaatgagattccccttgcaaaacacagcctgtatcctttcagaggttttttgtgtttgtgtgccccctctcccacgaatgcatgaaatgcaaattaaacaacaggtgttttctctcagtccacagggcatctgggaggacttaggacagtgggtgatgtaaggagaggactcctgaatcagtctggcatctctactaactagagatcaaatagataggcctgaaaggctcacagcaaaaatcagataccagccacaaggtttcccactcaagacctcagccagaaggaaaagctgcagatcaggcacacactatagacctgtactgcagtgccttgatcagtcactacccccagcagcagcactgacttcatgtatgccttcctttctcttagtgtcttattaagagcctggctgaagccctaggaaggtcaacaccccatcttccaccttgcaccatctttgtttaagatctcatcttgttaatagtgtagagataatttaatgtgcataccagtccattatctgcccattacctacttcccctttccctaactaatatctgagaaaagctgattttgtgcctgcttgactcagacatgaagtccattctgccctcattgtgtttcaactcagagatgaaaagtccatacagacctactgtgtatacgagttggtttagatttctgatgaagtatataatgcaagcaatagactgtgaatgcagcatttattgcactccatggaaaatgcagtgactatgctggttcactgctgacagaatattccacaaggacaattactactttcttttatccaatgacaagaattatttaactcattaaatttttttttcactttggcttcttggaagctcagttaatattagcttagggttgtggtgtcacttttttttcttattctctgtcaatcatttactgagatatgtttctttatgattatctggttcaagtcttttctacaagtttatcattcagaataagcttaatggggactattggcctcagaatgatcacatgattgtcacagccattggaccacatatataacagcattgccaaatttttcagttccttgtattgtactaaccccaaaagtctgagacatgtataaacccagagtttttattgagaacttagacttggcttctttaatactatcaaagcacccctatacatatatttataaaagctgaaaataattgattctcatccattttctttttttttattattactgttggatttttttttattatactttaagttttagggtacatgtgcacaatgtgcaggttagttacatatgtatacatgtgccatgttgttgtgctgcacccagtaactcatcatttaacatcaggtatatctcccaatgctatccctaacccctccccgcaccctacaacaggccccaatgtgtgatgctccccttcctgtgtccatgtgttattgttcaattcccacctatgagtgagaacatgtggtatttggttttttgtccttgcgatagtttgctgagaatgatggtttccagtttcatccatgtccctgcaaaggacatgaactcatcattttttatggctgcatagtattccatggtgtatatgtgccacattttcttaatccagtctatccttgttggacatttgggttggttccaagtctttgctattgtgaataatgccgcaataaacatacgtgtgcatgtgtctttatagcggcatgatttataatcctttgggtatatacccagtaatgggatgactgagtcaaatggtatttctagttctagatccctgaggaattgccatactgacttccacaatggttgaactagtttacagtcccaccaacagtgtaaaagtgttcctatttctgcacgattctcatccattttcaaagatttagaaagagccttgaatgtggaattggtcatttccatttaaaagtctctgtcttgagaaattactgttcttttattgctagctagcatacaaattcctaattgaaaaacctttacaagcagtgatggcatgaattgaacttacttctgtcctattagggacatgtcttggtcaggaaaggaatgcacgttggattcttaatgatttgtgttttatacggtctgtcctcaagggctatttcagtccccaggatgctaataagcagtccctgatccaggtcatttgtatttttttatcagcaaaaacagcatccaagccatacctcaatttagaacatctctaaattcaattctgttcaattcaatacaacttatcaaataattatcaattgtgctaggcattttctgtttctggaagtgcagcaatgaatagatctcagtccctaccctcatgaatgccacaaaagagaaagactgacaagtagcttgacaattaagtcacacagaggagaagcttctttctggccaccagtggggagaggacaggataggtttctcaaaggagatggctcaagcaagcatcacagacttgtcagcctggaaggatgatggagactagacccagatacagttcagagaacacaagaggttcaagagagaaggaggtggaggccctgagcattcccaggggctagtctggggcaacccaaggtgggcattcagtaagtgtttactgaattgaacaactgagtataaagaaatcagaaaagaacacaacagtgtgaaaatgaatggagtcatcgctgcttattcatcagggtcaccgaactcaggctacagactgcctgggacaggggattcgtgtactgacttgactttgaggtgagtcttagtataaagcaaccctccatttttccaatgaaaggagaacatataaaacagttttgaagccaacttaagtatataaacttttggaactggagatgaaatagctgaatgtcaatgtatactatttaattcattatcttagtcacaaatacgaatcaaataatatatggattgaaaaagtttacttctttccttcatcatcatttttcagtcttctagaaggcatagttggggagcactgcctctgtcctccgctgcctgttgaatacgtagcactgctctgaacaggtgtgtgaggcacctactagagacaacacctgaccaaggttctttcttgccatttatgatcttcagaactactcactatgttgctttaagaggttgatttgtaagatccaaaacttaattgtgaactcatacttccaggaatgcttcttaaactgaattaaatttctgtacttcctttttcatttccatcttgtcctttgtttcactggttctgtcagtaaatttctataatcagcccaaacatgcaatgatttaggtcacttcaaatatgtaggccttcccaaacagaattttgttatttaaaaaatacagtaattatcagagcacctcaaaatttggcaggtctgctaaaaggtgactcctgttcctaggagtgtgtatggggaagaatctctctataatcatccatgacaaatatggaagtaatttacattagctggtgaaaggcttatttatctctaaaaataaggttatactagaaaagattggctggactggctttggtactcctgaacctggaagctggctatcacacgccaagtttctaaaggctgccaaagtgccagccatttcatcctctaagaaccctagactagagggatccttaataggtctgatcatctgttctttcggcaagaaaggcatctctcacagccagcgcttttctaaaagaaagttcatagtgctcctggttaaccaagactgtgaggttctttcctttgggctttgttttctgaatgatggaggtaatacctagtatttgtaaaactctacactttacaaagcacttccacagcctctctctcccctactcccagcacagtccttggagttaagagcagaacctacttgggcttcaggtgacacacccacacccagcaggcagaatggcccctgtgtctcccctcccaggggcaggagagacacccacaggctgagtcctcagggaaggtcaatactgcaagaaggccaggcagaaggcctaggtggcagagaggatggaaagggacaaaacggcttcctgagccaggatcccaggagtcctccaggtgggcaaaggagtccttcaggtggagaaaggagaccctgagaccaggagagagaggaagggggtctccaggcagaaggtggacgagaagcgggaaggcgcaattctggaaggacttggtatgtcatttatcttgtggggacataaatagggagtccttgaagggttttcagctggggagatatttgatcagatttccatcatagacagttcattttaattacaaactaaaaaccccacgggagggagaggggttaccaggaggacagataggaggcttcatctgatggagtcctaaactcagggatgggcagatgggaatgaagaggagtccactctcccaaagccctgcagggccccagtgtgaccccctcccaccccacatctgatcctaaatcctaaactgtgtcagctgagatcaagctgctgctccggaaaaagagcagcaagttactctcctctccaaggtgatcttcatcatattattagatgctctcatagtctgtcttccccaggaaaaactttttcctttttcaaaagccctgagcatctcccagagacagcatgtaaaggagcatgccaagtgatgccctaagagttgcaggagcaatggcccaggtcccgtgccctgcgatgagaagggtgactgagaaggctgggccacttctgagcccttggggtcctcacacggtgggctttctcccagccagtccaaccattagagcagagaatgctacccatccatgtcctcagggtattgagttgttttttgtaaatcacctagaaaggcactgctgggcttgaaagcacaatttattgctgcattattaaatggtcccagcagcaagccacgttctttttattgacagagtaaaaatgaagcaacccagggggtgggacgctggaaaataggacagaagccgtggttccagtcccttcccaccccagacacacagaaaaagtccttttcctgctccccctgaaccccgcaggccaaggaaccaattctatattcaagatccttagagaaagctactgtgtgtaaaaggtgaggtatttttaaagggcatcaatttctgccagaaattatttgcggaatgaagccaggaaacataagcaatcaaaagcagacaaaggaagtgtccgttgaggtcccaggacctcagaagggtttggacaggcattccctctaccttctgccttcccccaaccagccccttgcccccaagtccttccctttctgcctccttttcagcatcgggaggaacccccacatatagggaccctatattatgagctgggccatgccctcctttcttgtacacaattcaggaaaatcctgaggaaggaagccactaaaacctgcttctgtctcagatttctctgcaaatcctggaacagcttcgacttcgcccttccttttttccaacaaagtggactctattgcataggcctttaagccaataatattaagtacacattctgcacaggtaaataatggccagtatttttcctcatactttgagctgatttttgaaaatattatcctgtcaaaagcatttcttttatatctctaaggaagaaaaaaatatttattctgtagctcgtaccttttattgtattctttctctgtcatgctattctattcaaaccaacatcctccaataaaatttccttcaatcccggggcattgaaatgctccagagggggagtggagtggggagggcaaaactgcaagcaaagctaggattcagaatgaccaattatatttatagagaagcttttctgttcataaagtgctctaacagacacatggtgtcactgattctcactcactcaaatccatgaaaaatgggtgaagtcaagtgactcacccagaggcacgcagctccagaagtgacctctgcatcctctagagctccacagaaattgcttccccaccctcactgccatcttcacccaagtattgagataactcccgcctctgtctggagggtccccttccctctggcacactctgcccactcagggatcgtacacgcaccttgccacgtggctgccaaaggtgcaactgcctcaggtgccactgcctcaggatgatacctgagtccctttgtctgggatatcatgaccacagcctcctgcctcctctggccagccctcctcagccctgcctcagacacacccaggccagcctcagccacacctgcaagctttggcctgtgcccatctcttcttgagcttcctttcccctcctggaccaagccttagtacacgggttctctcttctctacactgctcactatgctgtaaatatgtatgttgcaaatatatgtctgtcttccatactgatttttcagttcctctagggaacgatgtttgtgtctttagtgcctggcacttagtaggtgttcaataaacatttatgagaggaaagaattgagagagggatggagagaggaggaaaaagtggggaggatatgagtctgggccttctgagtgcaacccacaggtcactggaacacagctaccaatacacccctccatggatgggcacgccagtgtgttctctctggggtctctccttgagaaactctcccaccacaggtgttctttctgccttcctctctacctggtaggcagagactcgtttaagcagactcccagctctcctaccagaaaagggcttcaggtctcaaggttcacaaatgcaaatattggtgccaccttgtgtgatcatgaacatcccacaccagcaccgcctctacttgtgccacctaccccaacacctactgccaaagcatatcttgtgctccttagtttcattcaccctggtcccagtgtgaggcagtgtgagtgtcaccatttctcatcttctgggcccccttccaagtccacgaagcatgaataactctgaatgtgggtgagtggatagtagttctccttagaattcacacttgattacagaccccagggatgcagactcactctcccagggatgcactcattacacattcccctaaataggccagtaactgtcaatattagtgatgcttgcggatgttttgtggcatgtgggccatcgaattcacatgcatggcagactacaaaggcaccttagggacatctaggaaggagaacagctaaatttccatctcagaggctttggccagcatggtcaggggtgaggctgggtagaagagctgcccttcccacaaataggggcagaatgaagcacccagaggaccagcctgaacctatcatgcctgttcactctgcaagtgcttgcctgctgtcctggaaataatcaggaagtgtatcgagatgtggcatctgcggtccttaacagatacccacaggtggaaagagtcccttttcaagaggtttattcatgtccatactccaccttgtgtataggaggtactgacaccaggaggttccataggtttgtttggttgtttggctggccaccgtgcctctgggctttcatgcagacagcaccacctatgcccatactgtaaccatctaaaaaagtttctttgagttaccaggtttcacaattggcctaaaatgtttccatgcatataggaaaaagtgtaaggacttcgaagtcagaaaaatgtgggtgtaaatcctgcttctgttacatgttagaaatgtgtccaccagtgaaatgagtgaggggccaggaaactgaggcccatgggccacatccagcccacctcctattttttcatctgtttaggtatttatggctgtgttctctcaataacagccaagccaaatgcttgtgacagagacccatatggctgacaaagcccaaaatatatatctgggcctctacagaaaaagtgtgccacccctgggtaagattatttcacttctctaatcctcagttttttcatctgtaaaatggacaaaaaatttacattgaagaagtagtgctgtgagaaataaatgagaaaaagtcagacacatagcaatgcttgcttgctacatgctgggattctttttttttttttttttttttgagaaggagtctcactcactcttgtcacccaggctggagtgcagtggcatgatcttggctcactgcaacctccgcctcctaggttcaagtgatgctcctgcctcagcctcccgagtagctgggattacaggcatgtgccatcatgccaggctaatttttgtatttttaatagagacggggtttcaccacgttggccagactggtctcgaactcctgacctcaagtgatccgcccgcctcggcctcccaaagcatgctgggatcattaaatgcagattaaccttgctgttttctagccatgtcattcatggacaggtaagaaagggacacagcttgtcttcctgtctccatccgtgtttccctcttcatttctcgcctgcccctgaaagtagaaaagcaacaaaaaaacaaacaaaaaaatcattcagtgtctttttttttaaacgtgggatggaaaataaacttaccctaaacaaaaacttaattctattgggcatctcaggttacttattgtatcatcattttatttttagtgtaaaattaatcacgcaatatgtagtactgaacaaagaagagggccttcttgctttctcccatttacagaatttttttctcagagaaagtattgtttagatagtttcaaattcccacacttaaaatatttgtcttcttgagaaattttaataaaaaactaaattttataatggaatggagctatgtgagattatctgagatatgttttcccaaccagaaggaaataatcttccatatttgtcaagaaggaggagagacactttgcttctcccaacaacttcctccaactctttttatattaaaactttttttaatttcaattcgttgttttccttatcatctcctcagcagactcacaatttgccttgcaaagaagtagaaatcctccaaatggattaccaaaagaaagtatatccctaccaaaactaaacatattaaagcatttaaatatttttaatcagaactattacaaggtttaaaacagagataaaatggcttcagtgcagggatactgagaaagccctagacccggtggagcttgtattaccttccttcccttcactgcactcagcaaagatctgagcatagaggttgtcgtgtttttttttcaattattaccttccttcaactaggttaattagctatgattccagccaagaggttctactgcttttatacttgtaactaaaagacaatctctaaacacactgcagaaatgggaaaccattctggctctggatattcattttgtgacctgctactcttagatcacatgattcaactcaagtatggaactgtctttcctcaggcaaaaatccaagaagactaggaggcctcttttagatcagaaagtgcaaagaggagaaaagcatggctttcctcccaggtgcttgtgcctctgatccattttgtgaaaagaatccaaaattgatcctttggccttggcaccaatatggttgctacagtcctacaggaattagtgtgaggcaaacctattagggagcagttgcctaaagagggggcaagagttaaagacctccaggtcctccacagcctgccatgtaccccgtgagtgtgaactgtgggagatttgagatgtccctgcacttgtaagtctcatgctctggttgttggtgaaggtaaccataccaatccattgtggtggatggagctttggaagcaggacttctgatgcctgttctcattgctaattacatgagtgtgggcaagtcatttaacctctctttggttctgtttgcctgtttgcaaaaaacaatacttgcctcaaagtgttcttatgacacttatattgcacaaaggctgtagttgcctaacatatcactgtgcacaaagcaagggcccaacaaatgcttgttccttcttaatttgtctatgattatgagcctcatatgcactaaagaaactataaaatttcttgactgcaagaaatcaatattatactgccatctaaaattcagtattgtgtttgttagttggttggtttacttagaaattatgcctttaggtgaaaaaattatggtgagagtgtgaggagaagatatatgtgtaatgaatggtcatgtgatcatctcacctctatagtagggttatgttgtaaatcatccattcttaaaactacttgtgagaagatactttaaatttcctctaaaaaatgttgaaatcaacagaaaggacgaagaaatggggagagaaaaagggaagtcaagatgtttgcaatgatgttgggaagacagggaaatgatatgagaaaagctactgtatggcaaatgtactcattcattaaaaagtcaaaaaaacaacagatgttgacaaggatgtggagaaaagggaatgcttatacactgttggtgggaatgtaaatcagtacaacctttatggaaaacagtatggagatttctcaaagaactaaaattagaactatcattccatccagcattctcactactgggtacatacccaaagggaaggaaatgattatactgaaaagacacctgcacttgtatgttgatcgtggcactatacacaatagcaaaaatatggagtcagcctaagtgtccatcaaaggaggattggattaaaaaaaatatggtacatgtacaccatggaaataccatgcaggcataaaaaagactgaaatcatgtttttttgcagcaacatagatggaactgggagccactatcctaagtgaaataactcagaaagaggaggtcaaataccgcatgttctcactcacaagtgggagctaaacaatgggtacatgtggacatatggagtggaataatagacattggagactccaaaaggtgggagagtggaggggggtgagggctgaaaaattacctctcaggcacaatgtttactatttgagtgatgggtacacatagaagcccagactttaccacaatacaacataggcatgcaagaaatctgtacttgtgctctgtcgatatatacaaatgaaaaaattaaagtttttttttaaatgacaggggaaaatgcactaatttaggaagttaataggcaagcagagagacaggtgctggggataccgtggtgagccacaggctgcacaccctccctcctggagtcacatccgtcagtacccacgcagatacagagctacagcagtcatgccaaggtatgttaggaccaatgcagggtgttaggggctagaaaaggtttcccaaaggaatgaatgatgcttcaactgaaaattgaggaatgagtgggaattcattggagagagaggcttttcaagggcgagcacagcattttctatctgtgggaagagaatgcggctttacgtagcatttgagaaacggagagatggcagtgtggctggagcacagagaggcaggtacaagacaaggcaggagagctccggtgggcccagagagctgccaggtcgggccttccaagctgtcctgagagagtcccagccatcagcacagctgttctgactctggaaataaagagaaagaagtcaatgagagccctttagttgattccgtatgaaggatgcatttgttgttttattctctctgcttttttgtatgtttgtaaatgttcatgatagtaaatttttaagttagaacaaaaaaaaagagcccttctcaccagctgcaatttggttgtgaatgtgggccagtgaccagaagtttctctgagagtgcaaactttggcttgcctgtcacaggggaaggttatggcctccttagagagaaagaaaaagacaggctcattctcttcgtggaagaatcaaagaattcgagcacttggttaatttactgagcctcttccatctagagaattaggctgtacatcctacgaagcgtgctctggggatttccacgaattcttgtttacacccagaccacaaacaacacaacaggagttcagattttattacacagtgatttggcatttgcagctgaaactgaaattgcaaagaagcagaagagaggaacaataaagaaccatgcaaatcttttgaacacttcactctctctgtggttctggctctacatttggaatactctttctttttttccttccgtccttccttcttttccctctaagtgtcaattctgaatatatgttaagcactttgcaatgctcaaggggacagaaagataaacaagtatttatccccgcctaaaagaccctctgtagtgagaaatacactaattaaacaagcacaaaatgaagcataattataaagtgggatccatgctcttaaggaacaggaattgtgttctttccacgagaaagcaaatgttgtcacctacagccagattgcttccaggtatttcatcgtaggcccgtggggtttcaggtctcacagtcagacacacagttctggggctcagaaaggctgggagtccagatgggcatttgctgtctgctggattcaagacatggagtgactgaggtcacccagaaaaaggctgagaagggaagagaactgaggactgcatcccaagcaatgccagtagctaaaggacaaccagaccaaaatggggcaacaagaaacaacaggagggaaaacaggagacacgtctgaaataaagaagaggagagagaaaaaaatcacaccaatggtgtttcttgggttaaaggaggcttgttacatgtttgtaagatctggggaaggcgctcttatagaggaggagatggaatccagagaaaggcaggttaactgttagcgcccttgtttaggaagtaggagagttcgctttggagaaggacaattttcacccaagataaatgggaggcaggagagagggaagataacctctcaaagtgagaatcaatttcttttctataaaataagattattgcactaggtaagctctaaggtcttatcacctattttcacattttaagagataatatataatcccttttagtcccctgtagctgtttttatagcttgatcttagaagcaagttttcatgagtgatatactattcattattttgaaagaaaagactgacagacccattatatattttttcctggggccactgaaggaatcgtcatattttagtatgatgatcctgaaaaaatacattgttcaatgtcacttatatattcctgcctagcaatgtaaccatgaagaagcagcaggtaaacccaaaattaggaacacctttttttttctttttttcttattttcaagtactatactcttcaaacaatgtcagtgtcataaagtcaaagaaagtatttggaaataatccagattaaagaaaactgaattaatacaacagccaaatgtagtacctgattctagacttgatcctgtataggggagaaaaattttggaatggacattgttaatgtcaattggtgaaactagaatactgatagtggatttttttaaagtactgtgtcaatgttaaattgattgaagttgataactttatgtggttatgtaagagaatgcccctattcataggaaataaacactggcatattttaggataaaggaccataatgtatgcatttaatcgcaaatgggtgagagagagagacagagacagagagagggcaatgataaagtcagttgacaattagggcaaatgaaatatagatgttcaatataatatttctagtcttataatttttctgtaagtttgaaattattttcaaataacaacttaaaatacacattaatagctaaaggagtgctcagagtcctgtgttccagcactgtgccactgcatatcagaagctccagagaactctaagaataaggccatgccttgctgaggaagtctgtcttggcattggaaaaaactgagctcgtattatttgtataaagagcaaaagaactaagtgttctgtggcagttgtgaatttgtgaagttgtaagggtcttaacttgtatatgaccccatattttctgttcagcatatatttgtcttataaaaatcaattgttaaacagaagaaaaagtaaataataatcaaaggaagccccagcacggtggctcacgcctaaaatcctagcactttgggaggccaaggcaggaggatcacttgaagcaaggagttcgagaccagcctgaccaacatggtgaaaccccctctctactaaaaatacaaaacttagccaggcgtggtggcacatgcctatggtcccagctactcaggaggctggggcatgaggatgggttgaacccaggaggtgacggctacagtaagctgagatcgtgccactgcactccagccagagtgagactctgtctcaaaaaatcatcatcatcatcatcaacaaaggaagaagagaaattctcattgctaaagcagagaattcataaagagggtatcacagggacatgaaatttccctttggtatagattttttaaattgtaagatatagagagagcaaagctgatagaaagccttcatttttctacggctacagtatcatcttaacaagttcctggagtgtcaaacgcaggctgaattactcttttaggacacgcaataaaaggggtagagattacagggtaatttgaaggaggctaatgtttctattcttttaaatctgacaacagatcatatcatcatttcatgatactgtgtacttaaagttttcttactattttttcactgctttggaaagcagccttaagtaacgtcttcctgtgcaaactggtagaaccattctgaccaccccgttaacaaccccgctttggttggcgcgagcctgaccggcggtgcagttatcttcctgaaggcggcgctgtgccccagctgtgctgaaggaggccggcgtgaaggaaggggaggggcgttcccgggcagaaacccagctgggcgccgcgtttaaaagcacaaagggagcatagtctagtgagaagctacacgtttgcaagtggtacacataagaagagagatatgagcggcttctatgccctacaaaagcgtcgaaattaaaaaaggcacaatcttttgttcttaaatccccaagtgataataaagatgttcgcatagtcattatcccattaccttttatttcgcatttctctcaccttcttttgtcattttttaaactttttctccttccccctctttcactccagaatttgttttataattgatgtcgatgttttctgttgcttagaaattaaattatcagaaactcctttgtatactggtctctgacctataaatagcaccacagctgcctgtgacttacagcaattaaagatttttgtgctagccagaaaaagaaaagaaaagaaaaacctgaaggtcccagtgtagcatgtctagttgttctgctggctttattgggaggaaatatgagaaatggctcttagaaaatattttccttatcaataattgttctttggagttcaccttactcaacgaggatgtatcagaaataattattggggttgaatgtatttcctgtcaattagtgtggtctttttccacaagagtactttcttttcatttttcaaggatcatagacaacagctcttccctataaaaatatttttgaataaaaagtaccatttccattataagatcttggcaatcaacatatcttctattatatccaaaagaagagaaaggctttaatggggcctggttatgattaataatagatttggtgaagaaaaagccagccagactttaaaatagatgagaccattcttagtcttggtgagtcttggttcagctcattagggaagccagctgcgatgcagattggcataccatttctgtgacagaggaatttcccataagagctctctcctaaaggaggccagtgtgtttttaggtgagccctggccacatctggacgatagagatgaactgtgccatacaggaggtggaacaagagtagaggaaaacaatacaaatgacttttaacatttggaagcctacttttagagggaataccaaccaaatgggaccaataaaatgataaaataagaggagtgattgaaaaataatttcagcacaatctttaatctatgaagagctaagagatggaagacagggaacggacatgtcttcttttgtgggaaaggcaataaggaacagataaaggctgtaggaagagtgccagattgcactaggacaaactgtgcaccaggtatcacaagaaacattgccaaggatgttgtacacacaccttttatttttaagaatgcataaactgtcttttgtgaataaactaaatttaatcctgcttacaagcagaaagataaaccaggtagtccctaatttcttgtgatcacatatccccttcaatcatggaatcacaaagctgacagggagctttggagatcacacactttataaatgaggacacccattttgacaatagtccaaggtcatgagggtagtaagtggcaaagttgaagcaacaacccagttctgacagcctccggtccatggttattttcccacttcacaaaattacctccttagtccatttacaccaaatacagaaagttaaactccatcccatttccaggtctcacacccatgctgggtttgagtagcattcctattagcttcatgacttctccatatgggtgagccttagagaagacagatacgaggatccccatctgagttaaaacccaaagaaaatcctggcttacatggtgaaaccccgtctctactaaaaatataaaaaattagccaggcatggtagtgggcgcctgtagtcccagctactggggaggctgaggcaggagaatggcgtgaacccaggaggcggagcttgcagtgagcagagatggtgccactgcactccagtctgggcaacagagcgagactctgtctcaaaaaaaaaaaaaaaaagaaattaagagtctttgctgaggtcaaagccagccttccccaagcccccagctctgtgtgacttccagggggcattgctgcaactgatttctgacacactgtcttcctgtttgcctttgtaggtttcacagcggcagcttccctcgtgtccctggcctgggccttggcctcctaccagaaggccctccgggactctcgagatgacaagaagcccatcagctacatggccgtcatcatccagttctgctggcacttcttcaccatcgccgccagggtcatcacgtttgccctctttgcctcggttttccagctgtactttgggatcttcatcgtccttcactggtgcatcatgaccttctggatcgtccactgtgagacagaattctgtatcaccaaatgggaagagattgtgttcgacatggtggtggggattatctatatcttcagttggttcaatgtcaaggaaggcaggacacgctgcaggctattcatttactattttgtgatccttttggaaaatacagccttgagtgccctctggtacctctacaaggctccccagattgcagacgcatttgccattccagcgctgtgtgtggtgttcagcagctttttaactggcgttgtttttatgctgatgtattatgccttctttcatcccaatggacccagattcgggcagtcaccaagttgtgcttgtgaggacccagccgctgccttcactttgcccccagacgtggccacaagcaccctacggtccatctccaacaaccgcagtgttgtcagcgaccgcgatcagaaattcgcagagcgggatgggtgtgtacctgtctttcaagtgaggcccactgccccatccaccccatcatctcgcccaccacggattgaagaatcagtcattaaaattgacttgttcaggaataggtacccagcatgggagagacatgttttggaccgaagcctccgaaaggctattttagcttttgaatgttccccatctcctccaaggctgcagtacaaagatgatgcccttattcaggagcggttggagtacgaaaccactttataaagcaaaaggagttgcaggacccacaacatccagatgaaggggtgacagcagggctgtggccataatgacacttcatcctagagcagggcagtgagccgtgaagttcctagtgggaccgtcatcaccattatcatttgatcctgtcggctgggggcggctggtctccttccaaagcagctgcacccgagagtctctgactccacctgaaagaatgacgctggcttaataggactctccattgctaccaaactcctcctgcacggtcttgggtgcacccaccagagggtactactattatggaaaaattttgcctccaatcattagggtgtcttgatggcgttaactgatctttccataaaaatagattcagtcatacacacatacacacactaacacacataagttacaccagtcctctgtcaaaaaagcttaggtgacttttcttgatgcaaagctctgattcccacaggaatataaaaacaaagaaagagggaaacatccctcgagaaaaaaaatagtattgcttagaaaagaaaccattttctcatttggaaatccataccatgtgtgaaaatcctatccaacggacagcaaacccaaatgttgtctacacatgtgttagcattgatggagtggttcattttctacacatttcaggatttgttttatattttaaattttcagttgcgaacatcctttttgacagaaatcctatgcagcccatgtacggctttcaacaagaccaaggagctcaataacttcatgatgtaaattaaatagtaatcatgattcagtattcaattgcaaaaatgtaacaggtacacaaagaggaagtggggaaaaaggcaaaatgagagtctgattcccaggcatgtgcagcgcccattgggacataacggcagtgcggcgcgagccagaggaatgggctggaaccggatctgtttccagacgcagaatgagtggctctgtgtgaccataggcagatgctgactctggaagactccgtgccactcctttctagtgccaaacaccatccaaccacaggactgacgtggaagccccaaacaactgagaatgagtggcatgagccccctaaaagcaggcgagagaacgagcaatcaagttctccactgtgtacagacttttcctccccccaatccaaggtcaaagtgatgtgtcttttagaggctttgggacactttttagtaagtatgagcagacaaatgcaatgaatatgctatgaaaaaacccttctgaactgagagagggcttatcactatatccagctaagatttgtatttgaatcatctgtaaagtcgcactcttacaacaagcttctgggttttaaatacctccgtacagcaagtaaacgttccccgctttctgttctcagtgtcctcggtcatggtgcttttcgttgcattaaaagtgccggtcaaactttgatagtatttttttatagttggtgcagagtggaataactcatggattatttcaatatttttgtaataaaaaatatagggtatacacataggcatcatcacattttttatagacctggaatcgtttaaaatactttaagcatcataattacttgggatgtcagaaactggtccacaaattccatcagcctgcctcagcagattgaaaacatttgtctcttgcaagatcaccctactttgcaagttggtgcccccaggaacctggccaggggtgctatcagaatatcaggtgaagagagaatcagcttaaatagaaagggcttgtcaagactggccaatgtttcccaggaaatcaaagatgtaaatgattactttcatccatccattataacaaacctgaccacagtggaagctgtcttaaacttccttccctggttttatattaacccaactgatagattaagtattagtcaaaccactaa

SEQ ID NO: 847 - DNA, 82938 bp, Homo sapiens
cgagtcacgcgatttccgggaacccgtcaggaaggacataaacaaaacaaacccgaggcagcatggagaggggccgtggcccctgcagcggaaccggacccagtccctgagccgcccctacacccacaggtgagcgccgccacccgctgctcggaacccccaggggcctgggctgggggaagagcggaacggggggcggagggccgcttgcctaggaggcagcagcgctggggctctgggccgggccggcgcggggcgggggccgggaccacggccgagtgctagggcgcgcgggccttgggccaccgcctgcaggtcacgggggctccgctcccctcccccacccccggcccgggacggttacataaaagcgcggggcggcggtagatgggactcgcgggcgggcagtaggctaggccggggatgggcagcgccgggcgtccgtcctgccgggccgcccggcccttccccgctgcctccgagcccggggccgctgctgccggcagtcggcctgtcagagaagagagcgggtgggaggggcccgggaggggaggggaggcgagactggcgggggaggaggggagagaggggcgtgtgaggaagggccggggccgcggaggttggagccaggctggcaggagacgaagaggcgcgggctggggctaggggggtccgagcagggcgtctcgggggtagccgctcccccttctgtccccgcctcagaggcgacgggcgaggggcctccctcccgggatttgtttatatgtcttctcaaagcagcttgaagcggctgaggggcggagccctcagagctgagtggcaggctctggcgtccaatggagcgggcggatggagacttctgcaccaatgggcgtgggggaggcggtgccgcgggggggccactaattggttaggctgtgccggaggtgggccgggcggggcagccatgttagatgggaggggaccagtggtggtgggtcactgagaggggaggagacagggcaaagggcgagggagccgggccgggggtgtttcgggtgtccgaaggcgagtccgatcggaccaggaagtagctcaggggagcctgacctcgacccgcctttctcctcacacgagctgaggaggcagggaagtaccgagggcagtcaagcctcccctgggggtggttcctgggactagatggagctcagtctctggattctccctctttctcggccctatgcttcctgacagacctggccgccaaaccctgtaatcgccctcctttaacccaagaaagcaagtctttctgccgtttctgagctggcttgagccttaagactaccttaaggaggtacttggataaatagcggtctgaatttctgtaccaggcctcagataagagacaggcagtgaaggggaagttttgtaaaagaaaacgggactagaaaagccgagcaagttgagggctgggcggggtttctttttttttttttttctcatcaggatgccttttaaagattaggccccgtgcttgtcctagtcttagtagtaatttgcccctcttgctaacataagttggtagtccacattaatcagcttcttgagaaaactgagcccacaggaagttatttagtttcgaaggttctttgggacttttcttgcgaataccctgcaggtgaaaaataggatcaaggcctggaatttctttttttttttttaaagcagaaaacaagacttgggtgtaaatcttgtgatctgtcgtaaactagttgtcacttgattgtacttttaaatatctttaatcttttaatccaaaataggatatacaccagaggcagggaaaaatggtatgaataattcgaaaataacttattttaatctaattgtattatggttattttggcatccttttggccttgttaaatgcttaatttaggtttgtgtttacatcggattacaacctgtggctacgttggtattgtcaagggtaccaagctcttgatggcatctttggttaagtacttaggcgtaagaacatgccttagatagatcatgcaggggctaatcagagttagctgtattaagaatttgcattatcttctattttattagttggagaaaaagaataattggtaactgattcatcaattttttttttttttttaatttgagacggagtctcgctctgtcgcccaggctggagagcagtggccagatctcgactcactgcaagctccgcctcccgggttcacgccattctcctgcctcagcctccggagtagctgggactacaggcgcccgccatcacgcccggctaattttttttgtatttttagtagagacggggtttcaccatgttagccaggacggtctcgatctcctgacttcgtgatccgcccccctcggcctcccaaagtgctgggattacaggcgtgagccaccgcgcccagcctctttttttttttttttttttttttttttaagacggagtctccgtctgtcgcccaggctggagtgcaatggcacgatctcggctcactgcaacctccgcctgccgggttctagcaattctcctgcctcagcctcccgagtagctgcgactacaggcgcgtgccaccatgcctggctaattttttgtgtttttaatagagacggggtttcaccacgtgctggtcaggctggtctcgaacttctggctttaggtgatccacccacctcagcttccaaagttctgggattacaggtgtgagctactgcgcccggcctgattcatcaatttttgtagtactttggcatgactgactcagttctgttaataatgatacataaaaacgtaatccctgattatttgataaacttgaattcttacgtataacttttgcagtaaataagggtattagcttatttatcagttcttctttttcttttttttcttttttttttttttttgagacggagtttcgcccttgtcgcccaggctggagtgcagtgggaagatctcggctcactgcaatctccgcctcccgggttcaagcaattctcctgcctgagcctcctgagtagctgggattacaggcgcccaccaccacgcccggctaattttgtatttttagtagagacggggtttcaccatgttggccagactggtcttgaactcctgacctaaggtgatctgcctgccttggcctcccaaagtgctgggattacaggcgtgagccaccgcgcctggcctatcaattcttattttatcaggtggcattgtgttgcttttggaaccctagcccttacaatgccctaattagtttaacagagaagtatagtgaaaataaaaataaacacttttcattgatacttagaatattccaggcagttttcactgttgcatcggttgataaagtcaatcagcattgcttatataatgctctcttattctaagaatggcaaatagatgcaatagaacttatttgggtataattccttcatatgactggtatatcagctttgggttttttatattcataagcatagaagaggctaaatagctcccgaagagagtctggatgctccatttaccatcattctctgtcatggcaggtgaaagcaagcttttatatagacaatgttctacttagtttacagggtgtctacttagtttacagggtggatgtgtgtgggttctgggatactagtgtaagaagtaaaggaataactagcatggttcctggtggtggttaaatacaagtgacagtgaagtacagtaagtttgtgtgttgattctgttaatataactcagtttttaaaagataaagagaactgaaatcactgtttgcttttaaagcttaattttcagtcaagatcggcatctatatatttatttaaaaaatacatatatatatatatgtttttttttttttttgagacggagtctaactgcgttgcccaggttggagtccggtggcgtgatcctggcgcactgcaacctccgtttcctgggttcaagcgattatcctgccccagcctcccgagtagctaggattacaggcgtgcaccgctatgctcagctaatttttgtattttcagtagagacaaggtttcaccaagttggccaggctggtcttgaactcctaatcttaaatgatccgcccgcattggcctcccaaagagctgggattacaggtatgagccaccgtgccccctctagttatgtgattttgaaatgaattagcagtcgcttgtttccaagtagggttgaacttggatttttttgaggaacaattcactgacactttcaccatattcagtagctcatttcgggataggtaaactcttagacgagacataaatttgtcagataattggttctgattattttaagacaagggttgacagactttttttttttttttggaacaggatcaaatagttaatatttaggctttttcagccttccagtctctgccacaactactcaactttgaatctgtagcatggaaacagctgtagaaaatatgttctacatatttttgggctctattccaataaaactttatttacaaggtcaggctgtgcctctatttgtgcttccacggctatagtttgtcagcccctgttgtaagacatcagtcattgaggttttttgtttgttcgttttttgagacagagtctagttctgtcccccctgctggagtgcagtggcacgatctcggctcactgcaacctccgcctcccgggtttaagcgattctcctgcctcagccttctgagtagctgggattacaggcgcctgccaccgtgcccagccaagttttgtatttttagtagagacggggtttcactgtgttggccaggctggtctcaatctcctgacctcctgatctgcccgcctcagcctcccaacgtgctgggattacaggcgtgaaccaccacatctggcccagtcactgagttttaagtacttagatgttaaggtatttcagaatatacaaatagacactttaggtacatttgagcatttgcagattgtacagtctcctgccttgaagagaatttttagtacaagagcatatggcaacattgtattttgtatttttccttcgtttacatataaatgttttcttgaaaagctgtttaaagcaaatattggtataaatcctgttgattttagagatgcagtctgattgaaaaaactttggccctaagatatattcaggatatggtcctcttgaagtttcaaagcacatttagcatataatccttaacaaagctgtatagctgtttcaagagatgatagtcacgtgaatagtcaacacatgtagttcttatattcaaatatgcagttaatttagaagttaagacattgagtgctcattgcctgagatgcttgaagaattaaagagagtaggatgctttttccaggcccaaaaagatacaggttacctcctctctttttccagggaaaatgtcaagtcgtgctaagtgcctagtgaagcagagatgccgtaatctaaaaatataactgggaaatactaaatttttttgataacttttgctttatttttaatgtaatatttcaccatttttgttgacttgaactggatttcaagtggaagcgtaaaagtttagaaaagagaatatattgacctttatgaactgagaaacatgtggcctgcaatcttgtttctagatctagctaacctagggtctgcctggatgactacagataatctcagtttattaatttgtagtggtagggattaatgatgttttccatctcacaaggggatactgggaaatttttagttactgtattcttaaagtcttgtactttgaatatgctaatatttcggtctgcttgaaaccacttctcaaatctggattcgattttctcctggcttatttgtcttcccattaaactatgagctccttgaggtcagagtctgtgttttatttctatatattcactgcctcacactgtgcctgataccttttagtgctcttgaactgtttaaatgaatgcatgcattgctgagaactgcttatctggaaagtaataaagtctactattagagatgttgggcttttcttagttagaaaggaggaattaatcaccgtctgttcaaacaaaaagccttcattctaaaattgatccgttcttttaagaaagtttttagagaagctattttgatgatgtttaaaaatctctttagttcctttgttaatttgttttcagatgaactccattagttagacttgttgaatattccttgcaggtattaaaaaaaaaaagttgtgctttgttctttggatttgtcctatttggcaaatgtggatggaatctcttatttcatacaggtttgggataatttttcatctacatagtagggtctttttttaaggagggcactgtaaaatcattcttttttttttttttttttgagacggagtcttgctctgtcgcccaggctggagtgcagtggtgggatctcgcctcactgcaagctctgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggtgtgagccaccgcgcccagcctgtaaaatcattcttgctaataagtctgactcacctctgtggggtaggctaggatttggatcgagtttgacgcagggtgcggcagtagtatcaccagccaagccttatatgcatttcaccaatttatgacctttcctccaaaatctatattgtaactctccttcctaaacagctttctaaactactgctttccgtacttaactcttggcaacataaatcatcctacactctgtcctttcaacaccaaaaccacttttatatcttttgggtattactgattttgagaatttcctatgaaagcctcacaaatttcctgatttcttcttctctattttttttgagacagagtctcacgctgttgcccacgctggagtgcagtggcgccatctcggctcactgcaacctctgcctcctgggttcaagcgattttcctgtctcagcctcctgagtagctggtattacaggagcacgtcaccacactcagctaattttttgtatttttagtagaggtggggtttcgccatgttggccaggctggtcttgaactcctgacctcaggtgatccacctgccttggcctctcaaagtgctgggattacaggcgtgagccaccacacctggcctgctgatttctttttcttaatttttaatttcttgattaaaaagaatttttgttctttttgactttttttttttgaggcgagtcttgctctgtcacccaggctggagtgcagtggtgtaatctctgcccctgcgaccttcgcatcctgggttcaagcaattctcctgcctcagcctcccaagtagctgggactacaggcacctgccaccatgcccggctaatttttatatttttagtagagacagagtttcaccatgttggccaggctggtcttgaactcctgacctcaagcgatctgcctgccttggcctcccaaagtgctgggattacaggcgtgagccaatgcactggcctaaagttttttttcttaaagactagtgtgatagtaaagcttgctgttttttttgtcctccagtttttttttagattcttgttgtacatatgttttcttcagtataatattttgtcctgagggtttgaggtgctccttttataaaagcagtttcttttttggctgctgatggaattgctgccttttctattataggttagtcatttactgagaaatttaaagcattacaaaaataaaacgttgatatggggaggaattaggggtagggtgggtgtacttttgaaaagattcattgtagaattccttaaaacagcaaggcttctagcatcctagtggtatggtataaatgaggtggactcatgcagtttttgttgttgttgtttgagacaggtcttgctctgtcacccaggctgaagtgcaggggcacgatcacggctcactgcagccttgactttccaggctcaagcagtcctcctgcctcagcctcctgagcctcctgactatctgggactacaggtgcgcaccaccacacctggttaattttttttttttttttttttttttgagacagagtctcgctctgtcgcccaggcggagtgcaatggcacaatctcggcttactgcaacctccacctcccgggttcaagcgattctcctgcctcagccttccaagtagctgggattacagggatgtgccaccatgcccagctaattttgtatttttagtagagtcgaggtttctccatgttggtcaggctggtcttgaactccccaccccaggtgatctgcctgccttggcctcccaaagtgctgggattacaggtgtgagccactgcgcctggcccacctggctaatttaaaaaattatttgtagagagagagttttactatgtttcccaggctggtcttgaactcctgaactcaagtgaccctcctgcctcagcctcccaaagtgttggggttacaggtgtgagccactgtacctagctgtacagtttttgaactgctttttagtaaggttttcatctttacctttgaatcctctactagagttgcccatagactaggagaggagacacacattgcagcccaatgttacgatggtttttcagaacaaaatgttctgaaatatggaagaaggactgctaactctgcctggggaaagttgaatattcattgaaaaagtggtgtttgaacttagttttgaagattagtgaaggaggcattctagtacagctgaagtataaaagatgtgtagtgtggggttgggtatgagatggtttgagctaaggcagaggtgggagggagaatggaagaggaggaaactgatgtgtaagatttaggaggaaatagctttttttgctttcactttgtcctctaattctcttcagtctgttctatgctgtcaggtctccagtctcttttccctgtagctccctgtacctctgactttggttgattggttttttcccctagtgttccatttttcttttagtcccaccttttctaatgtgttggtactaaagtacctttcattctgactctatttgtctcttgcgtttatttcacctcccaccctccctccctctctctctttattccctttgggttatatttctttccttttcttttcctttttcttcttcttctttttttttttttttaaagacaggatggtgcagtggcacagtcatggttcactgcagccttgacctggggctcaagtgatcctcccacctcagcctcacgagtagctgagactacaggtgtgtgccaccatgcccagctaattttttttgtagagacagggtttccccacattgcccaggctggtcttaaactccagggctcaagccacccacccaccttggcgtcccaaaatgtgcgattacaggcgtgaccaaccgcacctggcccctttgggtttctctttgcccctacctttcctttttatttgctttattttattttttattttttttgagatggggttttgctgtgttgcccaagctggcctcaaactcccggtgtcaaacaatcccatctcagcctcctgagtagctcaggctgcaggcgtgtgccacctctcattatcttttatttaaaagcaaaacaaaataaattcttgcgcactatctgcttattttacatgtaaatagcaaaataagctgattccctcttgggaaatcttgtaagatcaactagcttttgatacctgttcaaagactaattatccatttctgtgaatttctttttatgaaacattttcctttgtattcaaagatgctacttcttcaaaggccacagtgtagaatgtgactgcctatgtgccctgttttctatttcttatgcacctacaaattgtttgataacaaagtccaattcacctttttcctaaagcttttccaaactttcccaggtagtagtattctcggtagttgtctattattttgtaaacacctctttttaaaattcagctttattgaattataatttatgtaaaagaaaattcaaccaattttgagttttgacaaacacatgctgtcgtctaaccactgttatatctctaacatttttatcaccacagaaagttcctcatgccccttttgttcagttctcctgcactcgcccttggctccagtcactgatttgctttgtatcactattgttttgtcttctctgaaatttcatataaatcttttggtagaatgtgttgtcttttgagtctgacttcttttagttaacattgattttgagatactcatattgtgtcgtatattcattgaatctttttttttttttttttttttttttgagacagggtctcattctgttgcccaggctgagtgcagtggcgtgataatggctcattgtatccttgacctcctgggctagagtgatcctccttcctcagcctcacgagtgtctgggactacaggtgccatcatcatgcctgattaatttttgattttttgcagagatggggttttgtcatgtttcccaggctcgtctggaacttttggttgcaagcagtcctcctgccttagcctcccaaagtactgggattacaggtgtgagccacctttctcagcctgagccaccgtgctcggcctgagcctttgtcattgtatggacataccacaatttatctgtttatcagtgggtagacatttgcattgcttccagattttaggctattataaataaaatggctttaaatattcatgtacaagtcttttagatatctcttttaacattcattacattttatttggaagttgagttgcagagctgtcaagactgaacacccaacattcataaataggcattttgctagttctgtggttttgagcatctttcagcttagattcataatctgtaaaatgggactgggtggagattcaagcaagctagagagcacaggccaatttaaagaggatacctctttttagttcaagtgatcatctttctgggaatgtatacccaatgtcagatctaattttttcccccaaaagagtggtatttgagatcagacatcaaattttatatgaaatttcatgtgaaatttaaatactggtagttacaatttaaaaaacactaatgcaactgatttgcaactgaacacaactgatttgtgggcgttgatttctcactgcagtacagtttgagaccttggctttaaatcttcagttaattggccgggtgccgtggctcacacctgtaatcccagcactttgggaggctgaggcgggtggatcaagaagaggtcaggagatcgagaccatcttggctaacgcagtgaaaccccatctctactaaaaatacaaaaaataagccgggtgtggtggcgggcacctgtagtcccagctactcgggaggctgaggcaggagaatggtgtgaacccagaaggtggagcttgcagtgagccaagatcgctccactgcactccagcctgggcgacagagcgagactccacctcaaaaaaaaaaaatcttcagttaattttgtcttctgttttaaaatgtatatcctcccagtagagtgcacttgttaggtcctttttaccttagttttattagcataataacttgctggttgtcaaaattcccaagttaaaaactaacgagttactgtaaattttattcttttgtctgattggaaggatattaagaatactgactgcctgatggaggagtggaactaggttcaggttactctatgtacttctccttctctgatagctgctgattatattcagtgctatgttttctcagcagttggaataatctgcctcacttgtttgatttatctcaacacttttgagacaagtatggtataaactctgtgtgtctctttattagaaactatgcaaggtgttacagatatacatacaaattttatatgactctgtttcatatggctcagattgtccagagccatttggtgaagccagtataatgaactatgaaaaagtgataaattatatgtaattgtttgaacaataaagagcaataatctttctaaagaggccttttcccctttatctgccatttctttattgtgtatagagatgactagtttgcagctttatgaatgactttgtgagtccagagattcttttgctgattaaaccagcataattgacatacaccctcataaacctgggggcaagggtgttaagtgtcgtgtgttgcctgagtatcccatattcaccctggttctagcttggtggaatgtggaatttagacaatttaggattttgagtgggccaggcgcggtggctcacgcctgtaatcccagcactttgggaggccgaggcaggcgaattgcctgagctcaggagttcgagaccagcctgggcaacatggtgaaaccccatcagtactgaaaaaaaaaaaaaaattagctgagcgtggtggcgtgcacctgtagtcccagctactcaggaggctgaggcaggagaattgcttgaacctgggaggtggaggttgcagtgagctgagatcacgccactgcactccagcctgggcgacagagggagactccgtctcaaaaaacaaaaaaaaagaaaaggattctgagttgagtttggttttataccttaatagcagcaacatcccaggagtatcacataccaaggaatagatctgagaataaaaatagccaccatttattgagtgtctgttttgtgctagggctagatactttatatgttattttattgtgaatcacaatatccccacaaaataatggggaattcttgcatttatacataaagtaaggcagatgagagtctggaatgaaattcttttttttaaatatatttcttttttttttgagacagagtctcactcagttacccaggctggagtgcagtgccgcaatctctacctcccgggttcaagcaattcccccatctcagcctcctgaatacctgggattacatgtgcgccaccacacccagctaatttttgtattgttagtagagatggggtttcaccatgttggccaggctggtctcgaactcctggcctcaagtgatccacccagcttggcctcccaaagtgcagggattacaggcgtgagccaccatgcctggccatgaaattcaaaatattcactcacaatgcataaccttttacctagagtttgttcctcataaagcaagctttttaggaatgttagagccaaagtggcaccgagcttttctcagtgttaaaagagatgactgcaaaaccatgttcaaataacctctgtactggctattatgtagtttatgctggtggtatagcctgcttcacagtaggaaggaatttgaatatatctctagtatatttcatgctgcttttgaaaaggtgccaaatctgagaaaggaggaaggaaacaattttttttttttttgagacggaatctctcttgtagtctaggctggaatgcagtggcgtgatctcggcttactgtaatcccgagttcaagcgattctcatgcctcagcctcctgagcagctgggactacaggtgtgtgccaccacgcctaactaatttttgtcttttcagtagagatggtttcgccatgttggccaggctggtcttgaactcctgatctcaagtggtctgtctaccttggcctcccaaagtgctgggattataggcagtgaaccactgtaccttgcccctacagtaaattttgaagaagagttcaaatccttgctaacaacagcatcaaagttgttacagtgtgtgaagaatgtgtggtgtcactggaatcctgctgtgtgctccagtgcattctcacttgcaccactgcctgtttttatgccgctgccattaattgtactgttctctttttaacattttatagatttctgcagaacagcttagaaaacaaagtgattctttaaaactaaaatctttaacatcctgcataaaatattttgttttactatggtgagtttatcttcctgctttgtagtttaaaatattaaaataaaataatgacgagggagagaacaatataacatgcatcggtccagtgcctgaattcagttgatttaaattaaatttaattctacttcttcctctgtcctctcttccctagataataattacatcaggtctttaaaatggactaaaatttaaatatcactcttcttggaaattaaaaaaaattcaggagtacaatttttcatatttttactatatgatactacagtggttcaagactcaatttaacaaactaagatgctttggagcacataaacgatgctcaataaatatatattgaataattgacttttttgtaatgtcctcattgtgaagagcaccacacctttgattccttatccagaaggacatgtggtcttaggggattttcccattcattttcagccatctcttgtgtggatgactgctcggaagggcattgcatttggcactgtagtgaaatagatgtgagatatgatggtcattctcaaagatgtcacagtctggtagtggaagcaagggaataggagagaagatgaaaaatatgagctaagacatgaaggtcagtctcactactggaagttcttagtggagtaaagtgggattgtaactatcttgaggattaggggaaatggtaaaatcagtctaatattagacttaagagtagtggaagacagagttggaaagatagtgtcattgtgtatgagtatttttgtttgtttgtttgagatggagttttgcttttgttgcccaagctggagtgcagcgccatgatctcgcatcactgcaacctccgcctcctgggttcaaacgattctccttcgtcagccttctgaatagctgggattacaggtgtgagccaccacgcccagctaatttttctttttagtagagatggggtttcatcatgttggccaggctggtctcacactcctgacctcaggtgatccacccatcttggcctcccaaagtgcagggattacaggcatgagccaccgtgcccggccttgtttttgtttttttaagagactaggtctcactttgtgggccaggcttctctcaaactcctaggctcaagtgatcctcctgcctcagcctcccaaagtgctgggattacaggtatgagccacttgtgtctggcctaaggtctgagtagtttggacattatccaagaaatgtatgggagttgctgatgactttggagcacagtgttaatatgacgtgtggtaggttagaaagaataattttatcttatattaataattattttaggctgggcatggtggctcatgcctgtaattccagcactttgggaggccaaggcaggcgattgcttgagcccaggagttcgagaccagcctgggtaacatgttgaaaccctctctaaaaaaaaaatgcaataattagccaggcatggtggcatgtgcctgtattcccagctacttgggaggcagaagtgggagggctgcttgagcctggaaggtggaagttgcagtgagctgagatcactccacatcactccagtgtaggtgacagagcaagaccctgtctcaaaaaattattttaataattttcattaatttttaataattattaaatttaaaatttttcctttttttttaagagacagagtctcacactgttgcccaggctgaagtgcagtggcacaatcatagctcactacagtcttgaactcctgagctcaagccatcctcttgactcagcctcctgagtagctaggactataggcatgtgccaccatgcctaatttttttatccctttttttttttaagacagtgtcttgctctgtcgcccaggctggagtgcagtggcgcaatctgggctcactgcaagctctgcctcccgggttcatgccattctcctgcctcagcctcctgagtagctgtgactacaggcactggccaccacgcccggctaattttttttgtttattagtagagacgaggtttcaccgtgttagccaggatggtctccatctcctgacctcgtgatctgcctgccttggcctcctaaagtgctgggattacaggcgtgagtcactgtacctagctgcctggctgatttttactttttttttttttttttgtagagacagggtctcacaatgtttccaagaccagtctcaaactcctggcctcaattaatcctcctgcctcggcttcccaaagtgctaggattattggcataagaataattttaaaatggggcataagaactcaagagagggagaggaggatagagacaggaagactgtagggtaaatattagaatggtaaatataagatgatgaggaccaagtaagggttgaaaaagagggaagggcaaagtcaaacagatgcatttgtgctcagtacaaggtaagtgatctgtacatctttgttaaaaagaattggtatgattcaacaaaatgagtaggggaggagaatttaaagagtgaaggctgaaatcagccttctatccctgaaagtcagagagtgatagtattgacagaataggaatgtttggatggggagatggcatgttgtatctgcagtgatggaatgtgaacatggagatatccacatctcagatgatagagctcacgcatgcacatgtttaggttcaaaatgtagatttgcgagtcttttagaaatgatctctgaggcccaaagagtagagatagtctttgtaacaataggtttgcttggaggcatccatttactgaatgaccttggacaaatctcttacccttgctgtactttttatttattgatgtaaaaagggttggacagggactgggggatagtggttatcctgataccaagactatattacctagatgttttatcaaaatactggtccttgttacttcaccaagttgttttattaaatgacagggtttagaaatgtactttaatctgtaaacagctacacagatacatacaaactgaatattttgtccccagtggtaatcaaagttggctgggattagaaatgcattctctggttctgtctaaaattgttccatgctcttattcttgtgctctgaacaacttaattgacagataccaaggctgcagaaagcctccaataccttgcaattgatagttttcagaaataaaaagtagtccttcccattcaactcagattaatccagaaacttgctttaatagtctttttagggccgggcgcagtggcttacgcctgtaatcccagcactttgggaggccgaggcgggcggatcacgaggtcaggagatcgagaccatcctggctaatatggtgaaacaccgtctctactaaagatacaaaaaattagctgggcgtggtggtgggcgcctgtagtcccagctactcgggaagctgaggcaggagaattgcttgaacctgggaggcggaggttgtagtgagccgagattgcgccactgcgctccagcctggtgacagagcgagactccgtctaaaaaataaaaaataaaaataaataaataaataaataaataaatagttttctttttggccggttgcggtggctcatgcctgcaatcccatccctttgggaggctgaggcgggtagatcaccggagttcaggagtttgagaccaacgtgaccaacatggtgaaaacccacctctactaaaaatacaaaattagccgggtgttgtggcacatgcctgtaatcccactacttgggaggctgaggcaggagaatggcttgaaccctggaggtggaggttgcagtgagctgagatcacaccattgcactccagcctaggcaacaagagtgaaagtctgtctcaaaaaaaaaaaaaaaaggcttcttccttattggttcccaaagagctttgactaagctcccatatgttgtccctgtaacccaaagattaaagttggataggagcctttggaaaggaattgaacaaaattgtaactgagagttcttctgtcttcctctaacatggcattctaagaagagatcacttttgagatttagtatatcctctttgctttttaagattttcagtaaaaggtggttttattttgtttaattacattttttgtggcagacctaattcacctcccatattttattttttattttttaaaatttttatttatttttatttttttattttttgagacagagtctcactctgttgcccaggctggaatgcagtggcatgatctcagctcactgcaacctccacctctggggttcaagtgattctcctgtctcagctgcccaagtagctgggacggcaagtgtgcaccaccacgcctggctaatttttgtatttttagtagagggggtttcgccatgttggccaggctggtctcgaactcctgacctcacgtgatctgcctgcctcatcctcccaaagtgttgggattacaggcatgagccaccgtgcctggccacctcccatattttaaaaactctccgaatgtgaggataaaagactattacattgatcaggtatacagagtttgcaaggtggtatggcaaaaggatcacagattcttacaaggtcattataagtactgctttggctaggaaaatgatcttttttcacccaatctgagggaaaagatacactttcttccttactttcctcttttcccattgtccttccttaaagactagcagcagcagaatttggaaaataaataatgggcatgttttgctaataatcatgacaaactataataatctgttttgaattttacttgcctgtttctaaattttggagtctagagaactgctatcaaagggtaaaatatagtgattcacctgcagttttggttacaggtttcatattacataataaagggagaacttgagccccacctttcccccagtgtattccttgcataggcaacctctgctgcttaaatgttttggagactttgggatgtctgatttcaactgtaccgtgaaacaggtagtggcttgacttagtaagcatctgaaggactgttttgttctactcttgcagagtagagtagttttcaaaaggaaaggaaaggaattgttgagtgggacctatgaagtatagcaggatggatagaatatgaggcagatgggtcctagtttgctaaagagcttgggccatctgataagttgtctttcttgccaaacaagggagtcacgtggggtatacacattgtataagcttttcagtcaccgaggttgcctgtccttcctgcctccctgtttcgttgcctccttgcctcccttcctcacttcccttcctttcccacctccctgtccacaccccttccttcccctgcctctcttcgtttccctttccttcattctttcctgccctcctgcctacttccctgcctcctttcctttacctcttgtcttagtctattttctgttgctgtaaccacagattggataatggataattttaaagaaaagagatttatcgctgggcgtggtggcttatgcttcaaatcccagcattttgggaggccgaggcaggaggatcgcttgagcccatgaattcgagaccaacctgggcaacataataagaccccatctctacaaaaaaaaaaaaaaaaaaaaaagtaattaagtaaaagaaaagagatttatttggctcatgattctgaagactggaaagtccaagaacatgacactggcatctgttgagggtcatcccatagtaaaaggtgagaggatgagagcacgtgagacagaggaagttgagctgaattcattttttctatcaagagcccactcctgtgtccagtgataatgtcattgatacctacctcttaaagggtccaccttccaatactgttaggatggcatttaaatttcaaacatgttttggaggggacattcaaaccgtagcatcttccttgcctgtcttcctttctttcctttcttcctctttcaactttactgaggattaagtcttaggagaaatgatttatttaaattagaggtcatggccaggcatcagtgtctcgcacctgtaatcccaacactttaggaggacaagatgggtggatcacctgaggtcaggagtttgagaccagcctggccaacatggtgaaaaccggtctttactaaaaatacaaaaaaattagccaggcgtggtggtgctgcatgcctgtaatcccagctactcaggaggctgaggcacagcaatcgcttgaatccaggaggtggaggttgcagtgagctgagattgcaccactgcattccagcctgggggacacagtcagtctcaaaaaaaaaaaaaaaaaaagagagtgtttagaacagtttctgcctcttagaattgtggatctggaacagtttaaagacaacagagagaggaacaagacctctggtcacatgaaagaaatgagcatgaaccagcaaagattaggaaggatcaaagtagaccatagtatattaactacatagcagtataaatttattggcttttttttttttttgagacagtgtctcactctgtagcccaggctacagtgcagtggcacaatctcggctcactataacctctgcctcccaggttcaagcgattctcctgcctcagcctcctaagtaactgggattacaggcgcccgccaccatgtccagctaattttttgtatttttagtagagacggggtttcaccatattggccaggctagtctcgaactcctgaactcgactaattcgcctgccttggcttcccaaagtgctagaattacaggatgggccactgtgcctggcctgtattcaggcatttcttacctaaaaaacgtaaaaaaaattttttgtggtaaaatatacataaaatttactattttaatcatctttagctgtacaattttatggcattaagtacattgagaagtgttgtgtaaccatcaccactgtctattcctgaacacttttttttgagaccgagtttcactctgttgcccaggcttactgcagtggcatgatctcagcttactgcagcctctgcctcccaggttcaagcgattctcctgcctcagcctcccaagtagctgggactacagccgtgagccaccatgcctggctaatttttgtatttttagtagagacagggtttcaccatgttggccaggctggtcttgaattcctgacctcaagtgacccacctgcctcagcctctcaaaagtgctgggattacaggtgtgagctaccacccccagcctccagaacacttttatcatcccaaacagaaactatgtacacttattaaataaaaactatcccagcccttagtaacctccattttactctctttctctgttctaagcacctcataaagcctaatcatataatatttgtccttttgtgtctattttacttaccataatgtttttaaggttcattcttgttgtagtgtgtatcaggatttcattcattttcatggctgaataatattctgttgtatttgccatattttgttgatccattcatctgtttgtggacacttgagttgtgtttaccttttggcttttgtgcataatgctgccatgaacataagtgtagacatatctgtttgaggccctgcttttaactcttttaggtatatacctaggagtggaattgctagatcatatggtaattggatttcgctttttgaagaaataccaaaccgtttcccacaccagctgcaatcctaccagcaaatgcacaagggctctgatttctctatatccttgccaatatttgttattttccactttttggataatactcatcttaattggtgtgtcaaaaatgttttaacatttactgtgatgaatgttagatgattcggaagagctacttactgttgtgaggaaccagtttccttaagttactaaaagggggcttaagccagttccatataaaacaagagctgcagggattctggccatcatatacaacatctccttattcataaaatactctcatttacaaaaaggtttatgtatttattattattaatgtataataaatatatatttattattcgtaaaatactctcatttacaaagaggtttatatatttcttgatgtgaagtttttctttttctttttttttttttgagacggggtcttgctctgtggcccaggctggagagcagtggtgcgatctcggctcactgcaaactctgcctcccgggttcacaccattctcctgcctcagcctcccaaagtgctggtgagtatttttagtagagatggagttttgccatgttggccaggctggtcttgaactcctgacctcaagtgatccacctgccttagcctcccaaagtgctggggttacaggtgtgagccactgcgcccagccgaccctattgctagtaaggttaatttttcagattttaaagggtatcaaacttttctcccaaatccaggttttatgccaagattatactgatccactttattgaacacatgacttgaattagatgcctttagggaggcctaagtcataggtctagaaaaagtgactgaccttctttctcataggaatcaggggagagaattagggcaatgattatgactacataccagttgtaggacgacggcatgaggtcacataaggagagactgcacaagaacaggcctttggcaggaacagggagcaatctagttatactgtagcactgaattgaaaagcatagttaactgtttctaggtgggcacttgacattgtttcctaggttagaccagtgagctgggaacgacagcccactggaggggagagtgcagcaaagatccagaaaatgtgaattatagtcagtttattaatctaattaagtagaacaatgattgagtccctgggtgtggtgttgcttgcctgtaatctcagctacttgggaggctgaggcaggagaatcactggaacccaggaggttgaggttgcagtgagccaagattgggccactgcattccagcctgggtgacagagtgagactctgtcttttttaaaaaaaaaaaaaaaaaaggaaattaatacaatgtaccactgtaaccctctagcccagacaatgtgctgacttcagaaggcaaattcagtgtaaattgactgtttaccaatataagaagtgacactgcttctggactgaattagatcaaggataggacagtggttctcaaactttagagaggaccacaatcacctggagggcgtattaaaaaacattgctggtacccactcctagaggttctgttttgattcttcattttaaacaaatttttaggttgttgctgatgtagtactgctgatccttggatcatactttgagacccactgatcttggacaggaaaatgaagcgagtataactgtttagttcctcctggttaaagtcttcatggagaagggaaaaaacactaacatttaagtctgtaccctgtcaaaatcctgtgccagatgatttgtagtcattgttttacttaacccttgaaaccactctgcaaagcagtcctcaggcccgttttccctcaaacatacacctgttaaaaacttgctggaatgattctttcttcaatgagagcttatacttataactgaaagaataatgttggcatataccattacaaatgtgattttatttaatgtagaggatatgttaagttccattgctgactattatgtattcattactcttctgttgacttatgagagagataaaatgtagattaatttagcagtaatgattatacaatagatggaattaaattttgagatatgttttctcataaagaacataaaatgaatgagagcttgactttaaaaatcaatatattacatctttcagatcacagaaaaaataagcctatgttaattttgtgttttttttttttaatgttgccaattggttattgaccagctctattttagaaaaatataagaggaggaatggtaaatttcagaatagtaagtattaagatatgaccaaatccttgataactcaaccataagacttactcatttaaagtacagtattctctgctaatattatttttcaaaagtcaactttttttttgaaacatcaacttgtttttcctggaattcagtgaagttactttgtgttgtttgacagacagcatcgcacagaattattttaaaaaaaagcagtgatccaagcaattgaattggaagcactctggggaaacctgctgtttattgtggaaatcatcttcgatcttggaattgaaagtaaagctggaaaggaatttacaaacaagaaaaaaaagaagtttggaatcggattcacaggatctgggcttggaaatgcctcaggtaaatcatacagagtaggtgcaaagttttttattttcccactacagaaagtcaatacctttgactcttaaatgaatcttaacacaactttgcatactacctttttgtgatatctcatttctgatctcagctagttttgagtacatgttcttccttccattggcttctatttcttactttgctatcacttgaagtttaatgagttctacataggtagtatgataaataggtagaaggtggacagatctgctggctttatggggcaaaaccaactcccttgaaaattagtctgccacagcaatcccgtttctatctcctcactattcctatttcccaattcttacctttcatttatgctagctgaatttagaagtaattaagaggaaatagtgagagacttcaggctgcctcccccaacccctctcatctctctctttctcatagacacacacacatacctatgtgtgcacatgtaaatatctccccacaaaatatatctaagaatgattgtatctgtttatattatggcagctactctgaattgatcagttttggttttaggcaatcagtgagacaatcagtgaagccctgttagtccccattctgcttatctaaactcctccttttcttctccagtgtttagctcttgcccctcccctgtttgtttcagtgctggggagaaacctagaagtaatgagtgggcagggactcttgggtggctttttgtgttgccatactgagctatcccttgagcacagggaatcaacaatttgctgggattgtctggtgactcggagacaggcagaagaggtaaagaaaggggacttggtaatagatattgaaaagaccagcggccggctaggcacagtggctcacgcctgtaatcccagcactttgggaggccgagacaggcggatcacaggtcaggagatcaagaccagcctggcgaacattgtgaaaccctgtctttactaaaaatacaaaaactagctgagtgtggtggcacacacctgtaatcccagccacttgggaggctgagacaggagaattgcttgaacctgggagtgcaaagatcatgccattgcactccagcctggggacagagcaagctctgtctcaaaaaacaaacaaaaaagaacagctgcctaccgccaccccaacctctgtgacagatggactgcatatacccttttagagtggttgcccattcaaggtttagttttttttttttttttttttttttttttgagctggagtctcactctgttgcccaggctggagtgcagtggtgcaatcttggctcactgcaagctccacctcccgggttcacgccattctcctgcctcagcctcccaagtagctgggactacaggcgcctgccaccacgcctggctaattttttgtatttttagtggagacggggtttcaccgtgtcagccaggatggtcccgatctcctgacctcgtgatccacccgccttggcctcccaaagtgctgggattacaggcgtgagccaccgtgcctggccgaggtttagttttatatttattgagtacttgaatttggggcttaaattttaaacttattttctcaagctaactttttctaggaagaaaggttctgcaggctggaaaagtagggggaagataagagaaagaaaaaaaaataagatgggatgtaccaatgaagaaaaatacgatgagagggtctatgaaaagtccggtttgtgaaagatagaaagtatatgaaaagaataagcaaatagattaataccatttaaaaacatttctgcagaaacttgcaaaaaaaaaaaagaaaatactaaaaaagagaaatttttggccagttggcagtggctcatatctgtaatcccagaactttgggaggccaaggtgggcggatcacttgaggtcaggagtttgaaaccagcctgaccaacatggtgaaaccctgtctctactaaaaatacaaaaattaggccaggcgtggtggtgcgtacctgtagtcccagctactcagaaggctgaggcgggagaatcgcatgaaccctgcggggggaggttgcagtgagccaagatcacgccactgcactccagcctgagcgacggagcgagactctgtctcaaaaaaaaaaaaaaaaaaaaaaaaaaaaaaaaaaaaaaccgggtgcagtggcttgcacctgtaatcccagcactttgggaggctgagacaggctgatcacttgaggtcaggagttagaccagcctggccaacatatagtgaaaccccatctctactaaaaaatataaaaattagctggacgtggtggtgcctgcctgtagtcccagctacttgggaagctgaggcaggagaatcgcttgaacactggaggtggaggttgcagtgagctgagatcatgccaacagagcgagactctgtctctccaaaaaaaaataaataaataaaagaaattttttattctttctcattctctttcttcatctcagttagatttcaaattgaggcctttctattatttgacccactttaggagggtgagcccagacttgactctggcgggatttgtatagatgttaaaatgtaaaaagaagatagagaaaaaacaagaaggagaattaatgctgggtcccaagtcttttttttcccctttacttattatggaatggactgtgcccttttcaggaatcaggattaaggctacagagttcatgcccaagttactggtcttaccaaggagatttttgggtatttagttgattctgtttccattaccttcctgcaggcattggttgtactagacagtgatgcccaaattgtcttccagcttgctttggaaaataagacatgggactcagcagcacagagtgagagtgatttgctgtatctgcagaccctaggaaaagacagggaattctctactgatagttaaaatagtgttgttagacaaggatttgaagaaatgttatacagctaagtgaaagtactcgataggtgctgtatggtgactggtggctaaataagctttactttctagaagatattaattgctgctctatattttttcaattttttttgacagggaaaacatttttttaaattacaaactcaatttatttggtgtatttcaaaggtgcaatacttttcttcatgtatcagtgaaagaagttagaaattaacttcccaaaaaatcagcaaatggcagacagatgtctgtgaaagtcacagtcacatacagtgtggcctagaaaacagaggggcaagacaggcttcacccactttcatgagtttcatcaaatactggatctactcaagggtggaaagaaaaggcaactttcaaaaaggagtatgttattaaatgaggcatttactatactccttcctgagagcaccagatggggaacatgttttctaaactagatctaggaagtggatccttcctcctccccttaagggctatctactggttaatgaattaaaaaaacaagactgaaaaacaaactgcacactcccctcaaaaaaagaggaggaaaaacaacaacaacaacaacacaccaagatgtcccagattactctccagggtggaaccagggaacagcttcaacaattccaattagtttgttacagagtcatccataagcatgccttgcttttaaacaaataataataaagttttaaaacaacaaaacaaaaactggtactaatcacttttctgacgatacacaattactcaaaattaactagtactgggagggggaaggggggaccatacctgtgggccttgtcccacacaagtgcatgtgggtaggtacgcggcatttgtcattattgcaaaaatgattttttttcttttttatttttatttatgtatttttgagacagagtctcactcagttgcccaggctggagtgcagtggcacgatctcggctcactgcaagctccacctcccgggttcatgccgttctcttgcctcagtctccggagtagctaggactgcaggtgcccgccaccacacccggctaattttgtctttgtatttttagtagagacggggtttcactgtgttagccaggatggtctcgatctcctgacctcgtgatccacctgccttggcttcccaaagtgctgggattacatgtgtgagccactgcgcctggcctattttttattttttgagatggagtttcgctcttgttgcccagactggagtgcaatggcacaatttcggcttactgcagcctccacctcctgggttcaagcgattctcctgcctcagcctcctgaatatatgggattacaggtacgtaccaccacacctgactaattttcgtatttttagtagagacagggttttgccatattggccagcctggtctcgaactcctgacctcaggtgatccgcctgccttggcttcccaaaatgctgggattacaggcttgagtcactgcccccagcctgaattttaatttttaatctttagtttgatttaaacactgcttttagtatgatgtcaacaccagctatgcagaaagggctctggagagatgttcatagcagcacacacctgcggctcttcttcgatcctggaggctccagggcagccaatattgtatcgtcaaatacattctttttttttttttctttttggagacggagtttcgctcttgttgcccaggctggagtgcaatggcgagatctcagcttactgcaaccttcgcctcccaggttcaagcgattctcctacctcagcctcctgagtagctgggattacaggtgcctgccagcacgcccggctaatttttgtgtttttagtagagacagggcttcaccatcttggccaggctggtcttgaactcctgacctcaggtgacctgcccacctgagcctcccaaagtgctgggattacaggcgtgagccaccgcacccggccatcagatacattctttaggcctttctgtgtgagtgtagaacactccacatacctgatggccttcaggtcatgggtcagctttttagcagtctctggagtgataggcttctgtttgttcttggcaagtttctcaatagtagaggggtcatctctgagatcagtttgggtcccaacaagcaagaaaggagtctttgggacagttaggcacccactttttttcacattttcaaatgaagatggagagaccactgaaaaacagactagaaatacatctgtttgtggataactcagcggtcataatctgtcataatcctttgccctgcagtatcaaaaatccaagagtgtatggttctctaccaatcataactgtgactgcatagttgtcaaaaacagtacgttattccgatggaaatttgtttgtcgtgtaggatatcaggagacatgttttgccaacagcaccatcacccacaacatatttaattgtctgcattgctgaaatagttttgtatccactttaaatatttcaaatctgatgttgacctcagcttctccactggggcattggcagcactctattttttctatttttaggtattttcctaatataagtctacagttcagtgttagccaaagctcttaaatatactatacagtagaaaaaaagtatagaaatgttttctgaaaagaataagttacttagtgggggtggggttggggctcatatgtgataaattggtctcaaagtagtctttaactttctaaaataaaaatcactctgttgtagcctagtgtaagcggaatggatccgcctttcggggatgcctttcgaagccacaccttttcggaacaaactctgatgagcacagatctcttagcaaacagttcggatccagatttcatgtatgaactggtaagcaacattttcttggttttggtcttgattgatttggggtaaaagtttgtgggagagttttttgtttataaatgcctgaaaaaaaaagatgtgcttgggccaagtttgattcttatgattatacctaggataattttatttatttatttttatttttatttttttgagacggagtctcactctgtttctcaggctatagtgcagtggtgtgatcttggctcactgcaatctccacctcccaggttcaaatgattcttctgcctcagcctcccaagtagctaggattacaggtgtgtgtcaccacatccaactaattttgttttttttttttttttgagacagagtctggctctgttgcccaggctggagtgcagtggtgcgatctcggctcactgcaacctccatctcctgggtttaagctattcttctacctcagcctcccaagtagctgggattacagccacctggcaccatgcccagctaatttttgcatttttagtagggacagggtgtcaccacgttggccaggctggtctcgaactcctgacctcaggctatccacctgcctcggcctcccaaagtcctgggattacaggcatgagtcactgcgcccagcctaatttttgtatttttagtgcagacggggtttcaccatgtcagccagacaggtcttgagctcccgacctcaggtgatctgcccgcctcggcttcccaaaatgctgggattacaggcatgagccatcgcacctggcctacatctagtaattttaaaagtatgcagctgttggctgggcatggtggctcacgcctgtaatcccagcactttgggaggccaaggcgggcggatcatgaggtcaggagattgagaccatcctggccaacatggtgaaattccgtctctgctaaaaatacaaaaattagctgggcatggtagtgcgcacctgtagtcctagctactcgggaggctgaggcaggagaattgcttgaaccagggagtcagaggttgtggtgagccaagatcgccccatagcattccagtctggcagactggagtctcaaaaagaaaaaggatgcttctgggtatggtggctcatgcctgtaatcccagcactttgagaggccgaggcgggtggatcacctgcctgaattttaatttttaatctttagtttgatttaaacattgcttttatttatttatttatctatttatttgggacggagtctcgctctgtagcccaggctggagtgcagtggcacagtctcggctcactgcaacctccgcctcccaggctcaagcgattctcctgcctcagcctcccgagtagctgggattacaggcatgcaccaccacacccggctaattttttgtatttttagtagagatggggtttcaccatattggtcaggctggtctcgaactcctgacctcgtgatccacccacctcggagtgctgggattacaggtgtgagccaccgtgcccggccttaaacattgcttttagtatgatgccgacagcagctgtgcagaaagggctctggagagatggtcatagccacacacacctgcagctcttcttccattctggaggctccagggcagccaatattgcttcatcaaatacattctttttttttttttttttttttttttttttgagacagagtttcgctcctgttgcccaggctggagtgcaatggcgcaatctaaaattagctgggtgtggtggtgggtgcctgtaatcccagctactcaggaggctgaggcaggagaattgcttgaacctgggagacggaggttgcagtgagcggagattgcaccactgcactccagcctgggcaacaagagcaagaccccgtctcaaaaaaaaaaaaaaaaaatgaatgcatcaaaaatggtaaaagattatctaaatatcttcaaatctagtttttgataaagataatgggcttttcagctggaaaacattgagcaaggcatgtgaatgacataaagaatgtggcacaaaaataacaattccaaacaggatctgcatatacttaatcatttattcttgaggtaaatagacacttaaaattcagaagaaaaacattttaaaaacagttttaattacataaaattgaaataacacaaaaatatataaaaactggaaaactgagtgctcaaatgcataaatctactaaaaattattgaattgtctacttaatataggttggttttatggtatgtgaaattatacttcagtaaagctgttaaaacatacacagacaggccgggcgcagtggtcatgcctgtaatcccagcactttgggaggctgaggcaggtggatcacaaggtcaggagttcaagaccagcctgaccaagatggtgaaacctcatctctactaaaaatacaaaaaaattagctgggcatggtggcacgtgcctgtaatctcagcaattcaggaggctgaggcagagaatttcttaaatctggaggaggaggttgcagtgagccaagatcgcgccactgcactccagtctgggtgacagagtgagactccatctcaaaaaaaaaaaaaacaaaaaaaaaaacccatacacagacaacacacacacacacacacacaccccaaaaattaaagaaaaaaaataactctggaagactcaaaacgtcctcattttctttctgtgcctccaccttccaaaccttttaccaaaacgtaactaacaggttcttttccatgcatatgtaaacatatgtatatagtttttttgtatatactttttaattggataatatagataacagttttctgtaacttgctcttttaaaaataaaaatatatggtgggcagtctttcatatttgtacattagagctatgctgcattcatttcaatggctgcagagtcttaactgatatttgaaattgacatctccagtggcacatgcctgtaatcccagcaatttgggagggcaaggtgggcagatcacttgaggtcaggagtttgagaccagcctggtcaacatggtaaagccctgtctctactttaaaaaaaaaaaaaaagaaaaaaaaatcatctctaaaattcgtgaggagtattttactctgcctgcccaagtgttgttataaggtcttgcaaaagatcttaccattctgtggttgaattccaactctctttggattgctctttgcctctatatttaagttcccactaaaaagatatcctcttctgtaatgagggtgtctttattattttcattgttaatattttaaattcttctctctcacttatcacattgtttgctttttagttgaagtgtctccccctgcccccaccctaccaccactaaggagatcccaaaatccttctaagataaggaaatgtaaacttttttcaggcagaatgtttatggtaaactcaagagcccttgatatttggatcatacctgagcctctcaagggacacactttccgtcttttttaaatttaatttttaattgatttttgtttgttttattttcattctactttttcttgcctaaggaaatgatgacattatatgaaatgataaagcgtcctgtcagtagcctttatgttaaaacagaccaaaagtcaagtattgatttatcagtttgacatatggaggtgaatatttccttctgaaatatgatgtgcaatttcttttttaaaacctttctcaggatagagagatgaactaccaacagaatcctagagacaactttctttctttggaggactgcaaagacattgaaaatctggagtctttcacagatgtcctggataatgagggtgctttaacctcaaactgggaacagtgggatacatactgtgaagacctaacgaaatataccaaactaaccagctgtgacatctggggaacaaaagaagtggattacttgggtcttgatgacttttctagtccttaccaagatgaagaggttataagtaaaactccaactttagctcaacttaatagtgaggactcacagtctgtttctgattccctttattaccccgattcacttttcagtgtcaaacaaaatcccttaccctcttcattccctggtaaaaagatcacaagcagagcagctgctcctgtgtgttcttctaagactctgcaggctgaggtccctttgtcagactgtgtccaaaaagcaagtaaacccacttcaagcacacaaatcatggtgaagaccaacatgtatcataatgaaaaggtgaactttcatgttgaatgtaaagactatgtaaaaaaggcaaaggtaaagatcaacccagtgcaacagagccggcccttgttgagccagattcacacagatgcagcaaaggagaacacctgctactgtggtgcagtggcaaagagacaagagaaaaaagggatggagcctcttcaaggtcatgccactcccgctttgccttttaaagaaacccaggaactattactaagtcccctgccccaggaaggtcctgggtcacttgcagcaggagagagcagcagtctttctgccagtacatcagtctcagattcatcccagaaaaaagaagagcacaattattctctttttgtctccgacaacttgggtgaacagccaactaaatgcagtcctgaagaagatgaggaggacgaggaggatgttgatgatgaggaccatgatgaaggattcggcagtgagcatgaactgtctgaaaatgaggaggaggaagaagaggaagaggattatgaagatgacaaggatgatgatattagtgatactttctctgaaccaggtattataatgcttgcaagcttaccagactgacctttgtattactattttgaaatagaaaggtttttgtttctgttttgtttggataatttctttattttagtttgggaattaaatgacttaaaccttggattggatatgtaattggtttttctattcaaatagctctaaaatgatcacttttgctcacatagggattcataagctgattccttgagggcttattttttattattttatttcttatttttaaaattaaaatagagatgagagcttgccactgtgcccagctgaggacttattcttaatgtatcttatgttaagtgacctgttttgtcactctcttgagcatttatgcaaagacaccaataatttattggtttaaaaaatattcctgtttagggccaggcgcagtggctcacgttagtaatcccagcactttgggaggccgaggtgggcggatcacctgaggtcaggagttaaagaccagcccggccaacacagcgaaaccctgtctctactaaaaatacaaaaatcagatgtggtggcacgcatctgtaatcccagctactccagaggttgaggcgggagaatcacttgaacccaggaggctgaggttgcggttagctgacatcgcaccattgcactccagcctgggcaacaggagtgaaagtctgtctcaataacaacaaaaaataataaataaaaatattactgtttatgcatgtgtctctctattatagttgagataagttaggagtatatagaatgttgaaccaagtgatgatggtttatattactcattccaatacccaacaaagtctatttatgaataatgtaaaagcattttctttgtgtctgctaacattttaatttacatcgtattttcctatttaagaaaaatacatgctgtaatttggtgagcatgaaggagactctgctttatttatatacagcgcatataaataaaagggacaaagaaaatgaaatctctgggggaactggttcactttagcatttacatgcttgggcttttggcgctgttggcttgtgcagtttatttataaaaatagtattgccaagtggcacatggttgaaaatgcacaaagaagtaaagatctttaaatttaaactaaagttatcttcttcaaaaatattgttggtactaactctgcatgaaaactaagttattatttaaaaaaaaactatcaaagagagcccttttgttataatgatgattgctggaatttcaggcagtataaacatagatatttaattttctgaaaggcgtttaaagcataatacctatattgtaactagtgaaacattattcttactaaaagaatttttcctttggtgaaatctttctattacacaaatgctttgatttatgcatttgacacaaacattttttgatttgggtggagtttcaggtaagtaaaaggtacttgaatatggaagaaaagggattgtgccttcttcattggtttactgtacaactctatatagtctaggtagaataatgtctttttacaatacaggaaaatttttctcttggcaagtgaataaaatctgctttgagatatttcaaggagacttgactttgtaggtaggggtaatttatataactccctgcacttggaagatcatagtgctcttcataagtggtccttaaagtcttgacagattggtcctgttgctttgagtctcgtatttaggagcagggaggggaagggtgaaacaaagagaggatgggtaattaagggaaatggcaaatgtggggaaggaaatgcctttagcagctggtgcttaaaggaatatatagatcagaaggagtcagtaaatcctaccatcaccaaggcagcaaggactatattatctacctgacttttgattgtagttttgcttttctttgactttttccccccagctttattgaggtatgtttggcaaataaaaattgtatacgtttaaagtgtacaacatgtttttacatatgtatacattgtgaaatgattactaaaatcaggctaattaacatacccatcacttcacatagtagggtggtaagaacatttaagatctactctcttaacaaatttggcctacacaatacagttgttgttgttgttttgaaacaagatatggctcaattgcctaggctggagtgcggtggcacaatcttggctcactgcaacctctgcttccctggctcaagccaccctcccaccacagccttccaagtagctaggaccacaggcgtgcaccatcatgcccagctaatttttgtatcttttgttgagatggggttttgccatgttgcccaggcatgtcttgaacttgtgaactcaagccacctgcccgcctcagccttccaaagtgctggaattacaggcgtgagccaccacacccagcccagtattgttatctgtagtcacaatgctgtatgttagatctccagagcttattcatcctgcataactgaaactttgtaccttttggccaacatcttcccatttcccccacccaccagcccctggcaacctccattctactttttactctctgatcctgagtttgactttttttctaagatttcgcatgtaaatgagatcatgctgtatttgtctttctgtgcctggcttatttaacttagcatgatgtcttccaggttcatccatgttattacaaagacaggatttcctttctttttaaggctgaataatattcctgtgtgtgtgggcatgtgcgtataactctcacattttctttatgtatatgttcattgttggcccctttgttgattccttatcttggattatgtgaatactgttgcaatgaacataggaatgcagatatctcttcaagatactggctttatttattttggctgtatccccagaagtgggattgctggatcatatgatcgttctatttttaattttttgaggaacttccatgctgttttccataatgactgtaccaatttacattcccactaatagtttacaagagttctcttttttccacatcctcaataacacttgctttcatttatctttttggtaatagccatgccgacaggtatgaggtgatatctcattgtggctttcgtttgtatttctctgatgattagtggtattgagcatgttttcatatacttgttggccatttggatgtctttttaaaaatgtttattcaggtcctttgcccattttttaattggattgttttcttgctattacattgtttgggttccttgtatattttggatattaactccttatcagatgtatggtttgcagatatttttctttcatttcataggtagtcccttcactctgttaattgtttattttgctctgtgggagctttttggtttgatgcaatctcatttgttttatttttgcttttgttgctagtgcttttagaattatacatttaaaaaatcattgcccagaccaatgtcaagaatcctttttcatgttttctcctagtatttttattatttagttcttatgtttaagtctttaatccatttcgagttgatttttcaatatggtatgagataagggtctccagtgtcattattttgcctttgaatatccagttttcccataaccatttattgaagagactatcctttacttattgttgtttctggcacctttgccaagaattaattaattggacataatgtgggaatttatttctgggctctctgtttcattggtatatatgtctgtttttatgccagtaccatattgttataattactatagctttttttttttttttttttttttgagatggagtctcgttctgttgctcaggctggagtgcagtggcccgatcttggctcactgcaagctccgcctcccaggttcacgccattctcctccctcagcctcccaagtagctgggactacaggcgcccgccaccacgcccagctaatttttttgtatttttagtagagacggggtttcactgtcttagccaggatggtctcgatctcctgacctcgtgatctgccagcctcggcctcccaaagtgctgggattacaggcatgagccaccgtgcctggcctataattactaaagctttgtaatatattttgaaatcagataatatgatgcctccagttttgtttttcttacccaagatagctttggctattcagaatcttttgtgatttcatatgagttttagggtctttttccctttgtttaaggattgcattgaatttgtagttcattttgggtgatatggatattttggccgtattaattcttccaatccataaacataggatatctttctatttatttgtgtcttcagtttctttcaccaatgttgtatagttttcaatgtatagatctttcactttcttggttaaatttttttctaagttttttttttttagtgtgatactgttgtaaatgggatttttttctaatttcttttttggatagttgttagcatatagaaacacaagtgatttttgaataatgattttgtatcctgcagctttactgaattagtttattagttctaacagttctatggtgaagtcttttctttttttgagacagagtcttgctctgttgcccaggctggagtgcagtggcgccatctgggctcactgcaaactccgcctcccgggttatgccattctcctgcctcagcctcctgagtagctgggactacaggtgcctgccaccaaacccggctaatttttttgtatttttagtagaggcggggtttcactgtgttagccaggatggtctcgatctcctaaccttgtgatccgcccgccttggcctctcaaagtgctgggattacaggcgtgagccactgcgcccagcctatggtgaagtctttagggttttctagatacaagatcatgtcatctactaacagagacaatttcttttcctatttggatgcctttccttctttgttttctttcttcccctgcctcccttccctcccttccttttctctttccttttcccttcccttcccttcccttccctcccctcccctctcctcccctctcctccctcccctcccctttctgtgtccagtccctcccctgccctcctctcccctcttgccccttccccctcccctccccttccctttcctttccttttgcataatttctctagataggacttccagtattatcaatacatggaatagtagttgagagaatgggcatccttatcttgttcctggtcttagaggaaaagctttcaggttttcatcactgagtatggtgttagctatgggtttgtcgtgtatggcctttattatgttgaggtacgttccttttatatgtaatttgttaaattttattttatcatgaaagcatgttgattttttaaagcaaattctttcagatcttgaagcatgttgaatgttgtcacatgttctttccatatctattgagacgattatattgtttttatccttcagtctgttaatgtggcatatcattgattgatttgcatatattgaatcatccttgcatctcaaagataaatcccacttcatcatgatgtatgatccttttagtgtgctgttgaacatggcttgctagtattttgttgaggatttttgcatccatgtccatcaggggtactggcctgtgattttcttacctcgtgtgttcttgtttggttttggtatcatggtaatactggcctcataaaatgagtttggaaatgttctctcctctacatttctttagaagtattagagaaggattggtattaattcttccttcaatatttggtagaatttactagtgaagtcagcaggcccttggctttagttcattgagagtttttgtttgtttgagacagtcttgctctgtcacccaggctggagtgcagtggcatgaactcggctcactgcaattttcgcctccagggttaagtgattctcctgcctcagcctcctgagcagttgggactacaggcactcaccaccatgcctggctaatttttgtatttttagtagagatgaagtttcgtcatgttggccaggctagtctggaactcctgacctcagttgatctgcccgcctcggcctcccaaagtgctgggattacagatgtgagccctcgtgcctggccgacagtttctgattactgattcagtgttctttcttgttattggtttgttgaacttttctatttttttcatgattcagtcttggtatgtttctaggaagttatccatttcttctaggttattcaatttgttagtgtataattgtttatagtagtccttaatgattctttgcatttctgtggtattaaatctgatttctcctctttcatttataattttattgatttgagtcttttttcttaatttagctaaaagattgtgaattttgttttcatttcaacaaaaaactcttcattgatcttttctattgttttttagtgtctaattcatttatttctgctctgatctttgttattttcttccttctgctaactttgggttagttcttctttttctacttccttgaggtgtaaagtttggttgtttatttgagatcttttttttttctttgtcgtagttgtttattaccataagattccctcttggatttgcttttgctttatcccgtaagttttgatatgttgtgtttccatttttgtttgtctcaacatatttttctattcctcttttgatttctttgacccattggttgttcaggagtttgttgtttaatttctacctatttgtcaattttccaattttccttcttttttttttttttttgacatggagtctcgctctgtcacccaggctggagcgcagtggcgcaatctctgctcactgcaagctccgcctcccgggttcagccattctcctgcctcagcctcctgagtagctggtactacaggcgcccgccactacgcctggctaattttttgtattttttagtagagatggggtttcattgtgttagccaggatggtctcaatttccttctgatttccttctgatttctagttatacagttgccaaaatatcatacttggtattatttcagtcttcttaaatttgttaagtaagacttgttttgtggcctaacatatgatctaaactagagaatgttctgtctgtgcttgaaaagagtatatattctgctgctgtcagaatgttctatatatgtctgttaggtccatttggtctgaagtgttattcaaatccattgtttttttaattgatattctgatgatctatccattgttgaaaatggagtgttgaagtcccctatattaccgtctgttttttcctttagttctattaatatttggttcatttacttaggtgctttgatattgggagtacatacatttactatgtatacaacctcttgataaatcaacaaaccctttattattatataaagaccttctttgtcttgtgatagttgttatttttttacttttttttttttttttgagacagaatcttactctgttacccaggctgctggtgtgcaccagtactatcacagctcactgcagtgtcaactacttgggctccagcagtaccactgcttcagcctcctgagtagctgggactataggtgtgtgccacctcttgtgacagtttttgatttaacatctattttgtctgatgtaagtatagccagctctgtcctttttggttgccatttccatggaatatctcttttcatttcttcacttatggcttacatgcatcctttttatttttttgagacaggttcttattctgttgcccaggctggagtgcagtggtgcaatcactgctcactacagccttgacctgccagactcaagcaatcttcccacctcagtctcctgagtagttaggactacaggcatgcacccccatacccagctaattttggtattgtttgtagagatgaggtctccctatgttgcctaggctggtcttgaacttctgggctcaagtgacctgcctgccttggcctctcaaagtgctgggattacaggtgtgagccactatgcctggctatatgcatccttaaagctaaagtgattttcttgtgggcaacatagagttggttcttggttttctattcattcagccactctatatcattttactgggtattgataggtaaggatttactgttaaccattttgttaatgttttctgactgttttatagtccttttgttacttcctctcttgctctcttcctctgtgatttgctggttttttgtagtggtatgctttgattcctttttctttatcttttgtgttatctatactacagatttttctttgtgattatcatggggcttacataaaacacaagtcttttttaagctggtaatagttttaacttcggctatatgtaaaatctctacactttacactttttattgatactacagttaacatcttttcatattgtgtatcccttaagaaattattttatatatagcttttttttttttttttgagacagagtcttgctctgtcatccaggctggagtgcagtggcacagtcttggctcactgcaaccttggctcactgcaacctcctcctcccaggtttgaatgattctcctgccttagcctcccaagtagctgggattacaggcacctgccaccacacctggctaatcttttgtgtgtgtgtgtgtgtgtgtgtgtgtgtgtgtgtgtgtgtatatatatataattttttttttttttttttttttttagtagagacagggtttcatcatgttggccaggctggtctcaaactcttgacctcaagtgatccgcccacctcggccctccaaagtgctgggattagtagtgtgagtcaccatgcacagccaaaattattttatatatagttatttttaatgcctttttaacttttatactagcattaaaagtgttttgcataccactgttacagtattagagcattctgaatatgactgttcttatttttacacagtgaattttatactttcatgtttttcttttcttttttttttggagatggagtctcactctctcgcccaggctggagtgcagtggcgtgatctcagctcactgcaactccacctcccgggttcaagcgattctcctgcctcagcctcctgagtagctgagattacaggtgaccaccaccacgccctgctaatttttgtatttttagtaaagacagtgtttcaccatgttggcccggctagtctcaaactcctgacctcaggtgatccacctacctcagcctcgaaaagtgctgggattacaggcgtgagccacaccgctcccccccaacccatatgttttcatgctgttagttagcatcctttcatttcaacttgaagaactcccattaacatttcttgtgaagcagtcctactggtgatgaactccctcagcttttgttttctgggagtcttttttgttttcccttaagagagagggtctcactgtgttactcaggctggtcttgaactcctgagcttaagcaatcttcccagttcagtcctcttgagtagctggaactactgatgtgcatcatcatgcccaacttaggaaagcttttatttatttttttcatttgtgaaggacagctggcttgctggatatggtgttctttgtagggtattgtttttgtttttttctctgagacagggtcttaactcttgctcaggctagagtgcaatggcgtgatcctagcttactgcaccctcaatctcctgggctcaagcaatccttccacctcagcctcccaagtagctgaggtgtatgccaccacacccagctaatttttgtattttttttgtagagatggggttttaccatgttacccaggctggtcttatactcctgggctgaagcattttacctgccttggcctcccagagtgctggaattacttgcatgagccaccatgcccagcccagtggttttttttctttcagcactttgaatatgttatctcactctcttctagccttcaaggtttctgctgagaaaaccactgacagtcttatgagagtttcattgtatatgacaagttgcttttctcttgctgctttcaaaagtctgtttgtctttgactttccagaatttgattataatgtgtcttagtgaagttttttttttttttttaagacgaagtcttgccactctgtcgcccaggctggagtgcagtggcaccatcttgactcactgcaacctctgcctcctgggttcaagtgattctcctgcctcagcctcctgagtagctgggattaccgacacccaccatacctagctaatttttgtatttttagtagagacggggtttcaccatgttggtcaggctggtcttgaactcctgacctcaggtgatctgccccatcggcctcccaaagtgctgggattacaggtgtgagccaccgcgcccggcctgtcattattactttaaataagctttctgcccctttctctttctttactcttttcactattcctataatgtgcatttcattttgcttgatggtgtcctataaatcctgtaggctttctttattctttttcattcctttttctttttgttcctctaactggataatttcaaatgacctgtcttggagctcactgcttctttcttctgtttgatcaagtcttctgttgaattgccctatggaatatttcagtttagtccttgtgttcttcagctctagattgcatttggttgtctatgttctcttgttgctcactgagcttctttaagacaattattttgaattctttgttaggaagttcatagatctgcattattttggatcagttgctggtgcttaattttcttcctttgctagtgtcatttgtccctgattatttgtgatccttgtggcctttaattggtgtctatacatttaaacatgtggactcctcttccagtctttatagactggctttgccaaggaaagcccttcacttgtcaggtcatctagaggttctgggtgggcttgctgaagggctctgcaggcaagtttgctcctggagtccttgggtaggctggcctattgctggagtcagcagccaggtgggtctgaggcttgggtctgtagaggtcatcctggtgcctggtactgtggaagcaggcctggagcctggatcatttggggtcagtctgaaacctgggtccataggagctgaaccggcagtggggtgggctttgagtctgaatccacgagaacttacctggcacctgtatctgtgggagtggacttggtcctgactccacaggcaccagcgtggcatgggggtctcttggggcaggcctgtcaactaggactgtgggtgtgagcctggagtccaggactccagggatgggtgggccctgagcctaggtctgcagctgctggcttggtgctggggtagacctgtaaccaggttctgctggggctagcttgggtccatgggaaccattttggagcttggggccatacttttctttgacctttaactccactctaaattcatccttgatctcttgacttcattccttctggatgtgttgagagataaggaggtctgtgaagggagatcacatggttaattgatcgccatttttattttctcatccctttgactctcacagggaggcagaactagtcacatgtcacattttcttcccttgacccttgtaggagaagccttatttattagcatgttgctcttacataacaggacagtggctttatacattagcaggcatttggcagggtcaagttctcttcttggacctatttgacaattatcccaaatttgtggatggcatttaattcattcactttcagttgacttgaagtaaaacccttttggttaatattatttggacagttctcacaaatgttaatgagcagcatgctttcaccacaaaattgtgttaattttgtggtattatttggactttattcacatttgctagtaaaattttctccttttcctagaagagctaaacaagtgactttaaagatgcaaaagtgagttactggtgagaaacaggaagaaattctttgtagcaaaagagtaaggatagctatagtttcttcagtgctagtttagggtggattgattggtttaatttatagctgacagtttacaaaggtccttttgtgatgactagctcccttgatgctgtttcttggcacttggctacaacagttcacgagcctacaaagtttcaggaaaggtgcaaaatggagttttagtctcttttctggattggctcccaaattttaatagagccttttctgtggacaggctacaactgtttggggtcatgaaattacatgattgtaaggctaagaatgggctcacagaatgagaatttattttgtaattttcactaaacatcttcacagttgactttaccagcttattgacagtagtctgtactaaccagagatgtgtgattgaaattttaggcagtaaatgtggtatttgttactttttttggtaatcatgtcagatagcaatgagttagattagtatgatgatctatcacatgaaaagaaaagggaaaggccttaataggaaatgttgcattaaacaacatcatgaatttgttttaaaaaattttgagtgcctacttttgtggcaggcactgtgtatattaggtactggctatacagagatgaaaaaagtagacatctttatcttcatggaatttagtgttaagtgggtttatttactgttatgatttcttaatcttttaacatgtctgtgtactgtgatttggcaagagagatatgcaggatgagagattttaaaacttacctgactacagaattcacttcgggtaaaaccatatctcacggtaacagtgttcttcagaatctagtttgagaaatatttaatgaccctagattcaagaccagtgatcttggggcataatttttttcattctgtttgatcattgatagtctctgtattgaaaggtggatggtggctgagcatggtaattcatgcccgtaatctcagcactttgggaggctgaaatgggaagattgcttgagcccaagttcgagaccaccctgggcaacatagggagactcctgtctctacaaaaaatacaaaaattagcccagtgtagtggtatgtgcctgtagccctagctactcaggaggctgaggtgggaggattgcttgagccggggaggtcgaggctgcagtgagttgtgatcatgctgctgcattccagcctgggtgacagagcaagtcacagtcccaagaaaggtggatggctttaggcaacaaattcagagagagagagagagagagagagagagagtgtgtgtgtgtgtgtatttttgtgatggtgaatttatggtgtatgctattagaaaatgttattgtattaagtcaaagaaaactgatggcttttaaatacttctgggaaaaaggctggatgcctataggtaataaaactgtaatttgggtgggacagaagaaataaaaaaatcttcatgattctttaaacttaacatgaaatatatgcaggaaaaaatctattcagatcatttaattaggcacaagaaaagtgggaagcccctgagacaccttgagttgtggggcctgacttagtcccagctgtgccaaatcatgtcaagtctccatgagcattttagttcgtataaatggagctaacaacctccttcctaactagggacagtgatttgccagagatccaggccccttgcagagaggcaaaggtagttactatctaagggagtatatcaaataaagtatccaggaggatggtatgtgtgtatatatgtgtgtgtgtgtgtgtgtgtgtgtgtgtgtacacacacagctgaggaagctgtgtataaaattttttcccttatgctttgggctgggataggcttaagtgtggaacacccaattactgacattgataggaaggtgggagtgttttggttggtgcatctgcctgtgttgaggtgttcacagtcaaactagggtaatcttgtgagccagtaatttttgcttacctagtgtaacaagggccttttatttatttatttatttattgagacagaatcttgctgttgttgcccaggttggagtgcagtggtatgatctcgtctcactgcactccacctcccaggttcaagtcttctcctgcctcagcctcctgagtagctgggattacaggtgggcgccaccacacccagctgatttttgtatttttagtagagatggtttcgccatgttggacaggctggtcttgaattcctgacctcgtgatctacccacctcagcctcccaaagtgctgggattacaggcatgagccaccgtgcctggccatgagggcctttttatttatttatttttgtatttttagtagagatggggtttcatcgtgtgagccaggatagtctcaatctcctgacctcctgatccgcccgcctcggcctcccaaagtgctgggattacaggcatgagccaccgtgcctggccacaagggcctttttaaaggccatttctgttggcaacatatggcccttgcatcttttccaaaactaggttgataactagaacaaaataaatcctatcatttgaaaagaaacataagcacaaataaataggccaaagccattgctttattctaatatagtttttaaaaattagacttctagaaatgattgtgtcactcaacttgtgcatcattttttaagaagagcctaaggggccaggtgcggtggctcacacctgtaatcccagcgctttgggaggccgtggcgggtggatcatgaggtcaggagatcgaaaccatcctggctaacatggtgaaaccctgtctctactaaaaaatagaaaaaattagccaggcgtggtggtgggcgcctgtagtcccagctactcaggaagttgaggcaggagaatggtgtgaacctgggaggcggagcttgcagtgagccaagatcgtgccactgcactccagcctgggcgacggagcaagactccatctcaaaaaaaaaagaagagcctaagggtcaccatcacactgcttgctgttttgttttaaactaccacgtgtacactaataaaatgctgttaataccagcagtgctacaaaagcttgccttaactgttgctcagaaatcattctgctttccaaattgattcttttttttaaagtcatgtttattgtggtataattttcacacagtaaaattcacccctcttacagtgtacacttctatgagttttgacaaatcatgtaatcaccactaataccaaatagtttgatcacccccgaaaattccctcttctattttattttattttattttattttattttattgagatggagtcttgctcttgttgtccaggctgtggtgcaatggcacgctcttggctcactgcaacctctgcctcctgggttcaagcgattctcctgcctcagcttcctgagtagcggggattacaggcacccaccaccatgcccggctaatttttgtatttttagtagagatgaggtttcgccatgtgggccaggctggtctcgaactcctgatctcaggtgatccgcccaccttggcctcccaaagtcctgggattacaggcatgagccaccgcacccggccccttatattcttttatagtcatcccttttctccactgccaatccctggcaaccactgtccatataggttgctttttccagaatagtatataaatggaagcatgctcctgattcattctttgtctggagaaaacttagttcctcaaagcaaacatatcatcaccttcttatgttttcaggaaggaaaaattacctttttacttatggccaatgctgcccaagttttcctggttaccttaggtttggattgtgtacattcttcgcacagcccattccgtcttgttcatgtacctagcgttaatgatctggagtacatcagaggtggccattctctgagggtattttagatttataggtcattcaatactgggtctgaccaacagttctagcaactcagaattaagtattttctgaaacttcctattaggaaaatacccccttcttaaacagtgacgttaatacaaatagctttcaataaaatattaactggaataggcatataagttttttatctgatagccagtgtgagaaccgtcatcttttatacttttccaaaagaagtggtgtgacaggtaggaagaaaactaatgctgccacatagaattctgcctagtagaacaccatcatagaagtgtatacagctgggctaggcatggtggctcatgcctgtaatcccagcactttcagaggctgaggccagaggactgcttgtgaacccaggagtttgagaccagcctggcaacatagtgagacctctgtctctacaaaatttttttttttttttttttttttttggagacagagtgagcgtctcattctgttgcccaggctggagtgctgcggcacaatctcggctcactgcaacatccgcctcctgagttcaagtgattctcatgtctgtgcctcccgagtagctgggattgcaggcgtgcaccaccacgccctggctaatttttgtgttttttagtagagacgattttgccatgttggccaggttggtctcaaactcctgacctcaagtgatctacctatctcagcctcccaaagtgctgggattacaggtgtgagccaccacgcctggcctacaaaaaattttttaaaaattaaaataaaagaaaaatatttaaaaaaaaagaagtatacatagctttctgtctgagatgtttcagatacaaatattagaaggaagacatttaaaaatcatagtttatgtatctaagtaccattatctgatggtacttttgatattcctatagctgtcctgtaattgttctcttaatcctgtttgaagataataaaaatagtatcgtatactaacttataaaaactaaaaagaaacccaaggaagatgaacagtgtagttatctatgtttattaatctcggaatgttttatgagttagagatttacatattaaaagttctcttatagacctggtttattatctttgacatgccaatgatgttttcagatgcaaggaaatataccaagttacaaatagaaggggtcttttcatttgttctgattgatttattgaaatttatggagcttaaaaattgcgggacctttttttaaggctatgaaaatgattctgtagaagacctgaaggaggtgacttcaatatcttcacggaagagaggtaaaagaagatacttctgggagtatagtgaacaacttacaccatcacagcaagagaggatgctgagaccatctgagtggaaccgagatactttgccaagtaatatgtatcagaaaaatggcttacatcatggtaagaggggattgcagtcagatatttagtgtcactttaatcaagttgagctactaatccataatgtttactccgtgtacctaggcattcagcccttcctagcaaactggagatggggactgtagagctgctacatttgtgtgactactcttcgtcactcacaaatagcttttaccagtgttaagagtcctcacctaagtggagaggaaggactgtgtaaacattatttcatttctagtcccttcttaatctacctaccccattcaggaaatgactaggaggctgctggtttctgacctgtcacagttggtataaccagaagggttgaggagaaagtgaacgggctctcttgcattcttgtgtaatccccagatgtaaatggggggactggaattcaaacggtaatggggataaaagggcaaggaaagaaaagaaagggaggatggttatggagaaaaggagttgtagagaagagttgaatacctgtagcaggaatcagaagtttataatcttaggtaggtcaggccgtgtgctgcagctcatggttgtaatcctagcactttgggaggatcacttgagtccaggagttagagtctgcagtgaattgtgattatgctactgcactccatcctgggcgatagagtgagatcctgtctctaaaaaaattttaaaaatgacagtcttaggtaggtcaaattttttattgtgaactcaggaagctgtgattaagtagaatttattctgcacaaatgttatttttaaattaatccatagtttctagttcttctgctctgaataaaaaaaattaatacaaagtctttactgaaaaaagtggggaggggaactactagtaagtgtgatggtcagtaaacaggttattcactcatcgtacgaatgtgagttgcaaaggatttttgaggacaagaattccatctgatgtatgtttgtgtctcattttccttttccactagcaaccaggtgtactatattgtctctcagtaaataattaccaagcttttgccttcagataagttttctactagaaatgaaacattaagtccagtcaataatcccaagtagcatatgaatactaggaaagttgtaggagttcagaggacagagccatcccttttgcctggagtgatagaccaagaccccttgagtcttctataatgttatttatcaaagcaacaaaagaagagcttttaaacaaggttatgcttacttgttggattttcaagttcaatacaaaaatgtgtatgtctgacagttttcagacgtagcatcagaaacatcttggtttgtgtaaaatctccaagctctcttccgactatgtattataccctagtcctgattttggtgtttagttgaactcatactcatcctgagatttgagatgcttagtatgccatgcaaataatgaagaatctgtcatgctggaactagaagcctagggtagggaagaacttggaaaaagttagaactctgccatatcacccccatttcctgcagccacaagatgggaaggagaggaggccagcccttctaggatagattgttaaacatgctaagacttctgaaacatgccaagacttctgaaaagaaaaggtagtggtgggaagtggttaaaaatgtggccgtgaaaaacgtgtctcttgttaattaaagtgatctgacttaaacttcttttaaactgtttataggaaaatatgcagtaaagaagtcacggagaactgatgtagaagacctgactccaaatcctaaaaaactcctccagataggcaatgaacttcggaaactgaataaggtgattagtgacctgactccagtcagtgagcttcccttaacagcccgaccaaggtcaaggaaggaaaaaaataagctggcttccaggtaaatgctaataatgttcactcatgtgaagaaagtttaggaggtgaggttagtccctaagtgagtttttatagaaggacaacaaagaaattgtatttttcttgtataaatactacaatgagaatattataatttttcttttgaaagtagaagacggtatttttgttttatggaaaaagtttttaagaggggagagatgaatggactctggtgcattatgttgtataacaataaaaaattttttcatagctttattttttgtttgcttttttagtaagtcagagttattgagctataacttatagtaaaatgtataccttttaatgtatacttttatgagttttgacaaacatatccaatcatacaaccaccaccacaatcaagatattgaacattttcatcatcttaaaaagtttccttatgtctctttgtaaaagcaaaccccttcctgcacccatcgcccctcaaaactactgatctgttttctgtctccgtagttttgccttttccagaatgtcatgtacatggaatatactgtatgtatgtagcctttgattgaacctgtcttcctttttttttttgagacagagtctcactctgtcacacaggcagtggcctgatctcagctcactgcaacctctgcctccagggctcaagggatcttcccgcctcagccccctaagtagctgggattatagatgtgacccaccatgcccagctaatttttgtattttttgtagagatggggtttcaccatgttgcccaggcctcccaaagtgctgggattacaggcgtgagccagtgcgcccagctgaatctgtattctttcactcaacatgacacatttgagattcatccatattgttgcctggagtaataatttgttccttttggttgctgagttgtattcctttgggtggggatatactacagtttatccattcaccagttgaagggcatttgggttgcctccagtttttggcaattttgaataaaaccaccatcaatgttcacttacaaatgtttgtgtgaatatatttccatttctcttagataaatatccaagcatatatgcttataagaaactgccaaactattctccaaagtagctatatgtgctgttttactttcctgctagcaacacatgagggttccacttgcttcacatcctgtacaacttttggtattatcagtttttgtttgtttttatttttgttttttagccactttaataggtgtgtgctgatatagctttatttttaaatgtgtgctaaatttttaaaaatcaatttgcataaatgattatgttgtgttttctggtaactcagttatttgttaaatgtcagtaggcagcagttttggattgctattagaaaatgaaagatgaaaattcacttaaaaaagaaagcaggctgggcatggtgcctcatgcctataatcccagcactttaggaggccaaaaagggaggatcacttgcagctaggagttggagagtagcctgggcaacatagcgagaccccttctccgtaattaaaaataataaaattaaaattaagaaaaagaaagtgaactaactgctccttcctttcacagagcttgtcggttaaagaagaaagcccagtatgaagctaataaagtgaaattatggggcctcaacacagaatatggtaaacctaaagttttaagaagttgattaaccacctattgatttgctgaccactctctcttttctttggtttgtgatttgctttcgctgtattctgcctagtttttggctagcctcctatttgtttatctgttcagtaagccacatgctcactttccttcagtcttgtccaccttttaatataagtttctgtactgctgacttcccaatccacatctcatctttacactaacaagctgatccacattgtgaccatgataatttgtttatttttttctataaaagatgtgaaaagttttacaagtaaattaagaataggcagcaaaaacaacctgcacttctcgaaagatcacaataatttcttctattttataattgtgttactggattagccagttttgttgactgattttaatattttccctaaattgaataatgatattttaggcttcgtatgaataattcagacctgtgtttttcagatttgattgctcattggaattgtctgtgtacttggttaaaatacacatttctaggcttctctgcagatcttctgaattagattgtgtacaagtagaactcaagaatccatatttttaacacttctcagatcattctctttttgtgtgtgtgagacaggatcttactctgttgcccaggctagagtgcagtagtttgatcacagctcactgcagcctccaccttctgggctcaggtgatcctcccactgcagcctcctgggtatctgggaatacaggagtgcactaccacgcctggctgattttttgcatttttcatagaggtggagtttctactgtgttgcccaggctggtcccaattttgtgggctcaagcaatctgcccacctcaacctcccaaagtgctgggattacaggcatgagccgctgcacccagccaagattattctttttttttttttcttctttttgagacggagtctcgccctgttgcccaggatggagtgcagtggcacgatctcggctcactgcaacctctgcttcccaggttcaagcagttctcttgcctcagcctcctgaatagctgggactacaggcccacgcaccacaccttgctaatttttgtatttttagtagagacagtgtttcaccacgttggcaaggctggtttcgaactcctgacctcaggtgatccacctgcctaggcctcccaaagtgctgagattacaggcatgagtcactgcacccgggcccaagattattcttaatggaaccattctagcacttattcaggaactactggctttgatctaaaccaaagtgcttctcagcatttcacattgtagcacatgtagaaaattatcatctctgaggcatcacggaatataacaagagtaggctgctcatgggaggaggtccccatgagctgaggggataattatcttacacatctagaacccttttacagcacttcaggggtatgggaagctctggttttgatcttctgtgataagaacacctcctttctcccttattttgtttaagcctggtgttataagagtgtattcctttgcctcaaaaattgtcctcttcgatgtgtagttcttttgggcaagttgaatctgaaagtgaaacagtgtgaacaatgaccaattatttgtttctagaggttttcttaagtttagcatgtctggcacataggtgttcaataaactgtgcagattttcttaatcttttatcttgattattttgtttcctttggtgagggcagaaaaagaatttccaactgtaaagttttcaacttatgaaatgaacttaatgttttatttaatagccactcagtaaatgaattagataaaataattgttggtgtgttgaaatgcaaagctatccattttcctattgttctttcttactattgaaacattttggccttgagctctgttagtggtgccctggccgcctcctagatatctggaagtcactctgttacttctttgtggaacacttattatccattacctatcagcccaatagtttctagaatttgtgatttacaatttgaaaaatattttgagacttgagaacataggcttaccaactttatattttgccaagtgagaacaataaaaagaacatcatctactattactataatttcatataaggaaggatattttagtattaaaaatttgagaagggcataatctcataatagaaaataaatttagctttatgaaaaatgtactctgttgtctttatcatttttaatatgtcatgaactggcattgttccagggactagcttcaggggcccactatactactcatctcatcctatcccaccaaacttccttctattgattcctcctgacaaagctcactggagactgctgtgtgaatcctgtggaaacttgttgactcagaatgagaaatagaactgttagctcttcactctgactgacgtattttgtccctaaggaaagctatatggaaacattaaaaccagaaaatcccttgatgaatatggcatcagaggaggaggatctgtttatgagttgaatgtttggactcaatttctgagagccaggtgcttctattttctaaaccagaggtttgcggtagcatgagagccctttcccttttctctccctgccccgtaatgtgtttggacactgtcaaggcttgagaagaactattctgctcagttttactttagattttatagtgttttttctttttcttttctttttctttttttttttttttgagacagagtttcactcttgttgcccgggctggagtgcaatggcgcgatctcggctcaccgcaacctctgcctcctgggttcaagcgattctgttgccttaagcctcccgagtagctaggattacaggcatgcaccactactcctggctaattttgtatttttagtagagacagggtttcttcatgttggtcaggctggtgtcgaactcccgacctcaggtaatctgcctgcctcggcctcccaaagtgctgggattacaggcatgagccactgtgtctgactgtgttttctcttttaaaagtaactttatttacttttaacctgttgaatatgggagaaccccattgttttccctaagtctagcctttatgcaaatatccttgagtaagtagtcttctctttcaattattcatggagaagaaacatagattttttgtttcaagtgatataggaggttagctctacttccttgttcagtgacacattttacatatattggccctgaatgtagttttgctttgttttttttttgagacggagtctcgctctgtcgcccaagctggagtgcagtggtgcaatctcagctcactgcaagctccgcctcccagtagctgggactacaggcacccgccaccacgcccggctaattttatttttttgtatttttagtagagatggtgtttcaccgtattagccaggatggtcttgatctcctgacctcgtgatccgcccgcctcggcctcccaaagtgctgggattacaggcatgagccaccgcgcccggcccctgaatgtagttttaaattgtccctctcactttcctcttcaactgcagtttagattggccccttctcagtattgctagatgaagaataacaaatcactggtttttacaccaggcattgtggcatgcttctgtaatcccagttactcaggaggctgaggtgggaggattgtttgagactagcctggatgatagagaaataccccatctctttaaaaacagaacaaaaacctcaaatcaccaaggcagtctctgaagaggtagagattaatttcagactgtaggaatcctgtgtgctgaaataaaaaatgtgttttccttacagctttaccgaggtataattgaagtacagtacctacacattgaaagagtataattcgattggtttacatatacgcatacatatgtgaaacaatcaagataatgaatatttccattacctccaaaagattcctagtgcccctttgtaagtcattctgctctccactcctatccctggatagcctcaatctgctttctgtcactatagagtaatttacatttttctaagatcttacattgatggaatcacaatatgtttacatttttgcctggctactttcactcagcataattatttaaaaattcctccatgttgttacctgtatcaatagttagatcctttttattgctaactagtattccattgtatggatgtactacaatttgtttatctcttcaccttttgatggatacttaggttgtttcaagtttttggctataaccacggggctatgagtatttgtgtacaagtatttgggtagacatatgttttaatttctcttggttaaatacctagatgtagaatgattgattcataagataagtgtatatttacttctataagaaactgctaaactgttttcccaactgactgtgccattttgcattcttaaaaacagtgtaggagggttctagttggtccacagccttgccaacatatggcaaggcctatattcttatttttacaaatctaatgggtgtgtgatggtatctcattgtggtcttaacttttcatttctctgattaataacattgagcctctttcctgtgcttattggctgttcatatgttttcttttgtgaagtgtctgttcaaatattttgccatttaaaaaaattggtttctcttctaaaggttctttattctgggccggtcgcagtggctcatacctgtaatcttagcactttgggaggctgatatgggtcaatcacccgaggtcaggagttcgagaccagcctggccaacatagtgaaatcccatttctactaaaaatacaaaaaattagccaggcttggtggtgagcacctgtaatcctagctactcgtgaggctgagggaggagaatcacttaaacccgggaggtatgggtgcagtgagctgagattgtgccattgcactccagcctgggcaacaagagtgaaactctgtctcaaaaaaaaaaaaaaataagtaagtaaataaataaacgttctttattctggatataagttctttggcttggctttttgctttcctcattggcatcttttcctttccttttcctttttcctttcctttttgccttcccttccctcccctcccctctcctcttcccttcccctcccctcttcctccctccctccctccctccctccttccttccttccttccttccatccctccctccctccctcactccctccctccctccttctctcctctctctctctctctctctttctttttctctctctctctctctcctcctcttccctccctctccttccatctttctatctttcttgtctttcctcgctctgttgtccaggctggagtccagtggtgcgatctcagctcactgcaacctctgcctcccaggttcaagcgattctcgtgcctcagcctcccaagtagctgggattacaggtgtgcaccaccacacctgactgattttttttttttttgagacgaagtctcactctgttgcccaggctggagtgcagtggcgcaatcttggctcactgcaagctccatctcctgggttcacgccattatcctgcctcagcctcccaagtagctgggactacaggagtctgccaccacgcccagctaatttttttgtatttttagtagagacagggtttcaccatgttagccaggatggtctcgatctcctgaccttatgatccgcctgcctcggcctcccaaagtgctgggattacaggcgtgagccacggtgcctggcctgatttttgtaattttagtagagacagggttatgccatgttggccaggctggtttcgaactcctggcctcaagtgatccacccgcctcggcctcccaaagtgctggatgggattacaggcatgagccaccatgcctggccctcactggcatctttcaaagatcaaacatttttaattttgatgaatcaatttgtcagtttttttaatatttcatgatgttttgtgttgtaagaaacctttgccaactccagcatttacaaatcttttcttgtattttttttttcttagcatttacgtagttttaggttttgcatttaggcttatgatcttttttaggtcaatttttgcatatggtataaggtaaaagatgatgttcatattttcccatataaatatctggttgatcaggcaccatacattgaaaagactttcccttccccattgaattgtttttgcacctttgttcagtcaatagaccacatatttatgggtttacttctagatattgtattctgtttcattgatacatttatcttcctttatgtggatacaaaacttttttttttttttttaaatagagacagggctgggcatggtggctcatgcctgtaatcctagcactttgggaggtcaattgggagtattgcttgaggccaagagttcaagaccaacctggccaacatagtgagacccttgtctctatttaaaattatttttaaaaaagaaaaaaagattaaaaaaaaacatagatggggtctcgctgtcttgcctcgaactcctgggctcaagcgatcatcccatcttggcctcccaaagagctgggattacaggcatgagccattgcacccagtcatgtagatagaaaattgtcttgatcactgtacagaactgtcttgattactgtaaatctttaagtcaggtagggctagttcttgttagacctccaattttgctctttttgtttaaatctgttttggctattacaggtcttttgcatgtctatatagattttcaaattactttatcatcttttacagaaaagcttactggaattttaattgggattgctttgaatctttagatctatttagagagaattactatcttaaaatggagttttccgatccatggacctggtatctctctctacctagctaagtcttctttagtttctctctgtcatcttttacagtgttcagtgtagagtgcttgaacatcttttattagatgtagtcctgagtattttatgttttttagtgcttctgtaaatggaattgcttttgaaattttatatttgagttctttggtattaatatataaaacatatttttgtgtattactcttagttccagtagtaggtatgtagattccctgggattttctgctgacacagtcatcatctgcaaataggaatggttttatttattcctttctgatctttatggcttttgtttttctgccttatcaaaatgtctagaacagccacaatattaaatagagtggtgattgccttgtttacaatctcaggggaaaccttttatctttaggtatgatgtttgtgttgtacttttttgtagatgagatgccctttatcattttgagaaaatttcctgctatttctagttttgtttattatgaatgggtgttgatgatttttttgcatctattggaacaatcatgtattgttctcttttattctgttaatacatcacatattcatctgttaaagtggcaaattacatttgttaatatttggatgttaagccaaccttgcattcttggaataaacgctacttggttatgatatatcttcctttttatattggaatctattgctaatatttcatattattctattctaatattatatgttggattccattgttaatgctttgttaaggattttgtgtctacattcaagaggaatattggtctatgatttttattttcttttttttaaaaggttttagtaccagggctatactggccttatagaattaattggaccatgatctctctttcttttttgtttgacaaagttttataagatcaattttatttcttcattgtatctatgatagaatttgctattaaaaccttctgggttctttttttggggaagatacttggtaatttcaattcttttactagaaaaagctattcagatgctttatttcttcttgtatggattttctttttctttctttctttcttttttttttttgagacagtatctcactctgttgctcaggctggagtgcagtggcacgatctcagctcactgcaacctctgcctcccgggttcaagcaattctcatgcctcagtctcctgagtagctgggattacaggcatacaccaccatgcctggctaattatttttatttttagtatagatggggtttcactgtgttggccaggctggtctggaacacctggcctcaagtgatccacccatctcggcctcccaaagtgctgggattacagatgtgagccaccgtgcctgagcctctttttttttttttttttttttttttttttgagatggagtcttgcttgttgcccaggctggagtgcagtggtgcaatcacagctcactgtaacctccgcctcccagcttcaagcgattttcttgcctcagcctcctgagtagctgggattacaggcacctgccaccaagcccagctaatttttatattttattagacatggggtttcgtcatgttggctaggctggtcttgaacttctgatctggggtgattcacccgcctcagcctcccaaagtactgggattacaggcacgagccaccgcgtccggccttcctggcttcttatgtggattttaaattgtgttttcaagaaatttgttcatttcacccaagttgttaaatttgttagcaccatattttcttattatccttttaatatctgtagattctaaagtgataacaacacctttttcgttactgatatgagtgattggtgttgtctcttatttttcatgatggatctacctgggtagggggttgtcagtgttattgatcatttcaaggaaccagcttttggctttgttaattttccttattgtatattttctgttacatacatttctgctctttattatttccctcctttacttactttgagttaacttgcttttttttttttgagttggagtcttgctctgttgtccaggctggagtgcagtggcgcagtctcggctcactgcaagctccgcctcctgagttcatgctattctcctgcctcagcctcctgagtagctgggactacaggcacctgccaccacgcccaactaattttttgtatttttagtagagacagggtttcaccgtgttagccaggttggtctctatctcctgaccccgtgatccgcccgccttggcctcccaaagtgctgggattacaggtgtgagccaccacgcctggccttaacttgctttttgttctgttttgttttaaagcttttcaaggtggggaaatctgtttttaaagcttttgtttttgagggacttggtttgatttatttaataaacatttactaaggtcctgtgattcgatatagcaggcactatcaggtcttaaagcaatgaagacaagtagggcaagttgcttacaggttagtggacatcgatgcatgtctacagtgtgttgtcttttttccttgccattttttttagttggagatggggtctcactgtggtacctaggctggagcacagcggctattcacagtcaccatcctagtgcaactgcctgcaactcctgggctaaagccattcccctgcctcagcctcccaagtagctgggactgcaggtgcacaccaccacacctggctacagtgtgttatcaaaagtgcatacccagtaatcttgagggttttgttgttgttgttgttgtttgctgctgttgttgttgttgttttttgagagggagtcttgctctgttagcccaggctggagtgcagtggcaagatcttggttcactgcaacctccacctcctgggttcaggtaattctcctgcctcagcctctggaatagctgtgactataggcacatgccaccacacctggctaattttcgtggttttattagacacagggtttcaccgtttggccaggctggtctcgaactcctgacctcatgcagtccacctgccttggtctcccaaagtgttgggattataggcgtgagccactgcacctggctaatcttgagatatttttaaaaaacaagtgccacatcatttgaaatcagtttctttgtataggagctgcttataatcattactgcttaatgctttcttacacattctccatttctttttttttttgagcatagaattttttttatttgttggtgtcatctattatttcttttattattattattattattattattattattattattattattatactttaagttttagggtacatgtgcacaatgtgccagttagttacatatgtatacatgtgccatgctggtgtgctgcacccattaactcgtcatttagcattaggtatatctcctaatgctatccctcccccctccccccaccccacaacagtccccagagtgtgatgttccccttcctgtgtccatgtgttctcattgttcaattcccatctatgagtgagaacatgcggtgtttggttttttgtccttgcgatagtttactgagaatgatgatttccaatttcatccatgtccctacaaaggacatgaactcatcattttttatggctgcatagtattccatggtgtatatgtgccacattttcttaatccagtccatttcttaattatctgttattacataattaaaaggaaagtctttcatggtagtgacatattccaagtgttttgttctgtcttacagataatttattgtttgtaatcaactccatcaagcaagagattgtaaaccgggtacagaatccaagagatgagagaggacccaacatggggcagaagcttgaaatcctcattaaagatactctcggtaagaagaatgcgagataaattcataacaattaataatatgtgtaagatgtatgatttaaggggatattaaaagttcttttagtttaaggaaaaactcaagtgctctcattgtaattactctcctttatgagtagttttatcttttgagatttagtgttcataaacatgtgttgcaggtgaccacaacttgtaatttagacttaatcatgaaactattttaacatttaagaaaaacaaacttctagcaactttaacctttcatggaggacaaaaggtcccagagctgtcaagcctgcagtttgcactttagtgtagagattcttacttgttttactcagtaatgcatttcacaggattcccacaaacttggctctctggtttcccatccctgaacagattgcacaatgtggggaggatcagagggcagggatctagacgtcaggccaactgagagctgacagggaagagagagctagctagtatagacatagacatgagaatcagctcagctgctgtaggagaaagtcactgacagacagtagcatccaaggcatccagcgttatatgacccacgaaaacccccaaaattaaatatacacaataaaaggtcaaatgtttttcttgaacaaaagtatatttatattgaaaacaatcaggtgaagagtagaccctaatcgccagtattttcctcagcaatcacttacctcctgcttccatatggattaattctgtgcttgactttttcttcaaatgggttgatgctattttaattttttatgtattctttcatagcatttctttcttttctttccttttatttttaaaagcatttttattcttcctttattagctacagggggaaatttaacattacaagaaaaagttatttttacctttttattttttaatataaacatctatatgtttggtaagcttatgtactcctttacacttgaaagtcagttttaccaggtataaaatcctcaactcgtattttctttccttgagtatcttgaatatgagtctccattttcttttggcataaagtgttgctatagaaaagctaatactggctgggcttggtggctcatgcctgtaatcccaacactttgggaggccaaggcgggcagatcacttgaggtcaggagttcgagaccagcctggccaacatggtaaaaccctgtctctactaaacatacaaaaattagctgggcgtggtggcaggtgcctgtaatcccaggtacttgggaggctgaggcaggagaatcgcttgaatgcaggaggggtggaggttacagtgagccaagattagaccactgcactctagcctgggtgacagagcaaaactctgtctcaaaaaaaaaaaaaaaaaaagaaaaaagaaaagccaatattgactaattattttttccttataagtactttgctgtttttgcttaggtgccaaaaggattttttctttaaataccagtgattttgctaagttatatcttagagttggtcatttttagttgacatttttatgtttatactgtgttctttcaatatgtactttcaaatgtttttagtgtttgatctgttcccttgctttgcttttcttctgtagggactcttattatctatagattggctctttttggcccatctttagtattcgtctgtctttcttttctcttttcttcttctttcttccttcttcttctttcttcttcttctttttttttttttttttgagacagtgttttgctctgtcacccaggcagtagtgcagtggcacaatcttagctcactgcagcctccacctcccaggttcaggtgattctcctgcctcagcctcctgagtagctgggattacaggcacccaccaccacacctggctaatttttgtattttttagtagaggtggggtttcaccatgttggccaggctggtctcgaactcctgacttcaaatgatcttcctgccttgtgtcactttttcttgaatcatttttatctcttcatttttaacattatttctcctttttaccttctgtttctcttaaagcattatttgctgtcattacttgctgatcttaggttccttttactttcaggaattttcccctgtatttctaattattttctgaattctgtcaccttatttcttagttattctatttctgatttatgttctttcatgtatcgtgccattttctttaatgtcttttattctcttttttcttagaaaaagttgtgggattctgaccttgatacttctctgttgttcatatatgtgtgaaattagttcctctgaacttttaaaagaaggtttggttcagaatagcttttcttttttcacagagtctccgcttttcagttaacatttaaaaacatggcatccgggcacggtggctcacgcctgtaatcccagcactttgggaggccgaggcaggcagatcacgaggtcaggagatcgagatcatcctggctaacatggtgaaaccccgtctctactaaaaatacaaaaaaaaagctgggtgtggtggcacgcgccggtagtcccagctacttgggaggctgaggcaggagaattgcttgaacccaggaggcagaggttacagtgagccaagattgtgccactgcgctcccgcctgggcgacagagcgagactccttttcaaaaaaacaaaacaaaacaaaaaaacatggcacgccaggtttggtggctttttcctgtaatcccagtcacttggaaggctgaggcaggaggatcatgtgaggtcaagagttctagaccagcctgggcaacatggcaacccatctctgaaacaaaaacaaaaaaatggcacctgtctttctgagatttcttgttctgcttccctccctcattttatttggaccatctctgtttcatatctttagttcctttcttgctcaatgttaatttcaaccccagggttttttgttttgttttgagacagagtctcactctgtcgcccaggctggagtgcagtggcgtgatcttggctccctgcagcctctgcctcccaggttcaagcgattttcctgcctcagcctccccagtagctgggattacaggtgcacaccaccacgcccggctgatttttgtgtttttactggggatggggtttcaccatgttggccaggctagtatcaaactcctgacatcaagtgatctgcccgccttggcctcccaaagtattgggattacaggcctgagccactgcacctggccagttttttttgttttatcacggcttgctcctgtcctgcaagagtcctggctggtccattttcagagttcacagaggctcaactgtgggccccttcacttctgactgtgggctccttgtactcaccttgtattcaatattgggttggagaaaatccctcacagcgttagctgcagttctcaagttgactctgctgtacttgccagtgggtaacctattcgctatatggaaatttttttttgttctcatgtccattacttccttttggcccatccacataaatattgataaatattgataatgctgttgccatacatgtcttaaagcttttggtagtttgttcctaccttcttgaatgttcctagggataccttatcacttgtaaatgttttccatgggtttatggttttgccatttagttgctctgtttttatatggggaaatgaagattaaaaatctatgtggtggctgagcacagtggctcatgcctgtaatcccaacactttgggaggctgaggtgggaggatcgattgaggtcaggagctcaagaccagcctgaacctggaaggtcaaggcttcaatgagcagggtgattgcaccactgcactccagcctgggcaacagagtgagaccctttctcaaaaacaacaataacaacaactatacagctgtcttcccagaatttgcctctggaccagtttaaatgggttggagtttctttttcttttttttttttttttttttgagacagtctccctctgtcacccaggctagagtgcagtggcactatcttgactcactgcaacctccgcctcctgggttcaagtggttcttatgcctcagccttctgagtagcatgttccaccatgtgcagctaatttttgtatttttaatggagacggggtttcaccaccttggccaggatggtctcaaagtcctgacctcaagtgatcttcccgcctcagcctctcaaagtgctatagtcatgagccactgagcctagctgagtttctttttcttttcttttttttttttttttgagatggggtctcgctgtgtcacccaggatagagtgcagttgcacgatctcggcttactgcaacctctgcctcccagattcaagcgattctcctgcctcagcctcccaagtagctgggactacaggcgcatgccaccgcgcccggctaatttttgtatttttagtagagatggggtttcaccatcttggccaggctggtctcaaactcctaacctcgtgatccacccacctcagcctcccaaagtgctgggattacaggcgtgagccactgcgcctggcctgagtttatttttcttaaaggtaatttctctgtcaggttacaaattcttctggagtcatttttgataatttacgtattcctgaaaaattacttcctcctgggcctcaaatttattaaaagtgagcaaagcatttttgtttgatttttgatttcttctatatctgttgttactgttccattttcatttattattttgtgtctgttctcccttatttcttgattcattataggttattctactttctcccccccaaaaccagctcttaacttaccaattctaatttcttgagttgttagatgcttaatttttttctttttattctttcttgaccattcatataaataacagcctttgaattttcttcttagagctactttagctgattaaaattctgacataagttctgatttgtcatttttattgttttctgaatactttgaaattttaggtttgatttactctttaacccaagaattctttgagagagatttaaaatttcccccagcaggtagggattattgttttctagttttattactgacctccagttttttgtggatttattgagattttcttggctacctaatataagattacaatttttaatgttctgcgggagttttaaaagaagatgtattttctgttttataataagattcccacatatcgactaggtatttttaataaagttttttcctttttttttttggtgtggcagtccatttactctgtgtagaactgagaaaagttcccagtaatgtatttcagtttcatctcatattttctgtgtttttgcttctgaatgtcaggatgtttgaatagtatttattagtactaaatctgcattatgaactacagtttttatcatcacgaagtacacttcttgtctggtattatcacgaatgcagctttcttattatatttgtttggtattgtttctaatcttattatttatatttgtttggtattcctttgtctactcttttattttcaatccttctgaatcattttattttattttattttatttatttatttttgagacggagtctcgctctgtaccccaggctggagtgcagtggctcgatctcggctcaccttatgctccgcctcccgggctcacaccattctcctgcctcagccgccggagtagctgggactacaggtgcccgccaccatgcccggcgaattttttgtatttttagtggagatggggtttcaccatgttagccaggatggtctcgatctcctgacctcgtgatccacccgcctcggcctcccatagtgctgggattacaggcgtgagccaccgtgcccggcctctgaatcattttatattagttacatcttttttttttttttttttttttttttttgagacggagtctcgctctattgcccaggctggagtgcagtggcgcgatctcggctcactgcaaactccacctcccgggttcaagcgattctcctgcctcagcctcccgagtagctgggactacaggcacctgccactgcgcccggctaattttttgtatttttagtagagacgaggtttcaccgtgtcagccaggatggtcttgatctcctgacctcgtgatccaccagcctcggcctcccaaagtgctgggattacaggcatgagccaccgcgcccggccagttacatctttttaaaacattttagccaggtgcagtggcttacagctataatctcaacattttgggagaccaaggcaggaggatcacttgagcccaagagttcgaagccagcttgggcaacataaggagaccccatttctagaaaaaaaatacaaaaagttagccaggcatggtgatgcgagcctgtaatcccagcttctcaggagactgaggcgagaggatcgcttttgcccaggagatggaggctgcagtgagccaagatcgtgccattgtactccagcctgagtgacagacctcatctcaaaaaaaaaaaaaaaaaaaatacacacacacaaaacattttagttaaattaaaatgtaacttaattttaattcagatatcagaaaattttttcttagatttttttgtttgtttgttttttgtttttgagacagagtctcgctctgtcgcccagactggagtgtaatggagtgatctcagttcactgcacctctgcctcccaggttcaagcgattctcctgcctcagcctcctgagtagctgggattacaggcacatgccaccacgcctggctaatttttgtattttagtagagacggggtttcaccatgttgttcaggctggcctcaaactcctgaccttgtgatccacccacctcggcctcccagagtgctgggattacaggcgtgagccaccacgctcggcctagatttttttatgtagcatgtatttggattttttttgttatttattctggaggttgtactttaataggtgagtttagctcatttttaaaaaaattgatctatgtttggttttagtgctgtcatcaaaagatctgctagagtttgtttatgtggccttttttttgcctttacatgatccattatggtttcacttttgtttgtatcctctgataattttcaaagctttgtgtttttaccttgtggattggcttttaactgtaacataaaatgtatacttattttgtctgtcaacttttcatttaagattttaatcctatagaaaaggagaaagaattgtacgatgaacatatatgtttcgttcaactggatttaccagttgttttcactgttctttaaaattcattgctttttttttttttagaaaccagtctcgctctgtcacccaggctggaatgcagtggtgctatcatagctcactgcagcctccaactcctggactcaagtgatctttcagcaccaactcccaagtagctaggactacagatgtgcgccaccatgtccagctaatttatttatttttatttttatttttatttttatttttgaaatggagtctcactctgtctcccaggctggagtgcagtggcgtgatcttggctcactgcaacctctgcctagcagatttaaatgattctcctgcctcagctgactcccaagtcactggtcgtacaccaccatgcctggctaatgtttttgcatttttagtagagacagggtttcaccatgttggccaggctggtctcaaactcctgaccccaagtgatccgcccaccttggccacccaaagtgctgggattacgggcatgagccagctcacgtggccagcagcaaacttatttttatgtttgtagagacgggttcttgctgtgttgcccaggctaagctcaagtgatccttccgcctcagcttcccaaagcactgggattataggcatgagccaccccacccagccctcaccagttgttaatattttgctacatttgctttatttctacctctatctacatgtgtattttggacagggaatatttgaaaataactcgtaaaaatcatgattctttgtctctaactattttagcctgtattgcttgaaaacaaggacattctcttagccacaacgccagtgtcacatcctagtgcttcaacattgatataatatctaatatggaatccattttcccagttgtctcaataatgtccattatagcatttttttgtgtgtgtgatccagtcgaggatcatgcattgcatttagtcatatctcttcttttgttttctttagtctacatcagtctccccatcttattttatttttatgaaaaatccaggtcttgtaaaatgtctcaacatttggatttatctgtttcctcatgactaaatgcagttagattttctggtaagaatacatcatacaaccttttcattccatcagtcaagaggcacataatatcagattgtctcattatttgtcatgctaagtttgatcacatggttaagcttgtatatatgtatacacacacacacacacacacacacacacacacacacttttttttgtttgtttttggagacggagtcttgctctgtcaccctggctggagtgcagtagtgcaatctcagctcactgcaacctctgcctcctaggttcaagtggttctcctatctcagcctcctaagtagctggcattacaggtgcctgccaccatgcccagctaatttttgtatttttagtaaaggcagggtttcaacttgttggccaggctggtctcaaactcctgacctgtgctctgcccacttcggcctcctaaagtgctgagatgacaggcctgagccaccatgcccggccagtattttttatgatatcttttgacttcttcctatgagcaatgacaaatatatttctttttttttttttttttgagatggagtttcactcttgttgcccaggctggagtgcggtggcacaatcttgactcattgcagtctctgcctcctgggttcaagcaattttcctgcctcagcctcctgagtagctgggattacaggtacccgccaccatgcccagctaattttttgtatttttcgtagagacaggatttcaccatgttggccaggctggtctcaaactcctgacctcaggtgatctgcctgccttggcctcccaaagcgttggtattacaggcgtgagccactgcgcccagccgacaaattctttttcctttccctcccctcccctcccctcccctcccctcccctcccctcccctccccccctcccctcccctcccctccccctcccctccccctcccctccctctttcctccccctcccctccctctttcctccccctcccctccctctttcctccccctccccctccccctccccctccccctccccctcccctcccgttcctttcctttttttttttttgaggcagagtttcactcttgttgcccaggctggggtgcagtggcatgatcttggctggccccaacctccaccccccgggttcaagcagttctcctgcgtcagcctcccgagtagctgggattatagacatgtgccaccacacctgggtaattttgtgttttcagtagagacagggtttctccatgttggtcaggctggtcttgaacttccgacctcaggtgatctgccgacctcaggtgatccgccaacctcaggtgatccgcctgcctcagcctcccaaagtgctaggattacaggcctgagccaccgtgcctagctgacaaatatatttctatttccatcctttttatttttcttaatacttaaaaaaatgtacttatacctctgttatttgatttagtgattttatcttttggtcttactatggaagatgaggaagatgagaaaatctacatacttatgctgctcccacctttctccctcttctcttccaacatttcttattcgttcattcacttttttaaatgaagaaaaggaaacttaaactgtatccagtaattataaaaatgacccaaaacatccttcaggtctatattttcagtttcatgggtgaaacctacccatggaacttggtgagtttagagtaattggaagagactggctgagagaacagggaaaaaccagggcgtgggaagcagtgcctgtcggcagcctttgggtttgggtttggactgttatttggactgttacacttgtcatctacctcactttaaatgttggtttatgatttttcatggctatccttggtttgacttttctaatcttaaaattttagacagtaatatgaagggtagcattgttttctgagctgcaataacaagtgccagggaattcatttgggaccagtatcaagctgagggccacacctgaacctcagtttttaccagctccttcccttcccttcatggccttccatttttgtgtctagatgtgccttttattcttctcttcaggtctaccagttgctgggcaaacctcagaatttgttaaccaagtgttagagaagactgcagaagggaatcccactggaggccttgtaggattaaggataccaacatcaaaggtgtaatcagcctcattggaccactggtcagaaatgtctgcgttttgtcacgttatccattgtaaattttcattctgttttgcatgtcagttagcattatgtaaacatttacaattaggttacattgttttaagaactaagtagcataagtgaagcatgatccaaaatacttgattattgcattttcagagcataaaccatgattaaaactgctactggcatcagaattgaaaatcatatgtttaagtaaatgttaggtacagattacaaaaatctgttaaagcaaaacattttggaggagtgaaatagtaaaatgccaagtattgtggcagatttatgctctgaaccacacaaaaaaattgaggaagcatttttttaaacagtcggtttaaattgtttttagaattattgctttttgttctaattttccacaaccattaatctcacttgtatatggcacacccagcacttgtgcctgtgggccatattagatgttcattgtcagagctcaagatgatatatataaatatatatatatatatatatatatacacacacacacacaaatgtctgtgcaagtaagaaaaaaaaagcatattctttgtgccttgtattttggggaaactctaaaactggtaatattttgtatgatgaaaaccctaatgagaaaaaacaagatatatagatggaaaaattatggggtttaaatgtttttttgttccaactctttttcagattttttgaatgtatataggactatgttgaaatgtagatatatgccacagagtctgtgtattgtataaaaaacaaaacaaaaaacaacaaaaaaaagatggctctagaaaactcatatttcggtacttgaccggaagaagacaaatacttgcacattattgcgattgttttattttttgtaccaaagacaaatgcaactgatatggcaaactgccagtctaagtaaagttttgcacagcttacatgatactgtatgaatgtatgaaaaaaaaggagaaaaaaaagaaaaaaaaaggtcagggttagggatcttactgaactgtgaattttatttctgtttgggtccaattatctacagaaggagcatccatacatacaaatattattttgctgttcctctagttcgcttccatagtagataagttggtggccatttagatgtcttttatttctgcacttattgtaggaaattttaatatatttcattttagtaagctattgataaaatagtttttgactttgaaaattaaaatgtttatttagcttattgtagtatacttccaccagacaacaaaatagattatttttattgtattatgtatatatatatatgtaaagaaagaaaaaagctaaaaatatctaattctttagttgccacttttccgattgatgtattattgtgcatgtaatattttcaaagatcaacacaggctaaaacaaaaacaatttatagatttttatatttttgtacaggtattttcaaactagcttcttcaaacttaacatgtgacttattcttctatagtttctagaattgagaaacattaacacatttagtttttaggtgctcttttttgctcatataaaacagcttcattagtcagtgttttaactgtgttcaagctttacctcttgatgagaaatttcttatgtcaaggcagcattataaaccttcccccacagatttttccatcctgtctctcttactgttttattctcaaatcttgtgctttgaactctgaaaactggtggcttaaaaactaaaaaaagaaaaaaagcatatttagcaaggaaaaaaataccaaaaatttcaggcatagctgctggaaaaattatctatttctccattacccactgtaggatttcttttttaattatactttgactataaagtgtcaaagtataatttgttcttttcttttactttgttaccccatttgtaagctatagcatatgaagctatatatatagcttgtgaaggtttgatctagaacacccagtaacaaatgaacaatgttgcttacctgcttctttgacatcttaaaaaagaaatccaaggaggattgtaaggattgtcttaccaccttagctgaactgtgatgcacaagatttttctatgtgtttggtggaaatgtacctggtttgtacattcacgctaaacagatgataagctcaagtctgatggtttaatagaatgtaagttcatcgtttaaagcttttcctttttaggttggagaaggcaaaacacaggcttgcaagttggaagtatatgaagtcttgacagagtgtgtctggtaaattgaaaagtgtttcaaactatggcagttttgcaatcaggtgaaaatcacctcatgatattcagctgataaggtttataaaattgcccctttctagctgctctgttaggaattctggtttttgatacttttttcctgtctgcaaaccagaatttgattttttggtcttgcatttcaaaaaaaaaaagactttgaatctgtttagtagattccatatctttgagtttcagtgttttatatgtactacttaagttaaatagttaaaagcttttaaatagttgagctttttaatgttgacactttattttgtacctatttatatatgtatgtatatcttagaaaagcactttgttaaaaaaaaattgcattttatatgattcctgccatttgctgctaaatctgggctggtcagaatgctgcagcgatacttgatctatataaaaacctggcagtaaaatgtagagtgaaagttaaatcctcttgctgttttaactttatcataaagatgacataggcaagctgtgcagctttacattttaaccaggggactctgtggcatttaaaaccgtctagaaatggttgtactttaatgccagtaataatctgcttcctctattgtcattaaaatatatacgtttagtgtatcacacaaaccaatcttataagggtaatgtaaaaaccccaacaattgtacatgttctgtttttgaaaattgtggcatgtatttttgggtgaagatcattagagaagagttctctaaaggttttctgtgttcatacatggtatacagatagctcataatgaagtccagaatcttacttttaagtgaaggcattgtgaattcacctcaagtaaacccattgttccaaagcaattataaactttgactctagtactactatgatttaaaaaaaaaaaaaaccaacaaaaaccttttttcctagtttcagatacactggattctttatagagtttgtctccatatgaaagcatgctgtccagtcgctcttgttaagatcttgtctgagttttgaattgggtgccacacttttccagtcaatataattgcttgttctactgtaccatgtatgattcttgtcctttcctatatccttcatgacagattatgatgtggctttatattgtgccttacttgtacatttaaaactaaacgtcttcattcccttccacttcctacatctttaactttgacctttttggtaagagaatcagaactattacaaaagcatcatgaaggatttcagatgggtatggtttcaaattccctctctttatagttattttatatttgtatgaaagaccagttttggatggtctttgaatataggggggaaagattagcagtaatttcactacatcccttttctctgactttcatgcatttctcatacatcttctttctgatgcttgactttatttgcttcctagcaatagtctgcatttaaagaaaggtgtgttcaattcatcagcttgaaattgactatttcatttttccaggattttttaggagaagagtacccattttgttttataaaaacagatgacaagtctctttaaaagaaacagaagtacagtacttttgaaatacaatgctgttagtttggatttctttttatatatatatataatattcatacaatgatctgatgtttgccttcattaataaagctgttagtttattcaccaaaatgtcaagaatggatgtgcttttctttattccacacatttaaaaaaatttagctgctaagatttaatgttataagaaatgaattcaagttgccttcagcaagaattaacaaaaacttatgttccctttctttatatagtttcctaaaattctgttcaagtattttctagttaattatgtaacagaatgttagcatctctccatatcttgaaacttgaattttgagaatgcattgaattatgctttcagtgttaaagtaaaaggtttcaattatccttctagtgaagtctgttgtggaataccatttcccatggaactgaggccatttccacaactttgcacagaactgcagtcttgttcttcccttggatcatgacaaataagtctcacacagtgccgtaatacttgtggattcttttgtaatctttgtaatcttaataagggcattatgagaagacgactccatgtttttttaatacttcaaacacattgggatgtaacaatgaatgtcaactgtaggaatggtggtttcgttttaaggaataagcatgttggggaaagatgatgaaaatgtactactgaaagttatacacttccataggcaaatgggattatgtgttgaagcatagtcctcatgcttaataaactgactgaaatcgtagaaattacacctaggaactgagctaggccaaattgccatttttgtttagagagttttggaggtagtagtgaggggacagagccttaaaactacttccaaacagtattttggaattgaagacttggtaactagtgaagaacatcaaagttgggtatttcaatgtgccaagtttgggtgaactaggttcggtttgcctctttcataacaatgtaaacacaatggtgtagttaattaaattctgggtggataggagcaggactgattactatgtcttgcccttcgccctttgtttttttcagaaccaaataacagaaatgtgtatgtgtgtactgtatctgcctttccaccacatttttatgacactgtattccactgcctgcttttttaccttctttccctaggatttgtcctacagcttagtattgtggttgacagcgatactagggctgacagcacagaagtcacaagagaagagtggaagggcaagaattcaaagcatttgttcatacaatgtggcaacctcttttgcatagttgcgtaggatcctgtttgtaatgctatcataaatattctgtagttttttttttttctctcccaactggagctatgacactttttattggattcagtcttgtctcttgtctagaaagaactttatcttgttgacgcatgagctgtttaaaaattatcctattaaatgttggttaatagttgtgcagtttttcatttcagatggaaaggcaatgcaaattttgcctttgttttctgtcaccttccaacccctgagcacttctagtcagatacagattcatcagtgtatgcaacatcctttgtaatttaaaataaaaaaagatgaaaagaaaacgtt

SEQ ID NO: 848 - DNA, 139582 bp, Homo sapiens
ggctcagggcagcgcggagccgctagcgtctcccggcgcggctgcccgaggccggcgaagccatgggcgccgggaccccgccgccgccgccgccgccgccgtctggccccaggtagggacaatcccccgccccgcgcgcgcaaagagggctttagtcctgcggaacttggctttggggcgagctttcccccacttctctccgagtcgcctacttttaagtttaatttcttgatttgcttttgccctgaaaaaaaaaattagagacgcaattcaaagtttgatgacttcgggaaaagtcacgtaattcaacaaaggggctctaaaaggggcaaaactcgggtggggggaggcggacttttacagattcccaaaaccaaagaccaaggcgtttgtaaagcttggcgtttaattggttgtgtgaaacatttttgcttttaaatccctaactaatgaactttcaacggtgcatgcgaacttgaaaaaactgcaagagattttaccttagatctgtgccctcctcccccattttaagtatgttttttaataaaaaggaaatggaatgtgacctctgctgtttctttgaaatgcccttgggtcccggtatttgccccccaggggtgctggcggcctgggcagtgggtaggggtgggggaagaggtcagggtgccaggaggcctcacgtagtgaaaagagggtgccaggtgcaaacagttaaatagtcacaaactgtttgctaaatatttaataattaggcaagcatctcccagcttggttacttaggttgcattgaccttggcagccctgatgaggcgagattttcacaaagtactggtgaagaatttttccggtgataaaaggcaaggatcaatgctttttaccccagcatggcaattgaccttaaaaacaaaattaaaactccctgtgatgacttagtacattttatgttactttccatggcagcatagatacctgccccatgatggatatttgccctgtgaatttagagaaagtttgtgctccagaggtggttcaaatcattgaagaatagggcgtttattttcttcctgtcactatttatgggaaagaattacggatggtccttcttgccctggtttgtggatgtccttggtggttgcaatcaagcaagctcttatgaggaataatatctggagaaaagaagagaagcatttgagagttgaatgagaaagaaatggaaagcggttactgcttttaaacataatagagtctatatttgttgcctacccctcccccttccccatttaatccttcagttgatactattttaggaaggataagacagatgttaaagatcatagaccaccttactggtcccagctgtgaaacactgtcaggaggcagataattgaaacaaggtacataattgaaacaatttgaagctcaaaggtaaagttaagttctggagttatttgtatttccctaaagtgtgaagagtcagctaacagcaagctgcctgggtcactgagcagaaatggaacagatgctgagacaggaagggaaggtgtggcttacttctcttcttggcccattctgtgtctatcctctgatcctgctccgtgcatttattcagcaagtatgatcttggtcctcaatggctccggagatttagataaataatgatacctaaagagaaatagggccaatctttcctgtgtttcaaagagctttttggatatctgggattgaagacaaaaccttgcataccaactcaacacgttccattatcctaaacatggaatgattcccttgacgtcccacccagaccctctctgagccggaaatacaacctggctaagctccggccagaatccatttgcagcccaagggcagagcacaggtagggccggcccctttcctcctagaacagcccgctcttggtgcccggaagcccattcacggtgcttcttggaatagacgccagtttccaaataattgaataccagccttccagtagctaggtttcctctccctagactgtgtttcacattcccctagttacacaatttttctggtaaccctgaatcttgggatcttttacagtcttggttaaatagtaactagtacctatgtcctgcttttctttcttggtcattaggcagattttctttttggtcattctttttggtcattagattacatgcttacagagagactttgtaggtgtgtagaaaagagttgagttaaaggggtcatcctaggggaagccgacttggagtcttcacctatgtgcaggtcagatgtagtctttctcgagtgcctgctcttaaccattgagccatcctgtgtctccagttgtagcctttcttactctgactgctatttaagagaataaactgaaaatgaaatcgctcatctacttgtacccttttcacccgagaatatcatagtcccacagaggttagttaaaatcttcaggactgtagattatcaaataatcctttcctaaaacatacgtaaaacaccaagccaatgaatacgtgtcctgaaacagaaaattaaaactctgactcagtgttgtcaggcattgtagaaaagatgttccagagctgcaatgaatattaacaaatgacaaaaggaatattgtatctcactcaaactttatcagaagtgctgaactctgttctgttcagtgtacaagtggttctacaaaatttaataaaaccctgacctggccttggagacatcatgtgcgtagacccagagacaccagagagtcgatgagtttctggggacacagtccttgtcttcagagatcccaatatcttgggagaaaccattgaaggatcttaagcacagcagatctctattttagagagttcatgcaggctgcaatgagaatgaaacaggaaagatacaaccaagaccaaaggcagctgcggcaaaaatttaaattagaggagagagagaagtgaactgattcgaaagatagttaaagaagcactggtatttaagattttaactgtaagaacccattaattgacttgaatctctgacgtcaatttacatgtcatttcaaaatacattttctctaggtagataaatgtaagccacatttcattgcaatgttcatgtggattctagttcctctagagctcctcatggtttttaatcacagaaaaaggtttctgataaatagccaattatatttcacattttcaacaacctagtgcttctttctacagacttaaatatctacatctgaaggcaaagctgaagtaaactgttgccctcatattatatacacattctctgatttagcttaactccttctgggagtaaaaacaccctgacatttgattgtttaacactagtggaaatggacagtagaacagcctttcttttttattgttttcagttgaccacaacatggcctgctgtatgtcacagagaggactgtattatatttgtaagagtattagtgacgtgtgagaggctatacataatgcctgtgaacaaacaaaagtcaccttggttattgactcattgccgcatgcatagctttttaatacaatgtgtatttggatgtattttaaatttattcacttgatcactagttgtggagtagatgtctacacacaggagttttgaaatttgattttggtgttgttttccctcatttgataactgagtatcatatatcttggttattaacgtgcaataaatacaaagatttgattctgtatagctgtgaaatagtactgcttttatttggtcagattgtcaacaaccttagtcctccagaatatgtattgtaacctagaaatgcataaaagaagtccacctgcaccttcaaattgttgttaagagtcacatacttaagattcccactagaacttatttggcattatttcatttctgattcctaatgagcttggctacctgggttcctggtccacagcaagatctactttatagtttcaatgtacagctcttgtgataagtatgaaatgtggttacagccaaatgctaggcagcaaagacaatacagtgaaggtggtctgtgattaaaccctaagtctacaagaaaaacattaaattgtgttcaaaactatctgttagaaaggaagaagtactgccttttggtaaaaaggacccttgatcctttttagagctggaaaagaaccttaaaagttacttggtctaaccaccttaatttacaggtgaggaaactgagtctcaaagaggttaattgatttgtccaaagtcatacagctgcccattggaaaaactgctgggactggaatctcagagtcccaattcctggtttagtcatgttcctacttctgactaaaaagcacaaatgttagtactatgaaaaactcattctatattaagtataatattgtccaaaacatagccactgtttattgagaaattacttatatattcagtatcagttatctattgctgtgtaacaaatcaccccacacgtaatggcttaaaataaccaccatttattgagcttgtgcttctgtagataagcagtttgggtgggcttgggtgggcaaattacgttcttttccagtttcctccatgcatctgtggacaccaaggcagctctgcctctgagtattggcggaccatcggccatgtcacgtggggagcagctgagcctcacgtctttcatgatttagcagcctagcctgggttcatcacatgttggctcaacttggttgcaagagagaatggaagcaacgccccttgaggcctaaattcaagctgacacaactcacttctactccagtctatttcaaaagcaactcgagaagccagctcagattcaaggggtggagaaatagaccccactttttaatgggaggaactgcaacgttacattagaaaatggcatggattcagggagggatggagaatcatggcctttttcacaatttataatatacacctcgtaccttatgtaacttgtctaacttaattctcacaatagcactgaaggttaaggcaaaattcctattttacaggtgaagaaactgagaaccagacatgttagtctggattaggcaggacagatggtgagtgatgaatccaacactgggacttgggtgtgtctgactccaaagcctgtgctcagtaccacgacggagctctgcctccctacataatgctgcagtgaagggtggtggtattactaagtattatacggctcagagttttgcgtgaaaaaaaaatcaaactttagtaaaactttttcatgatttatatgctaagagaaatatcaaacatgattatgccctcaaagaacatatggtctcatttatatatggttgcagtgtgcacacatgttatttaagcaataaaattccaagtaaagagaagtaagactggataatcagagaagcttaatagaggatgaagtgatgagttcaggggagccaagagaaagccctatttagaatagtatctgttaatatctcaaaagatcctcacgtcatttatataaattaagtaatattcccattatacaagggaagttatttgcccttagtcacacagctaaaacctaatcaagatgacatttaaacccatgtccatgtatctcaaaaaactattccttttccatttttttccaataagccagtaagctttggtcctcgaagtgaggtccatggaccagcagcatcataaccatctgggagcttgttggaaatgcagagtcctgacttcacctccagtctactgaatcagaacctgcattttaacaggatctcccagatgattgcataaccacagtaaatgcagagccctgcactaaagggagcttggagaaatgacttgtattaagataggtgaaggagggtggaagagctttctttcttttttttttttttttagcttggtttttttttttaattttattttattttaagttccaggatacatgtgcagaacgtgcaggtttgttacataggtaaacatgtgccatggtggtttgctgcacctgtcaacccatcacctagatattaagccctgcatgcattagctatttatcctgatactctcctccccctgccctccctacagccccggtgtgtgttgttcccctccctgtgttcatgtgttctcattgttcaactcccacttatgagtgagaacatgtggtgtttggttttctgctcctgtgttagtttgctgaggatgatggtttccagcattatccatgtccctacagaagacatgatcatgcttcttttttatggctgtatagtattctgtggtgtatatgtgccacatttgctttatccagtctgtcactgatggacatttgggttgattccacgtctttgctattgtgaatagtgccgcaataaatatacatgtgcatgtatctttataatagaattatttatattcctttgggtatatacccaataatgagattgctgggttgaatggtatttctggttctagatccttgaggaattgccacactgtcttccacaatggtggaactaatttacattcccaccaccagtgttaaagtgttcctatttctccacagccttgccagcatctactgtttcttgactttttaataatcaccattctgactggtatgctgtggaatctcattgtggttttgatttgcatttgtctaatgatcagtgatgagctttttttatatgtttgttggtcacataaatctcctcttttgagaagtgtctgttcatgtcctttacccactttttgatggagttgtttggtctttttcttgtaaatttgtttaagttccttataaattctggaaattagacctttgtcaggtgggtagattgcaaaaattttcctccattctataggttgcctgttcactctgatgatagtttcttttgctgtgcagaagctctttagtttaattagatcccatttgtcaattttggtttttgttgcaattatttttgacgatttcatcataaaatctttgcccatgcctatgtcctgagtggtattgcctagattctcttctggggtttttatggttttgggttttacatttaagtctttaatccatcttgagttaatttttctatgtggtttaaggaaggggtgcagtttcagttttctgcatatggctagccagttttcccagcaccacatattaaatagggaattctttccccattgcttgtttttgtcaggtttattgaagatcagatggttgtagatgtgtggtcttatttctgaggtctctatatctgtgttggtaccagtaccatgctgtgttggttactgtagccttgtaatataatttgaagtcaggtagcgtgatgcctccacctttgttctttctgctgaggattgtcttggctgtatggactcttttttggttccatattaattttaaattagctttttttctaattttgtgaataatgtcaatggtggtttgatgggaatagcattgaatctataaattactttgggcaatatggctattttcaagatattgatccttcctatccatgaggatggaatgtttttctgtttgtttgtgtcctctcttatttccttaagcagtggtttctagttcttcttgaagaggtcctttacatgagggtggaggagctttctaggcagggagaacagtgaaagcttggacgctgggctggaatcaatgccacaggtatgaaagcaagtggagggattgctggactagagtaggggtgcgtttttggcagtaaaaggaagttatgtgagactgatggaatcgctgtggagcctgatgaagtctgcttgttagaaaggttaatcgggcagtactgaggctggcctggcagcagtgaccctggttgttgcttaggctttgctgtcctttagctgtcctgtgaagagaactcagaccaaggaaaagatggaggaaatagaggagaaggatgcaatctgggaggcatttcaaagcaccttccatgggactcgatgccagatcttctaagggaataaagagagaatgtgaacatgattctggactgtcaagttctgaactgtgcttcccaaccttcaggctgggatgttatctttgcaattctttgctactgtaaaagaaggatactttttggtgattgtggttttgttgtttgtttaaaggcagcttcccccattccttttcattatagcagtttttcagcttttgctaagaggtaattcaaacatttaaattccaaatctgtatgtccatgtaaatagtggggaaatttttttggcaggcaattatttgtaatgaaatagttctttatgtagttctgtttattaggccttcccaacaaccctgtgatatctatgtaggtaggattatgatgatcatttcatagttaaggacacagacttggagatgtgattcagccaaaacttgaacccaggcctgctggctccaagcacaattctctatctgtccaactaaagcactttgcaggttttctatttggtctttggaggagattatcaaactgatcagtctttggtttactttggtttgacttttttcatatacactgtgccaaattcagaacgatgcttcaaagtttatattggtggtttgaagtaattatttcatggaaaattgaaaatgcctcattaaaaactgatttcctcccctgcctgattttcttattttattgaatccatatgttgatcccaatggcaacaaaccacacttcaaatttcaaatgatgtgagcaattttgccgtccattcctttgtttctttgaatgatgaaaagatttttattttttttcaattcaatttctaagcctatttcttaagcaactaagctgaggctttaaaaatgtccatagatgaggtcaggagatcgaggccatcctggctaacacagtgaaaccccatctctactaaaaaaatacaaaaaattagccgggcttggtggcaggtgcctgtagtcccagctactcgggaggctgaggcaggggtatggcatgaacctggactgcactccagcctaggtgacagagcgagactcagtatcaaaaaaaaaaaaaaaaaaaaaagtccgtagatgacagaatcatgacctggaaggggtcttcagtggtccaaacccctcattttatggataagaaaactgaggcctaaagagagaatgggacctcttaaaggatctcccataagttggaggttgttgtagggctgggacccatgtctataaccttcctgtcctgtgctttttcactcaaccacttcagagctgttcctttccctgtggcagcgtctcccagccactggtgagcagtgtagggaagttgaaagagttcacattttaaagccgccattacctgggtttgaatcctggtttgctggctacctggcatgtgacaaacgcatttaatgctatagtcatttccaaagagaataataaaacagagttaattggctagaccgtcaagattgcagttacaatttatctgcattctcttttaaacttgacaagacaagttttatgatgctcaccaggatttggttttggcaaaggaagccaagtgttctaggggtggacatagtaaaaatggaagagatccactgcagcccaggcagaggccccaccaagcctgatccccctgctgtaaaatgagttcaggcactactgttgatgccatgcattctctgttggaagataaaacacaagtatttcctggtgctgcagcacagggctaaattgtggcgctggggaggtgagcctgaaaacaaaggcagatagagaagtcacagctcactggtgagggagctagagagttgttttcttaataccctctgcctttgaatctgcctagattcaaagatttaatggggcaaaaggagtgttacttttatataaccaaaaaaaaaaaaaactaaaatagctttagagaataaaattactgaaactgcaacccttgacaggcaattgccctttaagagttaactagacaaacaagcaaaacaagctaacaaatacaaactcaagaatccacggctggagcacatcgcaggtcccctaatggcaggtatgactaggcgaggcacaagtacacccgcgcccataagtcagaaattatgagattcatcctcccaaacacagatgacagcatcatatgcacatttgtttgcattaaatcagtactcacctctgcaggtgcttaccctctattcagtttaagtgagccctttggaaagaaactgggtgtgggggttgtattttcttccatcactaagccatttgttccactgtacttcttgtgtaagtctcaaaagaggagaagctatggcccacttggagtcaggcctggctgccccagaagagacggtaatgagggctggactctcatcgggtttgaattttggctctgccatttgttgtgggacctcagaaatacttaaaattcctggatttcagtttcctcatctgtaaaactgggacgctaactactcctggatttcagttttctcatctgtaaaactgggacgctaactacttcctctaatgtgtgtctacctagcacagcccgcccttagtaaatgtttaaataatctgagtctcagcctctatggcctcccattttctcaaatgtaaaatacatctggactagagcagaatgggaggtacaggatggaaagaaagaatgagggaggggctcaaactacacacaccttctcctggctcccctcgtcttgaccttatataaaagccacacgaaatagcaggaagctttcaagcttaaactcttgggatttcccctgaatttctaactagagatgtaaatttcctcattatgaaattgtctacttaaatatctgtccagggatagtttcaaatgtttctaaatataccccaagcatgtaaagaacttgttagggtaaaacctataatcaattccatgtttgtattagtgtgaggcagagaggatgccaaggactgaatttgaggaaaggaagcaacagtggagttcacagagaaagcagaacttatttacatgctgaaatgatcacagtataagtagggagactaaagaaaactgtaaaatatggagaaattaaagctcaagaacgtgaccttttcttgattctcagttccatgaagagttttcaaaataacaaaggtggcatttataacatttaaaagagagggccgtggcctcacttttcatatttagtatattctccattcttcattttgtgaattggagttttgaaaaaatattactgtaaaatgttcttatactggagggcccattccaattagtgaacctagtgccacaaaaagctttttttttttctatcaatgtgtagaataaaacctaaatacccttttattgaacaagcatctgcggaggtcaagcaccgtgccaggtggtgaggatacaaaggtgaacaaaatggacctggacacaatcttggtgggagacaggtattgatgcaataaccatactggtgtggatggcttccctgaggaagggatgtccagctgggatccacaggatgagtggactcttacccggcaaagggagccccagagaggggagggcgaagggcatgctgatatggcttggggggatggtgttctgagaaatgtcttgagcacgaggagtaccaagagaagtagacagtagcttcatcctgcaggccttgcagaccacatgctaaaaaccaacctcagctaacctggtccttcatatctaccaggtccctctcagtggatgttaaaaactccagaatttggaggtgggtgaggataaagaaaccatcctcacagcctcaacacttggtctcgggttcgattcaccctcacaatccaagtttgattagtaagcaggaataaaaacaatcatacatcctgtcctgtaagcttggtgaggcccctccttctattcttttggtttctccaactgtatcttcatggaaagttcatgaaagacaaatgtgacactcttctagaagaagagttgaggtcacctaagagcttaatttaagcagcaagaatgctttgaaccggccactgaatgagccatttctcagaaacaagcactaggaacattgggaagggtaaaagatactggattgctgtaatcacattgttgatgcaagagtgggagtgcctctcactacactatttctagccagtccacactcatacaaaactgatttcaccaaggaaaaataacttctaacatccattttgcaaactcataaagtcctttgtgttgagtggaaataatgaggctagcatacctgtacaagccatctctgccttctgattatatttcgtttctgaaatattatatttatattttgaaatatatctgaaatattaatgaaatataatatctgaaatatatttcatttctgaatatatattcctgttggggcaactcatttaatctacatcctaaagcacagattaaaagcacactcataaattccaaactgtctacgctgacataccataaattagcaaattgcagacaatacaaccttatagttggtggtctttattttaagaacagtgagaagctattgaaggttttaaactgaggagtaataagatttgcatccctggctgctgtgtaggaagaaggcaagactgggagagaagagatcaattaagggactattgcagaagaagatgttgattctcctcttgaataaagtagaggcaattatagagtgagaagtggatgggttcctaggatagtcaataagatcaccagtacctggtaatgggataggaaatgggaagtgagggaagaggtgtcaagattgaatattaggacttgggtatacaagttttcttgcagtattgtttgtgatgaaaaaaatccatatatcatcaacatatacaatatgtaggccaagcacgctggcttatacctgtaatcccagcactttgggaggccaaggtgggcagatcacctgagttcagaagttcaagacaagcctgatcaacatggtgaaaccccatctctactaaaaatacaaaaattagctgggcatggtggtgggcacctgtaatcccagctacttgggaggccgaggcaggagaatcgcttcaacccgggaggcagaggttgcagtgagccaagatcatgccattgcactccagcctgggtgacacagtgagactccatctcagaaaaagaagtacagtatgtagatacagtgcagtactctgcactgatttaaaaatgagatgtatgtgtaatgacatgacagaaatattcaggatatagtcttaagtttttaaaaacttgttgaagaaaaatgcacttagtgtttcattttaataaaataggaatgattataattagctcttaacagaaaatagctggaagaataaattttaaacaaataacagtgaagattataggggcatttacaaactatatttgacatttctgtactcgagtttttgcaactctcatgtttacttttgtagtcagggaaagcagactttgcagaagagcaaactgcccttcttctatcatagaatcttctgatcctctgtcctaaaatgattgctccctcttccgaatatcttctagattgttagagccaaaaagggctttagagatcatttagttctacgtcttcatttcacacatgaggaaactgaggtctagaaggactaatggggtggccaaagtcacataaccctaaattaagagcaagaccaagactagaaccaagggatatactggcttgtggtctagaattctttctcctacaagcaaagtctcctctagcactcactgtatctgtgaataatttggctttacttggaaggcctcataaataaatatgtctttctcctccagtaaatttgtgcttgaactcagagtcagtgtccagtatcacgttcatgcattgtgaaacatgcagtacaacaattgacaggcttcagttagatttcagatctgaggcaacactaaaatttggggaaaagaaagactcccatttgtggtttgtacttacacagcactctcaggagctcgctcatgttctctctctgtctttcacacatacagtaggaataagttagttgcctaattggttatgctggggaaatgaactttgggttcagggcatgtcagtaggtaccttcccacttgcaacaaaataccaatatcccgaacttccggaaggaaatggcatggccgttcaactttaatctgttgataatgtcagtaatttcccacaactatattcaacactttctggtcctacaattctcataggtccttttcacacagtgtgtctcagggactgtttcatatctcacagagacacagccaaccctggcttgactatgggcgtggagcagtgtttcacattgtcaacccctcatgttgtggggttcagccagatggaggcttttgaatcactgttcagtgatataaacctcctcctttgaccgaaatgagaaatgatggctactttgtcccttgccttgtagctccccaggggcaattagggagttgccccagcctgcaaagggctgtgttaggatctcacctctggtgcctcgtccttttcttctcctcccctgaagctaatcatgacacttttgtctctactgagctccacttggcatctggtgttcatcgtctaaatgagctgctatctctaggaaactattctgctctctgcctcccattttgcaaatttggtgtgtttgtttccagtgttttattaatttatttcaactgaacattttccatatcctaaacattgacattatttacgttaccatctgcttgatgttttagactctgtatacccccccacacacatatgtttgtgtaagattcagttctaaagtctttcaaaccagttttcttttccaatagttaattctgtgcgggttcacaatgccttaaatatttaagtatccatgtaatgcatttatattttttatcttaaaattcggaaaaaacgttaagcctcataactatgatattcctttaaattgtattaaactaggattttgatatacagtcatgtacctcataacaacgtttgggtcatatacctcttatacaatgttggtgccttaagattataataccgtatttttactgtacatttactatgtttagatatgtttacaattgcctacagtattcagtagtatagtcacatgcggtacagatttgtagcctaggagcaacaggttgtaccatctagcctagctgtgtagtaggctctaccatctaggtttgtataagtacactctgatgtttgcacaaaaacaaaatcacctagcgacacctttcttggaacatattcccattattaagcaatgaatgactaaatgatatagggagaaatttaaagcactaattattttctcctcagtcagctgtaagtctgcctttcagtaagcttacattgttcttttcgcaaatgcagaaatttatttctcaataagcttcttgaataccaacttcacatagagactgtgtagtagtcaaggagagaaagcgtggaagagcagccagtagaccctcattgcaagtagaacaggaaggaatgtgactgaaccacaccccagtggatcttagaatcagaaaattacaagacaacacatagaaaattccaagatgacaagattgttgtgccctggagggttattaaaagagttggtattatctctatataacccagacctggactgtatatgtgcaccctcagaagtacctggaaaattttatgtttctcatttcgttcagctatgcccagaccaagcaataatctatcggacttatattattcttggtatgacatatagttactgaattttctagtgaaatgcaaaatatgttggatggacaacaggatgagctatttgagtcagtctgctctgaaactcaaaggttgatgttctccataacttgacccttccatatctgcacacagacccattatctgctttgccacaagaacgctgatcatattctcttccaaatggataaggcaaagcatttttatgccaatactatgacactttgggagatacagtttgtatgcataaacattgggacattttgatattcactgattcagtgataaattattattcactcaacaaatatgtattgaacatctcccaaattaaaactgccatgaaagagttagaacatagcatctgtagatataattaagagctactaccggggaacttgtttatgtttcttaatatctacaaccaacagattagtactttctagccatttgttttttgattcataaagttttgagagtaaagaaatgtaagaaaaaaatcaattacctcacaatcaactgagactgttttcctgctagaaattcccagttggaactgattaagaaatgtgtgtttctgataaaggtacaggtggagccaaaggataaaagggtgctgtgtctttaaatttaaagatattttataattgtccttgaagtttctattttcatttgtttgctttgggtgggacatggaaaatatttgcctactgtatggtactaatcttcatgcatgtgtttgcaaattaccttccctgtgaaaagggtggaggcatttcattggtgatggcttttcttattaaatacttgcaaatgcatgaattttctgcaccaaaagttggtgagttcattttatatctgaaagtcgggtttaagagaagatggctcagaagcttcaaaagtgtgaaactttaggaattaaacattgggttctctagttataaattatcaccggagctaccttagttatatgcttagtattttcattgtaagccagttattttcaaagttttggtgaaccctaatatttattctaaattacattgtttgaagaatcttattttgcttacctaagaagttttttttgagatgtagaaaagatctttaaattattttgagtggctatgtgtggttttcttccataaattaaaacttcgatagttcagaaattattattcactcaacaaatatgtattcaacatctcccatatactaggaagaaagtatgtcagccttcctgaaagcccacagcatatttttcacaaacagagaactttaatttgcaaataaaattattgaattctatactcccacaccacgtacctgatgtttctaaaagaaaaacattaactaaatttcgcagtttatttgagcaaagaaccattcatgaattgggtagcactcagaaccaaaagagattccaagttctgctccacagtgagcagtgagcttacattggctaaacttggaagtaaaatacagaaataacttgattggttacagctaggtatttgccatagttgagtatggtctggtcagttggctgcatctgattggctgaaacccagctatttgttacaaaaaatattctcctaagttttcatttgtttatatactaaattagcttacagtttgttatacaggaattcaaagcacagagacagcctcagtcttttgaccccctgcttattttgctttaacagtatgtaaatgtattctagaatgaatataatttcatatataaacgtaattttattgagcactaactacaagctaagcattatactctgggatggtcaggatacagaagtgaacagaatccctgtaatatctactgggaaagaggaacattaaataatccttaaataaaaatagaatttaaattgtggaacaacaaaggaaagatcaaagaggtatataatatccttaaatgggatcctgtttaaatgatttaaatgggagaggggagggaagggagaaggcaaggaaggcttttcagagaaagtgaagtgctaaaagtagaagaatgaagaaaagttggccaggggaaaaggtggagaaaattggctatatacaattttaaaaaataaagggagacttcattctgggggcaagaaacctggtttctagcttaagagatgctagcaactgcccttgagcctgtcttaacctctggcctcattttctttaagtgagaaatctgagttggatagaaggatctaggatttcttctcttatttgatctgtgattaatatgtatggctaccttatggggaagctctccagtggctccgtctgggctggttcctggagctgtcatcatcttagtccacattctttcggttcttggaaatggggaagctgcatactgcgtgtgcccctggcaggcattggctaggacttgcgacagtcatgcagttaggcttgagcgacttcagcctcctgccctacccatgtccacaaatttatctacatctgcatcagtcctttcctcattctcttcattctcagaggataaggtgttccttttcctgttcaaggccaactttttcatgtggacttaacttttatcttccatcctctgggatattgcttcaccaattaattctgtctttgtcctgaatctatcaactctaaccaaataaaagtgggggtaaggggtgttgaaaaaatttatttcttacaagataaatatgtcttcctttgagcctgttggctactgccccatctctgtttcccttatttaaaaataaaataatataaaataaaatgtcctaaagagttcttgagtaattgctgcctttaactgcaattcccattccagttcactcaacatattgctatttggttttagtccacatcgtgacatgaaaacatcactgatcaattctaatggtcatatttcacccctttaatttaaaaacctccttgctacatttcaagctattgatcttgaggatgtcttcctttttgaaattctccctttcctttgatgcttttatgctattacatttcttattcctgattcttctcctacttctatgaccagtccctatttttctatcatctattatcaagtttgaccctgaggttttcatgatgcagaatccagttgtatgttctatactatctatgagttatgtctgcaaggaagagtgtgcaaagaattctgagtaggattaaatggtaaccatattcattgattcaggtcaactggcaaggtaatctgtggaaggttacagaatcaaagatgacttgagaattagataacaagtaatttaaatcttggggacttagatgagaagactgaacccttcgtaaagtatagagtgtccgttcaagtatacatagggaaaattagatcctaaatcccaggctaacttgctagtgaaaatgcgctaagaaggtaaccccaaattttgggggaaagcaaaattatttccttataatatagtgttctaaccatgggaaaacttaaaatttaagtgtaaatatgatggactaaataaaataaaaatatttatacttttagataagtttggggaaaagtctttaatattttagatattcattatgtttaagataatgtgttaatatgattagccttgtgatttctaatctaaaatatgtcattggatgattgatttagactttgtattttcaagttaaaaatgttaagataattttgctgtatttaatgctatattgaaatgtttaatgtctactactttaaccaagttaaaagatcactcttcagaagattgacagagtttagagaatgttaaatagaatataagatttatagttgatctcaattcaaggaaaatacatttttggatttgttattttaatattaattttaaaaaccgaagtacctgcagataatgcttttgagggttgtaggggacacccagaaaatctccttgctatctcccattcccaagcagtagtgtgtccctggtctttcttctcaccccacagttcttcccagtcttctaggctccctgaccaacctctggcagtgtcagaatatatgcaccactcatagctcaaacatacatgatacccaaatgcctttctccagccctgcccccctacacagctacagatccattaaaaactacttccggtagggcatatctgcttgcatatccccagaccccatccaactcaactcacctgaaatgcagtctatcggtgctccaccttcaagcccactgatgtgctctcctttctgctattgtctcagctgatgacatcatcaagtgctctttcctctctagggcaaagactggcttggacattgctatggtttgaatgtgtcccccaaatttcatgtgtttgaaatttaatcctcaatgcaacagttttgagaggtgggatcctaaagaggtgattaggtcacaagtgccctgccatcatgaatggattaatgccattaccttgggagtgggttcctgataaaaggaagagttctggccctcttcccttctttctttctcacgggtttctctcttgcctttctaccttctgccatgggatgttgcagcaggaaggacctcatataaaataaaagtccccctgacctcgaacttcccaaccctcaggactgtaataaatctctgttatttataaattactcagtctcaggttgctatagcagcacaaagcaggctaagacacttgtcaacgttgcctctctttgaccccctcagtgcctactacctggcaactgtaggtacgcaaaaactcagttgataaatatgaagcccaaataaaagagggaatgacatgaatacctgctttaggatgagtggaaagggaagactccattatcattttggtactagctaatggtttctttgtcaaaagggtaggaatagctaacattcattgagcacctactatgtactaggtactttaggtgatttgtgcacattaactgaaagggttgggctcagagaagttaagtcattcaggatgatgaagctagtaagtgacagagatggtacttagcgaaggtctgtgtaactccagaacctcttcagtgttcccacctctcctcagaatagctattttcacattaaattagatttcctctgactgatgtttttatgcagtggtattactgatataattatgaagatcaagtggcatgtatgcaaaaactcagaatttagggtgtttataaaaaattagtagatttttttcatttccttataaaagacttcacattttcagtcaaaataccagggcttgatcatttcaaagatgaatactgtcagttatggaaggtacatcagcagaatcagctctgctaactttcttgcttgacctactgatggtttaggaaaaagccttctcgagttttccagatactgttagaccaagaaggatgcattttaatcaaactgaacacaaaaggttgggtttggaggaaatgcaaccacaagagtgccttttaagaaataaaattgagaaatcatccttctaacatttcctccttccctcccctttatacagttcatagaaacaatgctccttttttttcctgtggagcacttcaaccccagcacaaaattaataaaagtggtaaaactggaactgctatcttagctacatccaccccaccccatcaccatgaagaataaaccctttaaatacaggctgccaggtacaagctaaagattgagataatgatcctttgcttcaaaataaacattttttaaaaatgagtattctagtctatatatctcattcatgaattaactctgtcacacttaaaactaccctgtttcttttaagatttgtaatgttacaggaaattttgtctagtttctcttcaggaaattataaaattataccacttttagcaacatttatgaattagttatttagaatatcagtcctcttgagctattttgtttaattaggtcacatatacaaatttgaaaattggaaatatcctagataaagatgtaagaattatatatgcagtattacaggatagatttctagaaaggggttctagtgagcagtagcttttgactaataatgtttaactagggcataaggaatttgaattcccagaactgctttttactgtggccaaaattcaaaataatttttatttttgtgaaataatttttcttcaactacaaggaagagaaaggaaaaaaactaaaatatgtattttattttaaaatacattatttaaaataattattttattttacaatacattatttaaaatatattatttaaaataattattattttattttaaaatgcattattttaatcacaaaaactaaaataatgtatctggctctattttgattttgctaaaatcacaaaaactaaaataatgtatctagctgtattaggataatatgatcaatcattcaagagaaactggtctcgttcttgcaagtgtaaggaccaaaaggtaaatatatttagcacatggtttggttctatttatcatcactaatgttctcattttccaaatggaaggataaaaatgataacttacccaaagcagtgaagcagatgtgggactgtttaatctcagctcttcctttaaattgctctatagtcacagaaatcacttctctgttctttagtctattaacagataacatcttgcctattgctgtaatccaaagccatatcccttcagcatcttcataatcattactagatgctttaaatccacatatttcaaataccttcattctcccatcttatctgctcatgtttatgcaggcacctagtagctgttgaaacaggataacactgtggctaaaagcatgtgcttttagaacccctgggttcaaatcccagccctagaacttcttaacctctgtgagcctccatttctttgtctgtaaaacaggaataatcattgtgctaaaacatagatgggatcgttgttggtttagaagctaggaatcaaatcagtatatacatgtgaagaaattttgtatgttaacctctatgagttctgtattaaaaataatttttaataaaacatgttaaaaataatgaatttttgaaaattaccttgcctgcagcaggtaccacagcaggtgtaccacttcatgacggccacccactgggatagctgtaatcagacagatggacaataacaagtgttggcaaggaagtggagaaactgcaaccttaatacactgctggtgggaatgtaatatggtgcatccatgttgggaaacagtcttgcaattccttaaaagtttaaacacagaattacagtattcatcaattctcctaggtaaatatccaaggaaaaaaacatacgtttatgtcacagaaagacttgtacacaaatgtttacagcagcattattcataatatcccaaaagtagaaacaacctaaagttcactgactgatgagtagaaaataatacgtgatacatccatagagtagactattgttcagccgtaaaaaggaacagagtactgataacatgctacaacatgaatgaaccttggaaacatcattctaagggaaagaaaccagacacaaaaggctgcatattgtatgattccatttatatgcaaggtcaagattagtcatacagagatggaaagtagattggtgattgcctaaggctggggagagcaaggggattgggcaagatggctaaagttgatggctatgggatatcttttggcagtgataaaaatgtgctaaaatttattgtggtaacggtggcacaactctgaatatgcaaaaaaaattgaaatactttatttaaatgggtgaattataaggcacatgaattgtatctcaatatagctgttaaaaataataataaagtggcagacttctaaggaatttcggtaaccttctaaacttaaaagtttttagacaagagatcaatagacatctgttaattaccccatcacagatatgccaaccaatccctaggctttgacttcccagtagcttttgtttgggaatttaccttgcctacagtagcagtcttcctgtgggtaaaaacaagaaacttcaaccctggtctttgtttaatagttaggtttttttctaattctaaaatatgtacagattgggaaaaacccagaaaaaatatgagttcaaagcataaattaaagacataaattatcctgtgatctgcgagcagtatccctccctggctccttttcaggttggaaaatctgattttagaacttaggttttagagaaccgagttcttacaccaagtacatacaaaaactgcatctttacaaaatcgtctctaaattgatcacttggacctgaagagctcatctttccaaaggcgatttccagtcttgtatggattggagaatgcccaaatgtactaatttttttatttttattttaaaaacacccccccccaccgccacttactttgtgctgccattagtgatctcccctaccctgccccacaatttacacaatgtttttcttcctatgttacctttggaccaggttatggtcttctttattatttatctagttccaatttccctagcctagacacagccctctgaaaataatggctgataagggaaatggtgcccggatctctaggcccggagccagttcactgggaatcatactctcccaaggctcttaatgtaggtctgacttgatgtgacaagtgaatatagtagcctattctttgttagaaaaaaaaatggattaattatttggctgaagtccgccaaacagaggttggcccttaaaggaacaaatacttcccgttgttttagatcgtccttcaagcaaggaactaaaataatgtaaatataactcagataaagagactctttacgcttctgtttgttcacaggggaaatgcttatttacaatgtgccttttaaaattattttcctgagttggtcttttggtcaaggaaattaaattgataacaagacgtgctgttgtccatagggaatccatttctacaaagacaaataactacaagcaatctcatcccattaactctgtggccactttctgcctcccccctctcaatatttgttacttcttttatcaatgattattttttcatgggaaggtgtcttcttttctcaaatggctataaatttttaagtatgtcccgtaaacatcttgtcatcccccacagtaccttaagtcaagtcttaaatatatcctgattaattatttgccaataggcataggtagcctttcttccttcagtattggcattagtagtctaattacttagtcttatggctttctcaagttaaaatcagaattacactgtctacagcaaagcagaaaatgtcatatctacagagcagcattttcagagcaccatcaaaacattaaacaggctgactaatgggatatgcctgttcatggtactagtctttcaagtcttttctgggtttgaaagttttcaaaatcaaaagatttttaagaaattaaacatctaatttcatctccagaacttagatgcaatattaatatctcttctatattcagcttttcagatgggttctttatttcaaaggatgctaatttatagcaaataactacatgttcctaaggacccaaaaccttttttctttactcttgctcattttatttttttttgtaaaattttttcacattgtgtttcagataggccctccccaaactttcataaattaatgagtattccacagacatggagtttttagtctagaagagttagattcaagaattaatgaaataatcacacaaacgcaaattttcagtaggaacaagtataatatgaatcaatagtagaaagatttgatccaataaggaaagtaaaggaagatttatctgagggaggcagtgggcgctaaccaggcaggaggcacagcatgtgcaaaggctcggtggcaggcagcagcaacacagtgtgaggttgattacaagaagacctatgaatttggagcccaaagaggaagatagttcaagatgagagcttgaaggaatgggtagaaattttttcttctcatcctggaagcaaagggaatctactgaaagatctttaaaaacaagaagctgttataatcagacctaaacttagacaagattacttcatttgtgctgtggagaactcactggaaggcatccaataggcagatcagtcagaaaggttttgcagtagactaagcaagagacataggcaatttggtcattttggtagaaagaagtgaattaattcatgaagtatttataaaataaaagtgttaggcaatgttacagttcaagtttcagtggggaatcagatagaattgaatgattcaaggaatctttaaaagagaaagtcatcagaaattggcagtgcattagaaatgaaaagaggaaagggaggtcgtaagagttaaagaggaaggaaacacgaaacacagctggcaattaaagacaggttttctttagttaaaacctgagaggaggccaggtgccgtggctcacgcctgtaatcccagcactttgggaggccaaggcgggtggatcacttaagatcaggagttcgagaccagcctgaccaacatagtgaaacctcgtctctactaaaaatgcaaaaattagccgggtatgctggcacgtgcctgtgatcccagttacctgggagactgaagcaggagaattgcttgaacccgggaggcggagattgcagtcagctgagatcgctccgctgcactccagcctgagcagagaagcgagactccattaaaaacaaaaaacaaacaaacaaaaaaaactgagaggggctcctagccaatgcggtcaggagcactttctcttacagactaagagtatatatttgttttagggtgagggggcttgtcacaagcttggaatgtttctgtgtgtggagaagttcatggcagggttggaatctctctgggtggaggattattttggggcagacatctttccagcccagaggtgggttatcttaggctagcatcttcccgccccaagggggctttatctcggggctagaatgtctctgggaagggaggagtttggaatgtttctggttggaaatgttatttgtggtttacggtcatgctgaccttagccattaggctgatgccttttggatttaggcagttttttattaaggtgaactttagaataagaggcttatccaagatgatgatgctcctgctctgtcagaggtgtcaaggatgacaccgggtcatataaatcatgctaataatgtgcacgtcagcacattaaaggctctgaggagtcctacagcaaagtaacctggctagctatctaatccagcatttccccaaattatttgaacctagattacccttttctttttctggcaacaattactaacttcctcaaaatatacatgagacaactgagttagcctaagatgggctttttttatttaaaacaatttcaaattttttcacatttttgtttgaaaccctgtgttagtcggctagggccgggtggatcacgaggtcaagagatcaagactatcctggccaacattgtgaaaccctgtctctactaaaaaaaaaatacaaaccttagctggacatgatggcgtgcacctgtagtcccagctacttgggaggctgacgcaggagaatcgcttgaacccaggaggtggaggctgcagtgagccaagatcgcaccactgcactccagcctaggcaacagagcaagacctgtctccaaaaaaaaaaaaaaaaaaaaaaaaaaaaaaaaaaaagaagtccaagatcaaggtatcagcaggtttggattctcctgaggcctctctccttggcttgcagatggccacccttttgccgactcttcacatggttatccctcatactgtgtgttgtctgcatgttctaatctcctctttttataaagacatcaggttggtttaagacctatcctaatggctttgttttactttcatttcctctttgaaggctctatcctcaaatacatttactttctaaggagctgcagattagggctgtgatatggtttggctgtgtcgccacccaaatgtcatcttgaattgtagttcccataatccccacgtgtcatggaaaggacccggtggcaggtaatttaatcatgggggcagtttcccttatgctattctcataatagtgagtaagttctcatgagatctgatggttttataaggggtttccccctttgcttggctctcattcgccttccttctgccatgtgaggaaggaaatgtttactttcctttctgccatgattgtaagtttctggaggcttccccagccaagctgaactgtgagtccattaaatctctttctctttgtaaattacccatctttggtatgtctttattagcagtgttagaataaactaatacagcaaattgatacggggtagtgaggtactgctgtaaagatactaaaaaatgtggaagcaactttggaactgggtaacaggcagacgttggaacagtttggagggctcaggagaagacagaaaaatgtgggaaagttgggaacttcctagagatttgttgaatggctttggtcaaaatgctgttaatgatatggataataaagtccaggccgaggtggtttccaatggagatgaagaacttgttgggaactggagtaaaggtcactcttgctatgcaaagagactggttgcattttgcccctgccctggagacctgtggaactttgaacttgaaagagataatttagagtatctggcagaagaaaattctaagcaggaaagcattcaagagaaagcagagcataaaagtttggaaaatttgcagcctggtgatgcaatagaaaagaaaaccctttttctggggagaaagtcaagccagctgcagaaatttgcataaataataaggagccaaatgttaatcaccaagacaatgaggacaatgtctgcaggccatgtcagagaccttaatggcagcccctcccatcataggcctgaaggtgtaggagggaaaattgttttcatgggctggacctgggcccaggctcacctgctctgtgcagcctcaggacatggtgccctgtatctcagctgcttagttccagccatggctaaaaggggccaacatacagcttagactgttgcttcagctggaatgagttaagactttgagggactattggaaaggcatgattgtgttttgaaatgtgaggacatgagatttgggaggggccaggggaagaatgatatggtttggctgtgtccccacccaaatctcatcccgaattgtagttcccataatccccatgtgtcatgggaggggcccagtgggagataattgaatcatgggggcagtttccccatgctattcttgtgatagtgagtaagttcttatgagatctgttggttttataaagggcttcccccttcacttggctctcattcttcttcctgacaccatgtgaagaaggacaagtttgcttccccttctttcatgattgtaagtttcccaaggccttcccagacaggctgaactgtgagtcaattaaacctcttttctttataaattacccagtctcggatatgtctttattagcagcgtgacaatggactaataaaggctgcaacatatgaattttgtggggacatcatttagcccatcaccaccctagaggcataaacctcttttctagagccagtgccatctttgttcctccacaccctacaccacaggcaaggtctggtggtccagtgtcatgaagagtcatcttatgtctccatcctcagcactcttcatggtgagtcccaatacatgctacggcaagatttctattacttagattcgctattagtaaacctgtaacataccaacaaggataaggaaaaaggagccaacagtattcctgatcacccctatacgcagatatcaaagatggaggtgttagtggaagagaggcagtgcttctggattttttttcctaatgatatgaaaccagcatttcaccttgaagcagaagagcacctaagtccaggtgaacaccactctgctctgcttccctgtgccagcagtccagaagtccagcatccacagagccaggtctcatctatgtgggctgggaggtgagcagtttgtgagatgcatgggaactaaagttcaaattcttacaccaccctccactcagaatgtaagtcatttgacttttctctgtttcttttcctgggaggatggctgagaggattatgttcatggatcattctgcttttaaaaacaaaactgaaacactcttcccacataaaagtaagatcttcactcatcccattaccagctgactagtaaagtaatggtatggtctgaatgtctgtgtctgcccgaaatttatatgttgaaatcctaacccacaagatgatggtattgggagtgtattagttcatttacatgctgctgataaagatatacttgagactgggtaatttataaagaaaaagaggtttaatggactcaccgttccacatggctgtggttccacaatcacgacagaaggtgaaaggcacatcttacatggcagcaaagagagagaatgagaaccaagcaaaaagggaaaccccttataaaaccatcagatctcatgagacttattcactaccacgagaacagtattggggaaaccatccccatgattcaattacctcccacggggttcctcccacaacacatgggaattatgggagctacaattcaagatgagatttgggtgaggacacagccaaaccatatcaaggagatagggcctttgtggggagcatatcatgatatgccagctcccctttgccttcccttatgattatcagcttcctgaggccctccccagaagcagatgctggaaccatgcttctaacagcctgcggaactgtgagctaattacatctcttttctgtataaattaccaagactccagtatttctttatagcaatgaaaaaatggcctcataaaagagacctcagagagttagctagccccttccaccatgtgaggacacaatgagaaggcaccatctgtaaaccagagagtaagagctcaccagacatcagatctgctgatactttgatcttggacttcccaacctccataactgtgaggaataaatttgtcttgttcatcagccacccagtttatggtattttgttaaagtagcctgaacagattaagaaaagtggttagagagtcaaaacagtatggatgtgttatatccacaactcataaattcaatctaagaagtgaatattttatttattatgttgcatgctattttatattctgtattctccactagccccaaagtgattggaactttgacttcaggtttcctatgtttctagtttcagctagtcttttaaatatcatcacatgatctttattggagttaagtcccaaatgaataacaaaccaatgaaaacttcctgcttgttttctgatcaggtattgtttatgttaaggaaggtgctatggtttgcatgtgtcccccaaagttcatgagttagacacttaatccccagagccacagtgttgagaggtggggcctttaggaagtcattaggtcatgaaagctctgccctcatgaatgaattaatgccattatcttgggagtgggttcgttatcttgggatttctgataaagggatgagtttggctcccttcccttctctgtcacaggtgctctcttgcccttccaccttcccccatggaatgacacagcaagaaggccctcatcagatgggggccccttgaccttgacttcccagcctccagaactttaagaaataaatctctggtctttataaatgacccagtctcaggtattctgttgtagcagcacaaacaaagacaggaagagccagaatttttttttttcctcttaaatcctattaagcctcagaatctgcatactgctttttggaacctgaataccaccaattgagtcattttatgaaatgtgtccactgtcttattctaacataatggtcaaaagatgtttagtttgcatgtcagtcagctacttcccaagaagatattgtttgacctggcttttctacaagctcactgtcctgtcctaatagcaggacagggatccatgaaaatagaaggaactgagcagatttccctgaacttggtaggcatgggttattacagctagtctagctctggcaggttccccctgtacatagccagtagttaagcaccgtatcatgaatcaggtttgaattatcgcctctattcatagcacagaataagttaatttgagacggatatgtctttgttcaaggtagacttattgccttattttttcctagtagatatttactaaactcatatgttctttctagtgctgccacgtctataccattgctcctgaaatcttagttcaaatccaacttctgccactttagcaccttgtcattttatccatctaagctgaaattcaaagcctctaactcctactcttaggtgaagatttttttttccctgatctcttctcacatgtgagactttgtgggtatcaggagccatggggactaggcagcctggtaattacattgtttacttcctagtttcacacaaaaccaagtcaatcctgggcctgccaccaagcaccctttagggaaatatatttcaaaaagcttcactgaaaccacttatttattgacattcagagacagttaatcattctgccgagcaagaaacacttagaccaaacaagaaacagcccaacctttcaagcaccgagcctttgtcaaaggtttattgagaaaagaaaggcacaaaagaaccagcgttgccaaactcgggcagccattgtcaaccctttgccaagtgatagtatcatatggcatcagacatgagcttaagaaagagaaaaaaggaggaaggaataagctttctttccatatataaatcagattgaagttactgttcctttttgggactttcagtgtttatcctctttctggaatatattttccttcttcttgcttcagctcaccatccccaaaacatacacatgcacacacatgcacattgtcccataccttcataatatatttgaatgatacagtctgctaaaattactgtcacagacattatcttcatcttggacacctgtttgttctagttcctggctgcctggaagttctgaaaacgtgactcagcctagagctttttgttaaaccataaggaaagctactaatttctctacacagagatagcatgtataaagtaatcaccactgtgatccagaaatggtgatgtctacactgggagtgattgatggtggttattactggggtggagatggtacgagtgacatcttaagatacatttattaaaatgggccaagaaccacatgaaatgctttgcttgttttgaagtaggtttctttgcccaaaggttaaggaaatatttcaaaaaggcaaaaagagattgacccccacacactctcttattttctgtatgaacattttcaagctacagaaaagttgaaagaattgtacatgaactacactcaccacctgaaatctacaactaaaatttttcatatttgcctgatcacatatgtaaccatctaaccatccctctatcaagtaatgtatctttttatttaactgtatttcagagcaagttgcaaacatcagttcatttcaccccagcacttcaatatgcattgcattaactgtaagttttttttatggttatcttctttcccttcttcatcctaccctggtataatttacatacagtgaaatatacaaatttaagtgtattatttgggagttttaactgtataactcaaatttccatcaagatatatagaaaacattatcattacccaggaaaaccctcttgctgtttccaatcaatccttgtccccagccccatggagtcaatgactgttctaatttttaaaaatcaccacagattaatttagcctgttcaaaacttcatattcatgaatcatacatttatatcacacatttgtatgattacatatatacatatgtcctcctttgtgtaaggcttcttttactcagcctggttttgtgttttgttgatgttgcatgtttctttttcttttttattgctcagtagtataatattttattgctcattcttttttattgcttagtagtatttcattgtatgactacaccacagtgttttttactattgttggacatttggattatttcagtttggggctattatgaataaagctaatatcaagactcctgtaccagtctttatgtgcacttttgtgtaaatatctaggagtggaaaattgctaggtcatagagttgttccatagccttcacatccaggccctgttgggcttaaattttcttggaagagcaatttccaaatcctttcaagtccagaatatttttttcacacagcaatagtaaaataagacaataatagttaatttttaggtccaaaatgtatttattttccatatgcttaaaggcagtgtatttcctaaaagactagtttcaaaccagtgtattaagacacattggcatatgaattagtgggagaatcaagatttggaacattgtaggcaactcgagcttgtcacatgatagctggtggccccacagtcatgccatgtgataaatccatgtaggcaacaacaacaaaaaaacccaaacggcctgcattctgcctcttgacatccacaaagcacttggatattggaacactgctaacaaaaacctgtgggtctacataggcttgccaacagaagcagcagaagtagccagagtataacctctgccttacttccttctacctttctcttcttgcattctactgtctgaatctaagtcagtgtgggaactctcctgccagagcacctgggaaatctggatgaagataccagcatcagtctaccttattcctcacctatctcccctcccatgctcacaaatcctgttccatcacctctggcctgctgatagaccttcttcaagtgattatctccccgctttcctccgtctttaacctctaccttttcttccatctcctatcaacataacctaacaacttgactcttccagtgtaaacctcccttagtcctccagttgacccttgaacaacacaggttcaaatgcatgggtccacttataagtgggtttttttcaaccaaacccatttaaaaaacacagtgttactaggatgtgaaacccacgtatataccaaaggccagcttctcctaagcggtttcctaagtggttcctcaggccacctgtgataattgagtatgcatggattttggtatacgcagaggtcctggaagattgccggggcttaggggaagaaggaaatggggattgctgttcaatgggtataaagtttcaattatgcaagatgaataagttctagaaatctgctgtataatatgatgtctgtagttaacaatactgtattgtgcacttaaaatttaagaatgtagatctcctgttaagtgctcttactacaaggaaataaaagtcatgtataagaaattctataatttttcatacactaaattcttatgtatgctatggtctcattttgggggaaggagagaaagatttgctctatatcattgttatgtctctgtttttttgccctagcttttggggagattttagccatagatagcttaccaccctaaaatagcacattcctaggatgatagtcttcttaattaatttttcaaatgtgaattacacatacaataatataacattccacttcatatagtcatttaattataaaagttttagcataaacacaaaaattagaaaaataaggttacatttttgggtgagagaattgtgggtgactctgaggtatggttctgcaacttatgtaaggagcacaccaatgtatttttctgtctttaatgcaaaaagtatttattgagcaccttctctgtgtgccagttgttgttgaagacctgggatgacaaaaaataaataagtttccctaaaccaatgattagactccttgacttgacactagcagggtttttccagcacagataaatctggcaagcaaaggaaagctttagtgtcagatccaaaatgttagtgcaaatgaatgtaacctgagattgtcctaaatgggattgctgtagccaacgcataatatgttctttgaccttctgagattgactgaaccaaatttgtcatgagaaattgtctcctcttagatctcctatcattcttaacactagattacataacttaaaaaaaaagaaaagaaagaggatagaaaaaaagagtgtcatgaatcaatctaagattcttgtgaatcaaattatattctttgtatctatttttagagaaggtaattgaaactcaattttcagcactgtatactcagttttcattgctctcctgtatgttaatgcataattctcataacaaccatatggaataggtattaatatcccccaatttatgggtgaggaaccataggaatagattaactgacttacacaaagtcgtaaagttagtaacaggaggtttgaacccagcaatcttaatcaacccggcatttttctcttaaatgtagagaccccttcccctactttcatattggtatttttaaaagactagactcatgttcttccttttcatgtactagaaacgtgtaggagtgacttggccaatgctaccaagaagagcgttgactttaatgcaaacgtctacccgcgtttgtagtagtttcctttctttgtcccctgccaggttctcaagcagagcttaactcatggagacaggtaaatattaacttttaggtcagcatcaccatacgtcacacacaagagtctaaacagaagggtactttggtctctcccggcttctcctctcacctggacagaggaagatagaaatgcagcctcctttgtttctctaaaaatcagaagatggctttgccaccttcatttgatgggatcagattgtgtttttgcatgtgtgtgtataatacataccaaattttaatgatcaaaataatcaggggactctactcccagttaccagatttctgtgtgtttgtgttcaaaagtacagacacatgtacaaagaaatacaataaacaaatgtagagttcaagggacattagaaattagtacaattctatttatcaaaagggaaagggagtacccccaaaattgtttaccaaaatcacatagattctattttgataaagtctttactttttagctctatttatactattacactttaaatcattttttaaattttatcaaagttatatactagaatataaagagcctgcagatttcataaggttccttaaggaaaagagcagtcctcagccagccagcctacttccaatccaccttcctcaaaccactttccactctttgcctggtatttacttcctgacaccttaatgtcaagtgttcctcctgatttttttacttgggatattgtacattgactttccgctatggaagatgatggcttagctctttattctctctgtccacaccacaggcagttaattcccatcctcatgatataattatatctcgatttcaattagaaaaatattcaatttacattattcacattattatgactatatgtgatattcagaaatggggcatatgctcaactatatttttgtgggaacacaatatccctggagttagtttttttacttgtttgtatggttttatctgtttttcttgtgcatttttttaacgtacttagctttcattaataatatttgccaattgttaatattctttcaagatgttcagtgagtccagcagtttcctaccaggtaccttatcaattcttatcaggtatcttatcctatgttgtaaaatttcacaatgatatcccttggtgtgagtttatttccatctactgggcactcagtggtcctttgaatctagaaaatctaccctccagtttgggggaattttcttgaattattttcttgatgttttcttctgtgggtttttattttgttttatttcactttctagatcttctagaattattggattatctgcctttatctgtcctcttatccatttatttgttttttcactctaatttctttattttaatttacattcctttgatggaggtttttatataatgctatcatgtttttcctttctaagaggtccttttttattctctgaatggcctttttgtagaagcattattttcttgcttcattaagcaaatatggacacaggtctatatttttatctttgtgaattattttttcttttttttttctttaggtggagtcttgctctttctaccaggctggagtgcagtggcgtgatcttggttcactgcaacctccgcctcccaggttcaagtgattctcctacctcagcctcccaagtagctgggattacaggtgtgcgccaccactgaattttttaacaatcatctttaaatttttcttttacctccatagtttctggtccctccagattgtttttggctttccccggctacctgatagtcattggcgttctgctcatatataagagcaagggactaaaactgaaattctgaacatcttctgagacaggagcatggcatctggtctgaggaggtgctcagcctcactgatggtgattctcactggaatgatctggctgagccagttgttagggagcttccaatgtcagtgtcttcaggtacttctgcatagttggttggatcctgtaacaaagctcttccaaacacttgcctggaaggtatggaccttgctgccaggaggtgaaggatgaaggtgaaaaggagacttgggtaatctccctatgcttcgggcatatttacttaatcctcctatcttacatagtatcccacgttggatatgcctggtacatctcccaattcagaaaccttctggtttggccctcaccaaaggataaacttccagacttctgctgaggtagagcaggtgtacttgcccaggtgactgcagtaagggaagactaagcatgtcagctgcttcttaaacacagttcagccactcctcattttggcctcagcctcctactctgcctgaggtacctgctgctgccaccgatcctagtgccttttgaagaccctctgctgtaaattggtgccactgccagccctggttcagctttctcaggtccactgagtgaccactcatctgcctacttcctagcttccaaaatgctgttactgtcatctctcctagttattgatatgtgtgtgtgtatgtgtgtatgtatgtatatgtgtatagatatatatatgtatatgcgtctatatatgtatatatgtatttatgtgtatatatgtagatgtatgtatgtatataccttaaatctgtaattattctgcttttaataagattcaggaagaggccaaacttgctgagtctgttcaatccactgtctttacctggtgtttcaccaagacacatttaaatagagacagtatttaccaacatatctacacagaggtccaacaacatgtaattatctgttctaattcatggtgaattacagtatttaataatattttttaaaattatcataaaaagctaattcatttgtgaacacaaatttttcttaattcccacttcatgacgtattagttttatgatcacgttaggcttactccacaaacatttattggtatctgctttatccatggagtcacagcaggtgatagaggatttgtaaccctctcccctttccctgccactccactgagaagcagatatcatggcatgaatgattaaataggagactatatttcatttataaaatggcttaggaacttttacagatgaaagaaactgttcttgaaactgccaataatatcaggaaagtgaatactaggtcttatttgttctttttaatgattttttcatacccattaaccattctcacccccacctccccatcctccatggccccactacccttctcagcctctggtaaccatccttctactctctgtgtccatgagtagtttagatttttagctcccacaaataggtgacgacatgtgaagtttgtctttctgtgcgtggcttatttcacttaaaataatgatctccagttccatccctgttgttgcaaatgacaggatctcattcttttatggctgaatagtattttgttatgtttatgtaccacattttctttatccattcatctgttgatggaaacttaggtcgcttccaaatcatagctgttgtgaatagtgctgcaataaacatgggaaattaggtatctctttgatatcctaatttcctttctttggggtatataactagcagtgggattgctggattgcacggtagctctatttttaggtttgtttgtttaacttttattttaagtacatgtagaggtttgttatatgcaggtaaagtggtgtcatgggggtttgttgtacagattattttgtcacccagatattaagcctggtacccattagttatttttcctgatcctcccttctaccctgcaccctccagtagtcctccatgtctgtttttgctctctatgtatccatgcattctcatcatttagctcccacttataagtgataacatgcaatatttggttttctgttcctgtgttagtttgctaagggtgatgccctccagctccatgatccttcaaaggacatgatattgttcctttttacacttgcataatattccatagtgtatatgtaccaattttctttatccagtctgccactgatgggcatttaggttgattccatgtctttgctattatgaacagtgctgcagtgaacatatgtgtgcatatgtctttatgatagaacgatttatattcctttgggtatatacccagtaatgggactcctgggtcgattggtagttctgtttttaggtctttgaggaattgccacactgttttccacaatggctgaactaatttacactcctatcaacagtgtataagccttcgcttttctccgcaacctcaccagcacctgtcatttttttgacttttaataatagccattctgactggtgcaagatggtatctcattatggttttgatttgcatttctttaatgatcagtaatattgggctttttttcatatgtttgttgggtgaacatatgtcttctttgaaaagtgtctgttcagcaacctacagaatgggagaaaatttttgcaatctatcgatctgacaaagggctaatatccagaatctatagagagcttaaacaaatttacaagaaaaaaaaaaccccatcaaaaagtgggcaaaggatatgaacagacacttctcaaaagagaacattcatgcggccaacaaacatatgaaaaaaagctcatcgtcactggtcattagagaaatgcaaatcaaaatcacaatgagataccatctcacgccagttagaatggcgatcattcttaaaaagtcaggaaataacagaagctggagaggatgtggagaaataggaacacttttacactgttggtgggagtgtaaattagttcagccattgtagaagacagtatggagattcctcaaggatctagaaccagaaatagcatttgacccagcaatcccattactgggtatatacccaaaggattataaatcattctataaatacacatgcacatatatgtttattgcactgacttggaaccaacccaaatgtccatcagtgatagactggataaaaaatatagcacatatacaccatggaatactacgcagccctaaaaaagatgagttcatgtcctttgcagggacatggatgaagctggaaaccatcattctcagcaaactaacacagaaacagaaaaccaaacaccacatgttctcactcataagtgggagttcaacagttagaacacacggacacagggaggggaacatcacacaccgggcctatcggggttgggggcaaggggagggatagcattaggagaaatatctaaagtagatgatgggttgatgggtgcagcaaaccaccatggcaagtgtatacctatgtaacaaacctgcacattctgcacatgtatcccagaacttaaagtataatttaagaaaaaaaaaagtgtctgttcatgtcctctgccaactttttaatggggttgtttatttttctttttttcttgtagatttaagttccttatagatgctgaatgttagacctttgtcagatgcattgtcagatgcatagttggcaaaaaaattttttttacctggtgttctatagacaatccataacctatagacaaccattctatagattgtctgcttactctgctgatagtttctttagctgtgcagaagctcttttgtttaattagacttcatttgtcaacctttgcttttgttgcgattacttttggcatcttccttataaaatctttgcctgttcctatgtccaaaatggtattgcctaggttgtctttagggtttttatagttttgagttttacatttaagtcttcaatcccatttgagttgatttttgtatgtggcataaggaattttctgcatatggcaagccagttttcccatcaccatttattgactagggaatcctttccccattgcatgtttttgtcagctttatcaaagatcatatggttgtaggtggatggccttatttctgggctatgtattctgttccattggtctgtgtgtctgcttttgtaccagtaccatgctgttttggttattgtagccctttagtagagtttgactttgggtagcgtgattcctccaggtttgttctttttgcataggattgccttggccatttgggctctttttgggttccacatgaattttaaaatagttttttctagttctgtgaagaatgtcattggtagtttgacaggaatagcattgaatctataaattgctttggacagtatggccattttattggttcttcctatccatgagcatggaatgtttttccatttgtttgtgtaatctctgatttctctgagcagttttttatagttttcattgtagagatctttcacctccctgatcatctgtattcctaggtattttattctttttgtggccgttgtgaatgggagttcatttctgatttggctcttggtttgatggttgttggtgtataggaatactagtgattttttttattttatttttccataagttattggggtacaagtggtatttggttacatgagtaagttctttagtggtgatttgtgagatcctggtgcacccatcacctgagcagtatactctgcaccacaaatattatcttttatccctcattctgtcccactcttccctccaagtccccaaagtccattgtatcattcttatgcctttgggtcctcatagcttagctcccacatatcactgagaacatatgatgtttggttttacattcctgagttacttcacttagaatactagtctccagtctcatccaggtcatcacaaatgctgttaatttattcctttttatggttgggtactattccatcatatatatatataccacagtttccttatccactcgttgattgatgggcatttgggttggttccacgattttgcaattgtgaattgtgttgctataaacatgcgtgtgcaagtatctttttcgaataatgacttcttttctactgggtagatacccagtagtgggattgctggatcaaataaactagtttacattcccaccagcagtgtagaggtgttccctgatcgctgcatccatgccaacatctactgttttttatttttttgattgtagccattcttgcaggagtaaggtggtatcgcattgtggctttgatttgcatttgcctgatcattggtgatgttgagcattttttcatgtgtttgttggccatttgtatatcttcttttgagaattgtctattcatgtccttagcccactttttgatgggattgtttgtttttttcttactgatttgtttgagttcactgtagattctggatgttagtccttttcagatatatagattgtgaagattttctcccactctgtgggttgtctgtttactctgctgactgttccttttgccatgcaaaagctgtttagtttaattaggtcacagctatttatctttgttgttattgcattagcttttgggtttttggtcacgaaatccttgcctaagccaatgtctagaagggtttttgtctagacattgtctagacaatgtctagaatattatgttctagaatttttatagtttcaggtcttaggtttaagtccttcatcatccatcttgagttgatttttgtataaggttagagatgaagatccagtgtcatcctcctacatgtggctagccaattatccaagcaccatttgttgaaagggagtcctttccccattttatgtttttgtttgccttgtcaaagatcagttggctataagtatttgggtttatttatgggatctctattctgttccactggtctatgtgcctgtttttataccagtaccatgctgttttggtgactatggccttatagtttcaaatcaagtagtgtgatgcctccagatttgttatttttgcttagtcttgctttggctgtgtgggatctcttttggttccatatgaattttagaattgttttttctaactctgtgaagaatgatgatggtattttggtggggattgcattgaatttgtagattgcttttggcagtatggtcatttccataatattgatcctatccatccatgagcacgggatatgttttcatttgtttgtgttgtctatgatttctttcagcagtgttttgtagttttccttacaaatgtcttttgactcctttgttaggtatattcctaaatattttattttttgcagctatcgtttgttgattttgtatcctgacagtttgctgaagttgtttatcagcttaaggagcttttggactgagactgtggggttttctagatatagaagcatgccatttgcaaacagggatagtttgaccttcttcctatttggatactctttatttctctcttccctgattgctctggccaggatttccaatattatgttgaatatgagtggtgagagaagacatccttgtcttgtgccagtttccaaggggaatgcttccagcttttgcccatttggtacaatgttggttgtggatttgtaatagatggctcttattattttgaagtatgttccttcaatgcctagtttattgagagtttttaaaatgaaggggcgttgaattttatcaaaagccatttcagcatctattgagaggatcatattgtttttgtctttagttctgtttatgtgatgaatcacatttattgaattgcatatgttgaaccaaccttgcatcccagggataaagcctacttggtcatggtgcataagctttttgctatgctgctggattgggtttgccagtattttgttgaggatttttacaccagtgtttaccaaagatattggcctgaagtttttttttgttgagcctctgccagcttttggtagcaggatgatgctggcctcatagaatgaattagggaggagtccctttggaatagtttcagtaggaatgctaccagctcttctttgtacatctcataaaattcgtctgtgaatctgtctggtcctgggctttttctcattggtaggctatatatttctgattcaattttggagctcattggccttttaagggattcaatttcttcctggttcagtcttgagaggctgtgtccaggaatttatcaatttcttttagattttctagttcgtgtacatagaggtgttcataatattctctgatggttattttatttctgtgtggtcagtggtaatatcccattgtcttttctatttatgtatatttgtgtcttctctcttttttcatttttagtctagctactggtctgtgtattttattatttttttcaaaaaaacacacttctagattcattgacattttgaatggtttttcatctctcaatcttcttcagttcagctttgattttggttatttcttgtcttctgctacctttgaggttactttgctcttgattttctggttctttcagttgtgatgttaagttgttaaactgaggtcttcctaacttttttttttttttttttttttgagatggagtctctctctgtcacccagacttgagtccagtggcacgatctcggctcactgcaagctccgcttcctgggttcatgccattctcctgcctcagcctcccgagtagctgggactataggcgcccgccaccatgcccggctaattttttttgcatttttagtagagacagggtttcactgtgttagccaggatggtcttgatctgctgacctcgtgatctgtccgcctcagcctcccaaagtgctgggattacaggtgtgagccaccgtgcccagccaagtctttctaactttttgatgtaagtgtttagtgctgtaaatttccctcttaacactgccttagcagtatgcctgagattctggtacgttgtatctttgttctcatcagtttcaaagagcttcttgatttctgccttagtttcattacttacccaaaagtccttcaggagcaggttattcagtttccatgtaattatatgattttgagtgaatttctcagtcttgatctctaattttattgtgttatggtctgagagagtagttgttatgatttcagttattttgcacttgctgaagggtgtttcatatctgattatgtgattgattttagagtatgtgccatgtggcaatgagaggaatgtatattctgttgtttggtggtggagagttctgtagatatttatcaggcccatttgatccagtgctgagttcaggtcccaaattatctttgttaattttctgccttgatggtctgtctgatactgtcagtggggtattgaagtctcccagtattattgtgtgggaatctaagtctatttgaatgtccttaagaacttgctttatgaatctgggttctccgatgttgtgtgtccatatatttaggatagtttcttgttgaattgaaccctttaccattatgtaatgcccttctttgtctttttaaatctttcttgttttaaaatctgtttggcctgaaattaggactgcagccccttatttttttctgttttcatttgcttggtagatttttctccatccctttattttgagcctatgagtgtcgttacatgtcagatgggtctcttgaagacagtataccactgggtcttgcttccttctccagcttgccactctgtgccttttaattggggcatttagcccatttacattcaagattagtattcatatgtgaggatttgatcctgtcatcatgatgtcagccagttattatgtgatttgtttgtgtggttgctttatagcaggggtccccaacccacaggccatggatcagtactggtccatggcctgttaggaaccgggccacacagcaggaagtgagtggtgggcaggtgagcgagcattaccacctgagctccacctcctgtcagaccaacaggggcatcagattctcataagagtgtgaaccttattgtgaactacacatgcgagggatctaggttgtgtgctccttttgagaatctaactaatgcctgataacgtgaggtggaacagtttcatcccaaaaccatccctcacccctggttgtggaaaaattgtcttccacaaaaacagtcctttgtgccaaaaaggttggggttttatagtgtcactggtctgtgtactgaagtgtgtttctgtagtagctggtaatggtctttcctttacatatttagtatttccttcaggaactcttgtaaggcaggactggtggtaacaaattccctcagcattgcttgtctgaaaaaggtttcaatgtactcctgcatctcagtgatcttcattcctatccatatcctgaattctatttctgtcatttcagccatctcagcccagttcagaatccttgctggagaggtaatgtcatttggaggatagaaggcactctggttttttgagttgtcagagttcttgcagtggttctttctcatctttgtggggtggtgtttcctcaagctttgaagttgctgtttttgatgaccttgagggtttgactgtggtataaggtaggtttagtcaattggtttcatttctggaaggttttaggaggccaacactcagctcccatctcctagactgcatgccctaagggattcgtatcagaccccaactttgttctctggctcctcaacattaggaaaccactgggctgagggagacaaggtgtgcttggaccactaggcactacactctgatgggtggtgccagccaaagcctttcatagggtgatggcagcaggctccatcctcattcacacatgccagcatcagggacggcggcagtgcaacggggtgcatgacgcatgcctgtcgctatggtaggtgcaagcgggtgccgggggcctgcctccatgcaagtgttcacagcagtggcagaggcagcatggctcaggaaggtggaggccccccagttggcaactgtgcacacagttgtgctggtggtagtgttagcacgtgggtagggtgctggtggatgcaggtctgtgtgtgccctctgtggctactcagagttgggaagtctccagtgttttccactaccactctggtggtagtgttgatgcaggcacagggtgctggtgggggtggcaggccctgtgctcaccaaggctctaactgaaatggcaatacagcaggggatgggtggcagagtgcacttctgccagcaacagaggcagcacagggtgcgtgcgcacatgggtgctagcagggcaagaaaggcaaaatctaccctcatattcacgtaccgacacagcaatgtaagggggctacgggccagggagatgctgcagctgcaggagggagtaggcaggctggtgtgtagtcatgggtgcttccttgctggagctctctaccagtcaggcatggtccaccaacacaggagctatgatgcggcaccctagggcacccagggctgtattgcaagcagttatggccaggatgggaccccaagagaggccaggagaccaaggattgctgaggtcggactggccctgtctgatgggcaagaccaccctaaagagttcaggtccaacagtttccctagggctaaagtctcctatggaagcaagttgagcctggggaatgggcgtccctggccatactccactacagatgctcccacaccaaacactctgggctctgcatagctggtatgctgcccctaccacttctcttagcagctctccctgccaactgtagtgtctgtgatggccaaggggtctcctcctgccaggattccagaggcccattgtgagagcagattgctccttgccagttcaagtcactcattcccccagagtcattggaagccaggaaggagtcacagtgaggagttaccctgggcagaactctcagcttcctcccacctcagcttggcttcagtgtcttccttccaggcaccctcagtgccttccctctgaagctctgttaggagtgtgcccatcatcccagtccctcagtgacagctgttccacctgactgcatcaagtcagccatctcaccccaagccagcactgctaccccaccatctgccagggaatcctcagattctgggagcaacacacaccacctatttttagtttgttggggaacttccaaactgttccttatagtggttgtactagtttacattcctaccaacagcatactgatctccacatcctcaccagtatttgttattgcctctttttgatgaaagccattctaactggggtgagatgatatctcattgtgtttttgatttgcatttctctgatgatcaatgatgttgagcaccttttcatgtacctgtttctcatttgtatgtcttcttttgagaaatgtttgagatcttttgccgattttttaatcgaattcttagatttatttttttcctatggagttgtttcagcttcttatagtttctggttattaatcccttgccagatggggtagtttgcaaatatgttattctattctgtgggttgtctcttccctttgttgattatttcctttgctgtgcaaaagctttttaacttaatgtgatcccatttgtccatttttgctttgcttgcctgtgcttctgaggtattactttgtccagtccaatgtcctagagagtttccccaatgttttcttatagtagtttcacagtttgaggtcttagatttaaggctttgatccattttgatttgatttttgtatatggcaagagataggggtcttgtttcattcttttgcatatggctatccggttttccaagtaccattcattgccaacgtacactcttggcaactttatcaaaaatgagttcaatataggtgtatggatttatttctgggttctctattctgatccactggtctatgtgtctcattttatgccactatcatgctgttttgtactatagctctatagcttaatttgaagttagggaatgtgattcctccagttttgttcttttttgctcaggatagccttggctactctaggtcttttgtggtcccatataaattaaaatttttttttttccatttctgtgaagaatatcataggtattttgataaggattgcattgaatctgtagattgcattgggtagtatggacattttatcaatattgattcaatccatgaatatggaatacctttccattttgtgtgtgtgtcgttttccatttctttcaccaatgttttatagttttcattgtagagctctttcacttctttggctaattcctaggtattttattttatgtgtagctgttgtaaataggattactttcttaatttctttttagattgttcaccgttggcacacagaaatactactgattttttatgttgattttgtatcctgtaactttactgaatttgtttatcagatctaatagtttttggtggagtctttaaatttttccaaatataagatcatattatcttcaaataaggataatttgacttcttcctttcaaatctggatgccctttatttctttatcttgcctaatttctctggttagaacttgcagtactatgctgaacaatagtggtgaaagtgggcatccttgtcatgttccagatcttagaggaaaggctttcagtttttccccattcagtatgataccagctgtagctctgttgtatatggattttattatgctgaagtacattccctcaatacccagtttcttaagggttttcatcattaagggatgttgaattttatcaaatgcttttttggcaccaattgaaatgattacatctgtccttcgttctgttgatatgatgtatcacattggttaatttgcacattttaaaccatccttgcatccctggaatatattacacttggtcatgaagaatgatctttttaatgtgttgttgaatttggtttgctagtatttctttgaggatttttgcaccaatatttatcagtgatatgggcctgtcattttttttgttttttgtttttgatgtgtctttgtctggttttggtatcagagtaatactggccttgtagaatgaatttggaagttgtattagtccattttcatgctgctgataaagacatacctgagactgggcaatttacaaaagaaacaggtttaatcaggcttacagttccacatggctggggaggcctcacaatcatggtggaaggcaaggaggagcaagtcacgtcttacatggatggtgggaggcaaagagagagcttgctcagggaaactcccccttatattaccatcagatctcatgagactcattcactgtcatgagaacagcatgggaaagacctgcccccatgattcagttatctcccactgggtcccttccacaacacatgggaattaaagatgagatttgggtgggaacacagccaaaccatatcagaagtattccctcctccactattttttggaatagtttgagtaggattgttattagttcttctttaaatgtttggtacaattacagtagtaaagccatcaagtccatggcatttctgccctgggatactttttattacaactttgatctcattaatcgttattggtctgttcaggttttggatttcttcatggcttaatcttagtagagtgtatgagtctaggaatttatccatatcttctagatgttttaattcattggcatatagttgctaatagtagccactaataatcctttgaatttctgcagtaacagttgtaatgtctcctttttcatctttaattttatttatttgggtcttctccctacttttcttagtctggctaaaggtttgtcgattttgtttaaattttcaaaaatcaactttttgttttgtttatcttttgtatttttttcacttcaacttcatttatttctggtctgatctttattatttcttctaattttggggtggtttgctcttgcttttccagttctttaagacatattgttagcttatttatttgatgtttttcttttttgttgatgtaggtactcatagctataaactttcctcaaagtattgctttcattgtatcctatagcttttggtctgttgtgtttccattatcatttgtttcaagaagttttcaattttcttctgtgaattacttcattgaaacactggtcattcaggagtgtattgttgaatttccatgtgtttgtatagtttccaaaattacttttttttttttttacctatttctaattttatttaattgtggttagggaagatgcttgatattatttccattatttagaatgttttaagacctgttttgtcacctaacgtatggtttatccttgagaatgatccttgtgctaaggaaaagaatgtatattctgcagccattcagtgacatgttctgtaaatatctattgattccatttggtctataatgcagataaagcctgatgtttctttattgattttctatgtggaagatctgtccaatgctgaaagtgggtggttgaagtccccagttattattgtattggagtctatccctctctttagctctaataatatttgctttatatatctgggtgcttcagtcctaggtgcatatatatttataattactgtatcctcttgctgagtcaactcctttattattacataatgacctttgttgtctcttcttatcatttttgtcttgagatctattttgtctgctatgagtatagctactctggctatttttttgtttccattaacatgaaatatctttttccattcctttattttcagtctatttgtgtctttataaaagaattgtatttcttataggcaacagataattggatcttggtttttatccattcagccaatcaatgtcttttgattggagagtttagttcattgatatccaatgttattattgataaggacttagttgtgccattttgttatttcttttctggttgtttgatggcctgctgtttcttcttttcttccttcctgtcttccatttagtgaagctgattttctcaggtggcattatttcttgatttttattttttgtgtatccattgtatgttttttgactttaggttaccatctggtttgcaaatactgtcttataacccattagtctaagctgataacaacactagcataaacaaactaacaaaaagaaaagtaaccctaactctatattttaactttgttccccactttttaacttttcattttttctacttatatattattgtgcagtctgtggcttgaatagttgttgtagttactatttttgattggttcatcttttagtctttctgtctaaaaaaacatagtttgtacaccacagttacagttttataatattctgtatttttctgtgtgcttatgattaccaattagttttataccttcagatgatttattattgctcattagcatccttttctttctgattgaaatactccctttagcctttcttgttgaacaggtctggtattcatggaatccctcagcttttgtttttctgggaaagtaattttatttcttcttcatgtttgaaggatatttttgctggatatactattccagcataaaagttttattccttgagcaccttaaacatgtcatgccctctctcctagcctgtgaagtttcctctgaaaagtctactgctagatgtattgaagcacctttgtatgttatttgtttctgtttcttttctcttgctgctttcaggatctgtttttttatccttgacctttgggaaggatcttcccaaagatcctttgagagtttggttattaaatgccttgaggtagtattctttggggtaagtcttcttggcattctataaccttcttacacttggatattgataagtatctctaggtttaggaagttattatccctttgaataactcttctcccctatctctttctctacctcctctttaggaccaataacttttagatttgcccttttgaggctattttctagatctcgtaggtatgcttcattctttattcttttttcttttgtctcctttgactgtgtattttcaaatagcatgtcttcaagctcactaattctttcatctgtttgaccaattctgctattaaaagaccatgatgcattcttcagtatgttggttgcatttttttattcttaaactttttattatgaaaaatgtcaaatagtacaataaacatccacagacatataattatctagatttaacaattgtgaatattattgtgtttgcttcattcatctctttctcctcaccctcttctttttttttttgctgaatcttttttttagtatttattgatcattcttgggtgtttcttgcagagggggatttggcagggtcataggacaatagtggagggaaggtcagcagataaacaagtgaacaagggtctctggttttcctaggcagaggaccctgcggccttccgcagtgtttgtgtccctgggtacttgagattagggagtggtgatgactcttaaggagcatgctgccttcaagcatctgtttaacaaagcacatcttgcaccgcccttaatccatttaaccctgagtggacacagcacatgtttcagagagcagggggttgggggtaaggttatagattaacagcatcccaaggcagaagaatttttcttagtacagaacaaaatggagtctcctatgtctacttctttctacacagacacagcaacaatctgatttctctatctcttccccacatttcccccttttctattagacaaaactgccatcgtcatcatggcccattctcaatgagctgttgggtacacctcccagacggggtggcggccaggcagaggggctcctcacttcccagaaggggtggccaggcagaggcgccccccacctcccagacagggcggctgctgggcggaggggctcctcacttctcagacagggcggccgggcagagacgctgctcacctcccacatggggtcacggcagggcagaggcgttcctcacatcccagacggggcggcagggcagagatgctccccacatctcagacaatgggcggctgggcagagacgctcctcacttcctagacgggatggcagccgggaagaggcgctcctcacttcccagatgatgggtggccaggcagagatgatcctcacttcccagacggggtggcggccgggcagaggctgcaatctcggcactttgggaggccaaagcaggcggctgggaggtggaggttgtagcgagccgagatcacgccaccgcactccagcctgggcaacattgagcactgagtgaacgagactccatctgcaatcccagcacttcgcgaggccgaggctggcagatcactcgtggttaggagctgaagaccagcccggccaacacagcgaaaccccgtctccaccaaaaaaatacgaaaaccagtcaggcgtggcggcgcgcgcctgcaatcccaggcactctgcaggctgaggcagcagaatcaggcagggaggttgcagtgagccgagatggtggcagtacagtccagcttcggctgggcatcagagggagaccgtggagagagagggagcgggagaccgtgggagagggagagggagggggagggggagagggagagggagaggggttgcatttttaagctacagaatttccacttgcttctttttaattattttaatctctttgttaaatttatctgatagaattctgaattccttctctgcattatcttgaatttctttgagtttccttaaaacagctatttttaattctctgtgtgaatggccacatatctctatttctccaggattggttcctcgttccttatctagtttggtgaggtcatgtcttcctggatggtcttgatatttatggaagttcattggtgtctggacatggaagggttaagtatttattatagtctttgctataggggcttttttgtacccatcctccttgggaaggctttataggtattcagaaagatttggatgccgtgacctaatccatatctgcattaaggggcactgcaagcccaggatcactgtggttcttcctaactcgtactggtaccaccttggtggccctgaataagatccagaagaattctccacatttccaagcagagactcttgttctctcccctactttctcccaaacaaatggagtctttttctctctctgctgaaccacctggagctgaagatggtgtgacacagtgccccctgtgaccactaccactaggactgcactgggtcagacctgaagccagcacagccctggttctcacccaaggcctgctgtaaccactaccaggctactatatgctcaaggccttagggctctacaatcaacaggtgatgaaaccagttgggctcatgtccttcttttcaggttggcaagttcccctaggcacaatgtgggtccagagttaccatctggaagcctgggactggagtcaaaaaccttagagatctacctggtattctattctactgtggctgggctgtcactcaaaccaagtcacacagccattccccttcttccctcccctttcacaagcagaagagcctcaccccattgccaccaccaccacagacccacagggagtactaccagactaccaccaatattcagttaaggccaaagggctcttcagtcagcttgtggtgagtgctgccaagcctgggactcacccttcagggcagcggactttttctatcccagggcaggtccaagaatgccattcaagagccaaggcctggaatcaggggccctaagagcccacttgatattccaccccactgtgacagagatggtacctaaggtgacaaagtccacttttcttttccctctgctcttctcaagtggaaggagtctctccccaaagccaccactgctaggaatgtgctgcattacacctgataccagtatgtctgagtctcacccaaggcctgcagcataccacctgggtaccactgctggttcttcaaggcctaagagctctttagtcagtaggtaatggatcctgcctaaactgggtccttcccttcaaggtagtaggttcctttctggcccagagtatgtctagaaatttcatccaagggctaggtcccggaatgggagcctcacgactatgaccagtacgctatcatactgtggctgagctgctatccaagatgcaagacagttgtccttactcttccctctcttctcctcaagcagaaatcaagggtctcttttgaagatgcaagctatgctgcctggggttggtaggagggcatgatgtaggcactcccttagccaccctggctagtgtctagtaggccacatgccacccaagtccactggctcagagcccagctcagcactagttgggtagggtactggtcagagtcgtgaggaccccatttcacttgcagtcgttctggcctactgctcctaaagagaagcagtctagcgcccaagagcactcccagccacagtggcaagacttgctggaactcaagttctgaccactgggatgcacaattcccctctggctagggccagtccaaatattccctctgtagccgggcatcagctgagtacagcctggttttgatttccactctgacaggagtgagttcagtgcaaagccccacaatcactgtgctctccctctttcaagtgcacagattcttggtaccatgtggccactgctgaaggatgggggaatggtggtgtcagcaattcaagactgtctttcctaccctcttcactgcctctttcagagacatgaagtcaaaaccaggcacaggactaatctggtatttggttcctatgatggtgttccctttgtatagatagtgtcaaacttggtgttcctgtaggggatgaccaggggaaccctctgttcatccatcttgctccagcactccccaagcattacagtttgattagcacataagcattaaatggccttagtgtcctgtcactgagacactaaaaatcaagtccccacatttccaaatgtttcctgtgagggagtagctgccttacccagaaagtgttgatttcttttttttttttttttttgagacagagtctcactctggtgtcgccagcctggagtgcagtagcgtgatcttggtgcactgcaacctccgcctcctgggttcaagcaattctacctcatcctcccgaatagctgggactacaggcacgggccactaggcctagctaatttttttatatttttagtagagacggggtttctccatgttggccaggatggtctcaatctcctgacctcatgatccacccgcctcggccttcctaagtgctgggattacagacgtgagccaccgcgtctggccaaaggtgctgatttctaacacagcactttgtattacaaataaatctcatttcctgctggacgaggtggctcacgcctctaatcccagcaccttgggaggccgaagggggcagatcacctgaggtcgggagttcgagaccagcctaaccaacatggaaaaaccccatctctgctaaaaatacaaaatcagctgggcgtagtggcacacgcctgtaatcccagctactcaggaggctgaggtaggagaatcgcttgaacctgggaggcggagatttcagtgagccaaggtcatgccaattgcactccagcctgggcaaaaagagtgaaatgccatctcaaaaaaaaaaaagaaagaaagaaagaaagaaagaaatcccatttccattttacaacaaagatcacagagactctaagagattaaactccttatgcttattattagccggtcagtgctagcactgatttcaaaattaagtctaattccaaagcctgctctacttagcagcttctaggtgctaaaagaatttaaggaggttatgtagtcagctagggctgccatcacagaataccacagactgagtggcttaaacaatgggaataaattttcttactgttctggaaggtgagaagaccaagactcaggttctgacattgtttagtttctagtgaggattctcttcctggcttgtagatggcatattctactatgtcttcatgtggtctttccttgctgtgtgcatctgatgtttcttcctgcaaggacactaatcctatcagattggggccccacccttataacctcatttaaccttaattatctccataaaatgcccatctccaaatacagccatttgggtgttaggccgtgggtgttagggctgcaacatatgaactttgaagggacataaacattcagtctataacaaaagttgaggacagacaacaagtcattagatttggtgattgagatcacagactaactctgtacaaacagttttgatataatggtagggtcagaaattgtgtggagactaaataaggagtgatatttgaggaaaatgtcctgataattcatatctgtagggagtaaaggatggagggagatgggagagtccgtttagcgatcattcagagttgagaacctcataatcgaaaaatggtatattgagcactaaagtcaacacatcctagtaaacagaatgtttctgtctttattttgtgctgctgtaacagaacaccctgggactgcataatttataatgaacagaaattcattggcttatggtttaggaggctggaaagtcaaaacttatattgaattctttcagcacctgggagcagctaagtagaacaggctttagaattagacttaattttgaaaccaggtgctagcactgaccagctaatggtgagcataagatgccaatgttatctctcagagtctctgtgacctttgttgtaaaacagaaattagattttataacagcaccaatcctacccatacgatggagcactcctggcctaatcacctctcaaaggcccacctcttaatactgttacaatgtcagttatatttcaacatgagttttggtgaggacaaatattcaaaccatagcagtttctaactaaagatatctactttaactcaaggtatttattttaagatgatatatcttaagatttaagattatatctagtggcagagtagcattcactggatcgggataaaagaacaattctgaaatcctctctttccatgattttcccaatcccatactttgactgagacctacaaattaaaagaaatatattttatatcaacactatgagtacacacacatacaccccccacagactcctgaaacaaaattttaaaattatatggtatgatttctattgctgcatactaagccagcccaaaacttggttgcttgaaaacgaaacaaaaattgctcacaaatgtgggattcaggcaggacttataggtggtagggatagtatatctgatctctcctaccccacttggcattagctgaggcagctcagcagggactggaggatccatcctcaagatagctgatctacattgctggcagtttaatgttggctatcatttggtagctaagccagggctgtgggtcaaggtcctctccatggacttcttggtttcaaaagcaaaccttctaagaagagaaggtggaagtatgggcattttttatgatccaacctaagagaacacttcgtgtcacttttgccattgttatggactgaatgtttatgtctctccaaaatttgtatgtggaaatcctaacccttaatgtgatggtcttaggaggcagggccttagggaggtgattaggtcatgagagtaaaaccctcatgaatggtactagtgctcttataaaagggatcccagagagctttctcactctcttcctgccatataaagatataagaagacagtggtctgaaacctggccttgggtttcagaacccaaccatactggcaccctgatctcagacttccaacctccagaattgtgagaaatgcatttctgttgtttataagctacccaatctatggtactttattacagcagcccatgtcagccatattctattggttgaagtagtcacaaaggtccacccaagttttcagggaagagacaaagaccccccactcaataggtagagcatcaacatcacattgcaagaagaatacattgaatgggagaaactatcttgggtattcatagaaaatataatttgccacactctgcttaccttgtaccatactacactataccacactggtactatactacgggacaagcagtatattctgatatattgtagtctactgttttttatgctgatgattaccactgaactgtgttaacaatctagtggctccccatcctcagtttgaaaaacactgtcctgtacaattgtaaattgagacaatagtaaaaaatttcccttctacactggcagaatgctttaagaaaataaatacagggattactgaaatagatcagaaagattaaagtaaaaataactgagcaaaatgaagtttgccacttttactttctaatacctgtttataagagcaatgtttggcaatctcagatgagttcattttataactgagtcaaaatcttaacatacatcattgcttaggccaaaataaaacctctaattattatggcaaaccatgatacctctatacttttttttatatataaaatgcctttttcaagtcaattgtagaaaatgtgcataaccaactgattgtaacacaatcctttaacttgattcattctttacttattcatacaaactatttaggtatggaatttaagagttccttgaagtcatcatctttgtgacaagatctctaagcaagcaagtggctggcgccgtaaaggctaaaggaagagtgatctaaatcttgttcctctgaatgggtcctggggaccaatagtctgggtatcacctgagagcttgtagaaaagctcctgacaagtcagaatctgcattttaacaagataccccaggagattcctgaacccattcaggtttgaatagtactgaccgaaatcgatgttttccgaagtgtttagtttgtgcaacctatgagtaaaatatgtggcatgagtatatgtctatgtgtatctttgcataatacacatacactgctataatattttataaaccatatgatgcatcaaatagaaatttttaacagatgaggtaaacagatatcagtaggagttctaatccttctctctcactccctcactgtttcatcttaataagttccagaggtacaagcaccctgttttggagcccactggcctaaatcacaccacgagctcaaatagctttctcttgactaagtcacattgcccagaaacacatgaatactcttgtgacacgctgcagtaaaatgaacaatttataaagttccatgcatttaaaattccttcccctctttaaaagcaaatatgtgttgatatacttaacagatcattaaattttggcttcttagaaattaatcgcttattttaaggaactctgatccccagtattgcttgcaggaaatgagtaaacatatgtttgcatgtgagatgatacactggcataaacttttaatagcacactttaaaaatgatgcaaggtttctaaaaattataatctagccattaaaaattatacagtaggccaggcgctgtggctcacgcctgtaatccctgcactttgggaggcaggtggatcacctgaggtcaggagttcaagaccagcctgccaacatgaagaaaccctgtctctactaaaaatacaaaaaattagccaggcatggtggcaggcacctgtaatcccagctattcaggaggctgaggcaggagaatcacttgaacccgggaggcggaggttgcagtgagccgagatcatgccactgcacttcagcatgggcaacaagagtgaaactccatctcaaaaaatatatatatataaatatatatataaatatgtataaatataaatatatataaatatatatatagagagagagagcacctgtgtatatttttttgacacagaaaatacggtatatttttaagtgaaatctaaatgctagtggtaaccacagattattggggactgtgtttcaatggttctcattatgtttttgttttatttgtgttttctaattcttctgcaattaccatgttttatttgtgtaatgaattagtcactaacggtgacatcactggcatgccctgagcctggggtgcctaatgggttgaatcaattcttcacgtagttactggagtctgccagtcagttttcttttcttttttaattgtttttaattttttgtgggtacagatatttatggggtacatgagatgttgtgatacaggcatgcaatgtgaaataagcacatcatggagaatgggatatccatcccctcgagtatttatcctttgagttacaaacaatccaattacatttttaaaagtatttgaaaatgtacaactaagttattattgactatagtcaccctcttgtgctatcaaatattaggtcttattcatactttctaatttttttgtacccattaacaatccccatctctcgctcacattccatccccaactacccttcccagcccctgataaccatccttctatgctctgtctgtgagttcaattgttttgatttttagatcccacaaataagtgagaacatgtgatgtctgtctttctgtgcctggcttatttcacttaacataacgatctccagttccatctaagttgttgcaaattactgcatctcattcttttatggctgaatagtattcccttgtgtatatgtaccacattttcattatccattcatctgttgaaacttagattgatggccacttaggttgcttctaaatattagttattgtaaacagtgctgcaacaaacaggggtgcagatatctctttatatactgatttactttcttttgggtatgtacccagcagtgggattgctagatcgtatggtagctcaatttgtagttcattgaggaacctccaaaccattgtccatagtcgttgcactaatttacattcccaccaacagtgtatgcaggttcccttttctcaacatccacaccagcatttcttatcgcctgtcttttttatacaagccattttaactggggtgagatagtatctcattgtaattttgatttgcatttctctgatgatcagcgatgttaagcacctcttcatatgcctatttgccatttgtatgtcttcttttgagaaatgtctattcaaatcttttgcccgtttttgatcagattattagattttttcctatagagttgtttgaggtccttatatattctgattatgaatcccttgtcaaatgggtagtttgcaaatattttctcccattctgtgggttgtgtcttcactttgttcgttgtttcctttgctgtgcagagcattttaacttgatgtgatccaatttgtccatttttgtgttggttgcctgtgcttaggagtattgctcaaaacatttttgtccagaccaatgtgctgaaaattttccccaacgttttcctgtagtagtttcatagtttgaggtcttagatttaagtccttaatccattttgattgatttttgtatatggcaagagataaggatttagtttcactcttctgtatatggatatccagtcttcccaggaccatttattgaagggactgtcttttccccagtgtatgttcttggcacctttgtcaaaaatgagttcactgtaggtgtgtggatttgtttctgggttcttgattctgatccattggtctatctgtttgtttttatgccagtgtcatgttttggttactatggctctgtagtataacttgaagacagggaatatgatttctccagttttgttctttttgcttaggatagctctcgctattctgggtcttttgtggttccatataaatttttaggatttttttttttctgcttctgtgaagaatgtcattggtatttcgatacagattacattgaatctgtagattgctttgggtagtatggacattttaataatattcttccaatccacaaatatggaatatctttcctttttatatgtactcttcaatttctttcaccaatgttttatagttttcatttgagagatctttcacttctttggttaagctaatccctaggtatttacttgtttttgtagttattgtaaacaatattactttttgatttctttctcagattgttcactgttggcgtatgaaaatgctactaatttttgtatgctgattttgtatcctgctgcaactttactgaatttatcagttctgatagtttccttgtggagtccttaggtttttctaaatataacatcacaacatctgcaaacaaggataatttgacttcttacattccaatttggatgccctttatatctttctcttatttaatggctctagctaggacttccagtacttttttgagtaagtggtgaaagtgggcacccttgttgtattccagttcttagaagaaaggctttcacttttcgccattcaatatgatactagctgtgggtctgtcatatatggcttttattatgttgaggtataatccttctacccccagtatttttagggattttcatcattaagtgatgttgaatttcatcaaatgctttttcagtatcaattgacatgatcatatggtttttatccttcattctgttgatgtgatgtatcacattggttgatttgcatatgttgaaccatccttgcatcccagggataaatgccatgtgatcatgatgaatgatctttctaaggtattgttgaattcagtttgctagtattttgttgaggatttttgcctcaatatttatcagggatattggcttgtagttttctttttattgatgtgtctttggttttggtatcaaggtaatactggcctcataggatgagtttggaagtattcccttctgtattttttggaatagcttgagtagcgttggtattagttcttctttaaacatttggtagaattacagtagtgaagccatcaggtccctggcttttctttgctgggagactttttattacaactttgatctcgttacttgttattgttctgttcaggttttggatttcttcatggttcactcttggtagattgtatatatttgtctaggaatttatctgtttcctccaaattttccaattgattgacatatagttgctcatagtagccactattgaacctttgaatttttacagtatcagttgtaacatttatttttttttcatttttttattttttgagacggagtctcactctgttgcccaggctggagtgcaatggcctgatctcggctcactgcaagctctgcatcctggcttcccgccattctcctgcttcagcctcccgagtagctgggactacaggcacccaccaccatgcctggctaaatttttgtatttttagtagagacaggatttcagcatattagccaggatggtctcaatctcctgacctcgcaatccgcccgcctcagcctcccaaagtgctgggattacaggcgtgagccactgcgcccagcccttttttctcttttattttatttatttgggtattctcttttttatagttagtctggctaaaggtttgcaaattttgtttaacttttcaaaaacccaactttttgttttattgatattttgtatttttttatttcaatttcatttttttctcctctgatcttcattatttattttcttctactaattttggatttggtttgctcttgcttttctagctttttaagatgtatcattagattatttatttgaagtttctccattttttgctgcagggacttacagctataaacgtccctcttagtattgcttttgctggatcccataggtttttgtctcttgtggtctaggtgccacctcagccacagtgcagtagaacaccaggtagacatctaaggcttttgattctagtccttaactcccagatggcacctttgaacccacccagggcctgggagacctcactgcccttccattatcatttgtttcaagaaatttttcaatattcttctgaatcacttcattgacccactagtcattcaggagcatattgtttaatttccatgtatctgtatagtttccaaaattgctcttgttattcatttctatagttttattctattgtggtcacagaaggcttgatattatttctatttttttaaatgttttaagactcgtttcatgacctaacgtatggtctatccttaagaatgatccatgtgctggtgaaaataatgtgtattctgaagctgttggatgaaatgttctgtaaatatctgttagatccatttggtctagagtgcagaataagtctgatatttctttattgattttctgtctaaaagatctgtccaatgctgaaagcgggatgttgaagtctccagctattattgtattgggacctattcttctctttagcgctaataatatttgttttgtagatctggataccccagtgttaggtgcatatatatttaaaattgttatatcctgttatcaaattgacccctttatctttatgtagtgaccttctttgtctcttcttatagtttttgtcttaaactctgttttgtttgtatgagtatagtgactcctgcttttcttggattccattggtatctcatcccaagattccattgggtctcacccaaggcctatggccttggctcctgcatatgttcactcaaggccctggagctctacaatcagctggtggcaaagccagtcaggccagtgtccttttgttcagggcagcaaggtctttcaggccctgggtgggttcaaaggtgccatctggaagttaaggactagggtcaaaagccttagatatctacctggtgttctattgtactgtggctgaggtggcacctagaccacaagatatggttcttcccactcttccctcacctttccaaaggcagaggagcctcaccccatagccaccaccatctcagaccacaaagaatactgccagactaccgcccatgtttccttaagacccaagggctcttaagtcagcttgtggtgaatgctacctgtcctggaactcatccttcgggaaagtggactctggtatggccccgcacaggatcagaaatgccatctaacagtcaattcctggaatctgggaccccaagagcttcctgagtactctaccctctatggccatgctagtacctgaagcgagcaaatctcagaggctcacccaaggccctcaacatagtatctgggtatcactactgatcattcaggggccaggggctcttcagttagcaggtgatgaatgctgccaagactgggtgggtcctttccttcaagtcagcagtttcccttctgacctgggatgtctctagaaatgtcatctgggagcaaggacctggaacaggggcctcaggactctgacagctgccctatcatactgtggctgagctggtatccaaaatccaagactaagtcctttcaacccttctctctcctctcctcaagcagaaggaaagggtctgttttggagccaggagccatgcagcctgtagttaggggaagggtgatgccagcactcccttagtcaccccagcggatgtctcagtatgtcaggtgccccccaagtcctccatctctaattcaccattaggacttgcctaagagtttcagtccttatggcctagcctgcctttcaagtttactgggagacacagagcactttggccctcagtggcaaggtttatgagaactcaagttctgaccacaggggtcagtaattcccctctggctagggctggtttaaatgctccctctgtgggtaaaaactatcagctgagtttggtcctgttttcctttctgccctaacaaaatgcactgagttcagtgactcacagttgttgtgttctccttccccagatgcccagagatgctctctgcaccacgctgccattgctatggggagtgagagaagggtggtgttggtgattcaggacttttttttttttcctgtttcttcattgcctctttcagcaatggaagttaaaaccaggtactatgagggcacactgatttttggttcttatggtgttttttctgtgtaaatagttgttaaattggtgtccctgtagggagggatgactgttggagcctcctattctgccatcttgctccacctccagtttgccagtcagttttcatataaaccagagggaaggttatacgctgtctgttttttcctctgtaagtaatcagaaattacaccatctgtatgttatatacacatgtacataacattcctgtcttagtttgttcagtcggctatagcaagttaccatagactaggtggcttagaccacaaatattcatttctcacagttctggaggctgaaatccaagatcagggtgcgggccatcttcccagttatgtcctcacatggccttccttggtggtgcatacaagcagagagagcagaaatgatcttgtgtctcttcttctttctataagggcattaatccatcatgggaacttcactgtcatgacctaatcctctccagggcttcagctcctaataccattacactggggttagggcttcatcatatgaattggagagatacaaatctgtccatagcatttctttcacagctaaattggcatttacatttcaagaagagaaagtgtccaagagtaacaattgaagtataaagtgggttctttcttttaaacactttgtattatgttatctccatcatgaagccgtttaagaaaaggaactgcattctcagtgtattagttatctattgctgtataatctgtataagttaccccaaaactcagtgatttaaaacaatagtaaatatgtatcagcattgatagtttgtatggatcaggaatttgggagtgccctggttgggccttagtggcttggggactctcacaaggttgcagtcagattagactgtggccttagtcatggaggcttgattggggctgaggatatacttccaaggtgactcaagttggatactccccaccagggcctcaccacagggctcctcatgcatctccacagcatggcagctggcttcccccagggggagcaacgggagagacccttaacagaacctgcaatgcctttcctaacctgccttgagaatatcactccatctctctgccatattctattcgtctcaccacaaccctgattcactatgggaaggggattatacagggatctgatactagaggacaggaattattggggcccacttggggtacttaataaccaagagtggttattaggtgataatttcttatgtgatagtttcttatggtgtactgcttagtaaagacagtgcttttaaaatgaagtgtaggttaaatagacaccctcatcccaagtgcctctaaagcaaataactgaggtgatgttgagaaaggccaaagcggtaatcacttacggagagttcaagaagtgtaatgcgcacagtgggttctgggaggaccctgggtactagaaaagggaagggaagggaagggaaaaaccaaaggatttcagcttctctgacgattcagggtgtccagatttaagatggagttattttaggcactgaattgacaattccaaaatttgtgcagtccgaagaaactaaaactgaaaattagagacaaagcagttctttatttcaaccctgcaaacgtgtgtatgtttcctctgggataggaaagggacatcaatgggtcagtaatgcagaggaggagaactgaaaatgaaggagtggctacctgggctatgtacataattgtttttcatttttatagcaacctggtaagtaggtattgttatccttatttagtgtggaaaaattgaacctaaaggatttacagtcagctacatagccaatgtgtgagggccaaaattgcacttaacttcaaaataggtctttacaccatttaaaaatcaaactaaattggatcaagtgtagataacagtagctacagggaagcatgaggtgggtgagaattagccactctccaacgtagtccctgccaggatataatgaaagcaagtttcagactaaattctccacacacatacttttaaactgtattagcaaggaggccctaagcaattcatcagtccgttctgtaaacattcatgaagtctcaagtctttattcttttaggttcttctaccaccactctgcagaaaatatattgcagtcagcttaactatattccccaataggattctactacccttaaattcagcatcaggcaccagaaatcatataatccaccagcaggatacaggaccaatccagcctcaggcagcacaccaaaggcttcactcgatgactattccctgttcatacagggtcagggaagcctatttataccttgaatctcataagtagtgtctgtttttagaatttatttttctgatcaataagccattaatttcatcaatgaaaactcatttctgccattcattaattcatatcttaatcaatggacagtggagttgcatttattaaccagtactatgtctgaccttcctgattagatactagctgttcactcctaaagtgtatatttctgactaccccaagggtttaataaacaaaaatctacatttgtatcatactgtttatgatgtagtaaattatacatgtcaaagcaaaggacacaagcaaatccttagcccagacactagatgtagcgggagctcagctgaagactgaattactatcgcactagaattcagcaccatcttgttttgtgctttagttatctaattgcttcgtgtgttggatttggcttcttaatcagattatgaaattcttggaaagagagagttatatactgtttattcttctacaatagctagcacagtgctagatacatataggtctagaatcaatcatttttaattattaaaattcatagtaataccttacaaacacttggcccgtaggattctatagttgctttgagattctaaagtacctcagtggactacaaaccttaagaaattgcctgactgacttgagtgatggaaatggtatattttgtgtagattttctcatatcaattcacagctttgttctaacaattattaaacttcattgggataagcataaagtatgaaccataataaacaatcatgcacctcataacgatgttttggtcagctatggactgtatatgtgacagggatctcataaaattatactggagctgagaaattactactgcctagtgacatcatagcacaccaccttactcacgtgtttgtgatgatgctgttgtaaacatacctgccgcacttctggtcttataagagtatagcacatacaatcatgtatagtacatacttgacaatgatcataaatgtctgtgttacaagtttatgtatttactatgctatactttttattatttgagagagtacatcttccacttatttaaaaaaaaagttgattgtaaaacagcctcaggcaggtccttcaggaggtattccagaagaagacattgttatcatacaagatgatagctccatgcatgttattgaacctgaaaaccttccaataggacaagatgtggaggtgggacagtgatactgacaatcctggccgtgcgtaggcctaagctaatgtgtgagtttatgtcttaccttttaacaaaaaggtttttttaattaaaaaaaattaattaaaaaaggaaaaagtatatataataagactataaagaaagaaaatcattttatacagccacacaatgtatttgtgttttaagctaagtgttactacgaaagagtcaaaacgttttagtaattaaaaagtttataaagtaaaaaagttacagtcagctaaggttaatttgctatcaaagaaagaaaaatattttaaaataaatgtagtctaagtgtgcagtgtttatgaagtctccagtagtgtccagtaatagcctaggcttcatattcactcaaactcactcactgactcacccagagcaacttcagtcctgtaagctccattcatggtaagtgccctatctaggtgaaccatctcttaacttttataccgcatttttactgtaccttttctctatttatgtttagatacataaatacttttatgagccgggcattgtggctcacgcctgtaatcccagcactttgggaggccgaggtgggcagatcatgaggtcaggagattgagaccatcctggctaacacagtgaaaccccgtctctactaaaaaatacaaaaaaaaaaaaaaaattaactgggcgtggtggcgggcgcctgtagtcccagctacttgggaggctgaggcaggagaatggcaggaacccaggaggcggagcttgcagtgagccgagatcgcaccactgcgctccagcctggcgacagagcaagactccgtctcaaaaaaaaaaaaatacttttatgttacaattgcctaaagtattcagtacagtaacgcaccatacagatgtgtatcctaggggcaataggctataccaggcagtctaggtgtgtggtaggctacaccatctagatttgggtagtacgctctgtgatgttcacacgacaaaatcacctaatgttgcctttctcagaatgtgtctttgtagtgtgaccgtacaaacataaatactgatatctggcttcatttcaaaattttttaaattgagtttgtccatttccactgaatttaattatttcgagcaccaactccaggagcaggaagttagcactgggcttgtttttattctgagtactgcttgaatactaatagttgaaaagtattgtaatatttgaccctgaagagctttgactcagggattttgtgttgtcattcacatcctcggcaaggaaaggtatccagctcctactatttaatatgtaatcacgacatctagtgctcactgtttggttttgttaagcaatagctgtgagccacagagccaacctgcagccgcatctcacccaagaaggcccagggctgtgttttcagttttgcttttaatgattgcataactgtgtgaagttctaagacactgttgggattttagccttgggatgacaagcctttggggcacctctttggggtaaagaaagaagaactaacagaagagcttcagtttaagtctgatgaggacaaacgcctggcactaggtgggttttaaaaatccttgaaaattttttaaaaactaaaaaaaaagccagctcttttgcaattgcccagagagaggaggacacccatattgattgatgcattgttctcctaggcaggaatcgtcccactatagtctgcggtagcaagagttcaagggttaaagtaggaagactgatcccataaatgtaatttgcattccttccaaattcacatacaattgtatagcagtgagtatttaaatttaaaaacattatagtttaaggaacttttctcatgaacagttctcctagtgtacattatgtaaattctaccaccagagaaaaattcctgctttgttccggcttaagcttggtacatatatacaaacccatactattacttcagaaaattcaacttaggtaatctggctcaatactcatggttagagattttaactttaacaacttaacaatatttggtttatcatatttgtgcttttatttcaatttagaatgttttccagccagaaatctagctttaagttttataaagcatgatgacacagcagctagaactcaaatctctaaatggaattatgctaaatttaacaatatgttacctaaagtccttatgccttaaaatgtttctaggctaaattctgcaatttccctggaaacatattgaattgtcttcaataatacattgcataaatatatttatcctacatctaggtacttcaaattataagctagtaaatcttgtaatatttctagctttaagactcgtatgtatttcttcctttgtattttctccccaatcatatgattatgtactattgatgctataaatatcttatattttaaggttaggctaattcccagtggctctattatcccacctgtgcttgcaactcagtatgtgatgaaattgcctatgacttatcaattaacccttggtgtccctagaatccaaaataaagaataaatgtatgtaaaaggataattggagacttagaatctcttcctcaagattttatctggttaatgactatcacaggtgggctgttctttttattcttggaagaacatactctattccggaggggaaaatatcaaattagttcagcctgctacctgctcccatagaagatgggggaagctggctctttcatcggtgttttcgtctgtagccgcccccttccccaaccttgagttgatttaaaaggatggaagaaagtaccgtgctacctccaatgctgtcattcagtgttcaccccaggcagtgtgctagacacattcctggactaaatcctttagttcctttaagacaacaaacctataagataggtattattatctcgattttacatattaaaaaataatgtaagcctttttgtatttgcattgttttgctttgttctttaaatgtctgctttaaaaaaagaagtggggtaggtaaaggatcaaaaaaggcctggaatcccaaaagtaatgataaatgttctaaaaactctttaaaactttttatcttccatctaaacaggatgcatctgttacccatgctaattacacagaaggcatctgagtcttcctaacttctagcacgtaatagacaacctgtgattcctaacatttactgttggaatttacccattggatcttttctattataaatttatcttcacttttttgttgttgtttttccaagaagaggtgaaaatagcaatgccggctgggcatggtggctcacacctgtaatctcaggactttgggaggccaaggccggtgaatcatttgaggtcaggagttcgtgaccagcctggccaacatggtgaaaccctgtctctaccaaaagaatataaaaatgagccatgcatggtggcgcacgcctgtagttccaggtacttgtgaggctgaggcacaagaatcgcttgaacccagaagacagaggttgcagtgagctgagatcatgcccctgcactccagcctggatgacaaagtgaaactatgtctcaaaaaaaaaaaaaaaaaaaaaaaaatgcttgggagccaggtaatactcaaagaagaatgattgccactgggcttttctcaaacccactcatctgtcagtcacgtttgaaaattatttctcaggtcagatacggtggctcacgcctgtaagcccagcactttgggagacctaagcgggcggttcacttgaggtcaggagttcaaaaccagcctggccaacgtgatgaagccccccgtctccactaaaaatacaaaaaattagccgggtgtggtgtggtggtgggcacctgtaatctcagctacttgggaggccaaggcaggggaatggtttgaacccgggaggcagaggttgcagtgagccgagagagtgccactgcactccagcctgggcgacagaacgagactctgtctcaaaagcaaagaaaagggaaaaaaaaactgtttctctgttaaaggaaaggaagtagctcacctgactgacatatatgtgtccagaaatgaaatctttacagtgacctgttactgtcttaatgataaacattgaattattgacatctactttatctgaggcgttatcctaggaactttatatgcgttgtctgtaatccttatagcatccctcagaaccacattcttccccttctacatccttccttctcaggtaaggaaactgaggattgcctcaaagtcacatgactatggtaaagacatttttttcccacatgcttatgactaaatgttagtactcgctggaaacttcataccagacatcccataccctttggactgattaactcatagcaggggaacttgggccttagagtcactgttaattggaggttagtggtatgtggctgagagaaaattgtctgggaaatgcatttgcccttcaagctcagaacccagaaagcttttgtcagagccagccaggactggctgcaggattttggaatttcagaaattttgtgagatttttataatattaaaaattaaaatatattaaagtataattaaataaatcatattaaggatgaagtaggtcgggcatggtggctcacgcctgtaatcccagcactttgggaggccgaggcgggcggatcacgaggtcaggagatcgagaccatcctggctaacatggtgaaaccccatctctactaaaaatacaaaaaattagccgggcgtggtggtgggtgcctgtaatcccagctactcgggaggctgaggcaggagaatgacgtgaacccgggaggcagagcttgcagtgagccaagatagcgccactgcagtccagcctgggcgaaagagctagaatctgtctcaaaaaaaaaaaaaaaaaaaaagaatgaagtaaagaaatactcaacactcgtcacttcctaaatattttactattgtccatgctttggaggtaattgacatctattatatctgtgttgtggaaatactatgtaatggggtgctaccatacatcctttccaactttatgttcagtgacttaacattgctagcttgaaattagctatggcaggagcatttacaccatggaaatcagcaaatatgataaatcaatgcttgatttatcattttgttgcttgtctacaattaagaatgaagaaattattaatgcaaattaaacttaaaagtgtgttaagtctacagctgctacatgggaaaaaggaaatttttcttccaatattcaaaagctattatctgattcaccaaagaatttgctcatgtcattaacaaatgagtgtaattccaacatatatgttctttgtttcactttcttctaaattgttaaacaaaaatgtgaaccagcattcatgtgggaactatacctgctcatcagttgaaactataggttaactatggatagaaaaggctggcagaactcattgaaagcattctgtgaaatcagtcctctaaatggaatttattatttttaaaaatactattatttgtaaactatgtggtacacatcctttatttacagtaagcattttttttccatagaaccagttgtaaaacatttgccagaccactagctgtaaggtataactggtctgcaaactttgcacctgccagaaccacagagtaaaatcataccttccccaaaacaaaggcaccattttgaacacagttggaataggaacatagcttttaatcctgttgtttaaaaagagaagctaaaaagtatgctgactgcttttaatatttttcccattcgtccactagcaggagtgaatactgtcaagaagtcttcaaactacccaaaagcaagttgaagataagcttctatgaaatgtcatgcatttttgtagtgtgtgtatgtactatgttttgctaaagaagattatagaatccatctcctggactttggggacttggggggaacagtgggaggggggcgagggataaaagactacaaatgtggtgcagtgtgtactgctttgatgatgggtgcaccaaaaatctcacaaatcatctggtatgtaaccagataccacctgtacacccaatagcttatggaaaaatagaaatttaaaaattaaaacattaataaaatatgtataattatttaaaaaaatagtatctatttccaagtatctttggcttaagcagtaggattttttttccccaaagaacagtaagttaatgcactttacatgttaatatttccagctaagaaaacattaaggattgaaaattaggaatttaagctggtctcatatttatttagttgagtgaattaaaggggggttaagagtttatcagtttctggtgttcttttacttctaccctgtaccactctctagaaatacacttgtgatctgtgaattgtcacgcatatcgttatatgatcatttacttaagtctactttaattggttttggatcgtttccacaaactatgtttctgcattacattccacattgcagaaggtggggctgctctgttgagtttcgcttataaataagcaaacattctttgacctgcaaaattccaagaacagccctccttcctacctgacccttatatatttctaacacttgttaatagaaaaattgaatgaaaaaaacaacaactaaagatccttccaatattttctggaaaattgatttccttttgtgggagttggagtgtctaactggaagggataaaaataatacctgagcaagttatatttgactcatatttgaacagtcatctaatggaagacaaatctatgttcgcaaagtctttgtttcccttagggaagtaagtggattgccaaataatggtgggaaatgcttacagtgcatattttctttgtgattatcaggcagaattttgttctggttttgggattcaaaatatgccaggttctttattttcttaggatgtccattttacctagttcattgtaaatgacactgaaaggaaaccccgatcaaagtttttggcttcctggaattttgctgttgcttgggggaaaagcaatgcttttttttctgtttggatttttcagtggcatttaaggaagcaagatgaaataggtaatccatacagaaataatcatcttgtttttctttttgaaaatcactggtccaagaaagatacaatttaaatccaaggtcattggcattgatcagaatagatagctgatacttttcctgaaagatgaaccataatattttagcatcatgaagcccaggaatgtgagccacaagaacctgggtccaggaaagtcatgtaaatccattctggcttggccacagctggggccttgactagagttaccgttttcttaaccttaaagccacgccttggactctgcttcctttaatctgaccagactgtcttgaatctaatagtatgaggccatgtatttagggtcagttagctgattattgagtacccactatgtgcttgctactgggttaaacatgatagcttccttatggaatttacatttgtcttagtccttttgggttgctataacaaaataccttagactggccaatttataaataatagaaatttatttcacataattctggatgctgggatgtccaagatcaaggcatcacagatttggtgtctggcgagggcttgctgtcacccataaatggtgccttgtgactgtgtccttacagggcagaaggggagggcagctcccttcaacctcttttgtaaggacactaatcccatttgtgaagtcagagcccttgtgatgtaatcaacttctaagggcctcacctcttaacatttccacacttgggtttatgtttcaacatatggattttggagggacactagtgttcaggccatagcaacatttagcctagaacagcctagaaatgggtgagaattatttcctttattcaactagaattgattgaatgcctatcatatactaggtgctcttccgcatactgaggattcaaatgcgacaaattccaactcttgtctaagaggtgcaagagagtgccatgagagttcagaactaggacaactaatccagctagaggcatccagggtactttccggaagaggccaacactgagtgggaagtcagagtcagccagatgctataaggagggctttccggagagaaggctgtccatggacacggccagtaaaaactcccaaagtgtgacagcgtgacgtgtttttgaaagaatcgagggctgggcgtggtggctcacacctgtaatcccagtgcttggtcggccaaggcgggaggattgctttaaagcaaggagttcagggttacagtgagctatggtcccatcactgcactgcaaactgggtgacagagtgagaccctgtttcaaaaaacagaatattttttctctatatccacaccttgttggatatgcccacaatttggggccatttacagatggagtggggggccacagtgatcctaagagccagggagggaggagcaggaagtgggaaaggggtttaagtagacagcttccagagccccacttcgctccacctctacctggatttctgttcattcaggtctcccacaaccaagaggtgtctggtgagaagatcagtaaatcacctcattttgattccacattcgtaaagaactgaaaatcgctatttcatgacctgcgcttttcctcgcagtaaccctgagagtttggaaaggggcattaccaccaccacattatggatgaggaaattgacatcctcagtgtgagcgatgttgctgggtccacagttcaacatggcagcgctgggactggagctgtgtttcctgggcctttgggcccaggcagtagagtataggtttaaatcttggctctaccagttgctagctagaggatataaagcaagttccttaacctgtttaaccttgcttcctcctctgttagatgagcttcaaaatagtacctcctaagtggttgtgaggattaaatgagatcatgcacataaagtgcttggcacatagtaagcactcaataaatatttattccattaataggcactgaatcagattctgtggttgcaaaactgggtgtgacacgagtacaaaacagagacagacaactacataactggccatatagccaggggataggctctgagtaagcacttagcacagcactttgatggttctatttgggataggggcacagcgggccaaaagctttcacagagaagatcctattaggactttgacccagaaggtagaatttcactccccttgaaagggcaagtccaactaaagagatgcaattctattagttacctattactgtacaacaaattaccccaatatttagcagcttaaaacaacaaacttttttttttatctgacagtttctgtaggccaggaatctgggcgcaggataatggggtgcctctagtttaaggtctgtcagtcaagctgtcagtcagggctgcagtgatctccaggctggactggggcatggagaatccgctttcaagctcactcaggtgtctcttggcgggtctgaaaaggtacacttccaagctcactcgtgtgactgctagcatgcctaggtttctcatcaggtactttctttatcctgtagagatggagtcagcaaactttttatgtagagaaccagatagtaaatattttggactttgccagttatggtatctattgcaactactcaactctgctgtgtagctcaaaagcagccacagacaatgcataaatgaatgggcctagttgtgttccaatagacatgtatttgttctctctcttgctctctactaaaactgatagcttaaccaggatatcaaaatacattacaaacctcatgtagaatgggaaagatttaggggacgacaacttaactgacagttcaggttctttttggtaatacatgtagtcttagtcactggtggcatggctggccagctttggggcagagtgacggactcatggcagcagggcccttgcctgccataagaaaagacaggcccggaagctgaagggccagtggcatcataattacatctttccagtaattgattgcttgacctgtgccaatgtaacatatgtaacccataagattgttcttaaggctcataagatatagatacttaaggactcacagagagtgcagtgtctacacaggtatgttctgccctccagaatttcccttaaataattgcacagaaatctgtccctaatatttccttttgcattacatgtatggtgtacctagaatctggcttttctaaaacaactagaacatcagcaaggtgtctcagaggttgaaaagaggcctggatgattctttgtgcttgtgtttgaggctgtcaatatgttaaagtagtaaaataatgacaaagcagcattataaacattgaagaatattttaaatgcttacatgtacaaatttgcaatattatacacatgcataaaagtggtagaattttcctagtctagaaataacataaggaacagcaagtgatttgttatagaaaaaaaatgaggctgaggtttaaagatacatgaagaacattacctttcttcagtcctgtcagtgcggctctgggcatgtatttggagatagtgtcaggagcctacatttgagttctctctttgacaggaagtccaagttattcaacttcctgtgtctcacattccctgcctagctctgcagtgataggctttgttgcatgcatccaccatactgaagactccatgatatataataaatgaagaagcttaaactctgaattctttctccaaaatatattagttgtgtaaccttatgcaagttatttaggcttgctaaaccaatttccattatcgtaaaatgaagctaggacactggaatgcttatttcacacagagttgctgggaaaagaacaagatagtgagtgtaaagtatcaaacacatagtgaatgctcaagtgtcagataccatcaccatcttcaccgtcatcaccatcaccaccacttccactgtcaccaccatcaccaccatcatcattaccaccacaaccctgtcacacacacacacacacacgcacacccatgcatcagaaccagagcctcaaatcttggtttgaaaatctgttgagtgtaacaactgggactggatccagtgaagagtcttatggttataacctccctgagccctcctgcatgtgtgaactgttagcaccacagccgcagtgacttggccctgggttctgcttcattccaccctcacctgtccttggtaaataaacatgtatgtgcaagacagtttgtacatctcagacaaatctcttctgccacatgtgtgagaaaattgagacagaataaggactttataactagaaaagataaaatccaaagggcattggggcatctgcagattcacagaatgactgtcagtcatcattcttgggcccctgatgctaaaagagacacaccttgccatctccacctgggaagagcttgtgctgcaaagagagagaacatgatgaacttaacaggagttaagaatttggctctgattccctggagtctgttaggtggggtctttagctgtttggaaaagaagggtttctgcctgggacaggtaataattgctgaacagactttccttgcactttccctggaggtgtgaatttgatagcagtgatgccttgcagattatcatttcctggtttatgatggaggaacttaatctcctgtttaggtttctaactgccaggtcccataggttacttacttcacaacagaaaaatagaaaagaatggaaagataaaatcaaattcatctcacacattaaaatcatggcctgttatagtcagcactgtagacactgaacttggaagctgcaaggagggtgatattaccaaaaatgttaagttccaaaaatgttaaactctagagagaatggttaattaactgtcaggggtcactgtagggtagatgcatgtcgcaatgataatctatgcataccctaagaatgacccccacatagcactcgcacctgaatgtgtgtttggagttccaagctaaggaatctgggagtggccaagccagagattcactccttatctatgaggaacatctgagcccccagccgaccctgtgaaaaacagaccatacatgggattaaggcccttggttttcagttaaatgaaggttaagtagaagctgttaaaaggaggatgttacgtgaaaaatgttatataaacgacatgcttctcttgagtggctgtggttatcgcgttctgctgccactggtcctgtggttctcctgttcagcctgctgccactggtctgtcctgatatgtaagttcccctctaaaccctgtggcagccgggcgcggtggctcacacctgtaatcccagcactttgggaggccaaggtgggcaaatcacctgaggtcaggagtttgagaccagcctggccaacatggcaaaaccccgtccctactaaaaatacaaaaattagccagatgtggcgcacacctgtaatcccagctactccagaggctgaggcaggagaatggcttgaacctgggaggcagaggttgcattgagctgagattatgccactgcactccagcctgggcgacagagcaagactccgtctcaaaataagaataaacataaaccctgtgtcgcattcactggctccaggtctcttcttcagcctctcggacctgctgccatcctcactggaattaatggggaattggcatgacaatcactcttggaataatttgcaagaatttaaaacaattattatgaacattgtgtattttcatggaaaaggccagagacgtgatgctaagtgaaaaaaatgggacatgttgtaaaatgatcaaaacagggtatttagcatatgcaacagcacgcatttatcatttctttatcataagaacattcaaaagcctctcttctaaatattttataagatactacaccttactgttactaaatgtgaaaaaaataaaaattaaaaaccacacaagaaaaagaagtgggacacgaagttgtatgtgtattgtatagaatttgtatgcagatggacataaacccttgaaaaaatttgcatacataacacacggttcagctgcactgattatggttgaccttttttcctctctttttccaagttttgtgcacttatatgtatttgtgcatgcgtgcataattatatatgttttaatgtagagtgtataaatcacattatgtatatgcaaacatatataacatttttaatgaacaaaggtctttaagcatttggaaaagaccagatctgagcagagcgagtgcaaaaagaaagtttttgtactttaaaaactacttagaatttggcataaactaaggactaagctttaacgttaatcgataaatgagtgaatcttacattctatcccgaatatgattgtgctttagtgaagtaactaggatttttcttttttctgtggagattctagatataaatcacggttttgtttctttggtttaaattacattcctctttgatcattacttcacacaatgaaaagatatttccttgtgcaaagtagtggttaacttctcataacctctgacaacaaagagcccctgtgtgaggacacaggaattcctcttgggatacagggaaggcccccagctgaatcgtatccaaggaagatgttgcaaagcttgcaaagcttgttcagaaaaaggagcccagcttgagctctttgctttctattcagatattggccccatgtagaggtgggggtgggagttggggggaacccatcaaagagaaatgggaaacaaacctgactgcatttacagattacaaggaaaagttaattcttgcaaccagtgttagagccaactcaggcttattatatttagaatttaactccacttggaaaaaaaccccttttttttttttcctttcatggaagttaaagaaggtaacacaaacagcccgtccactctgtggtgtaaactctgaagtaaaaaacacctgtctgcagagaagtcccaggctggctgagttcaccttgactagctctatttttccccaccagtgagtccagcatgttcccaccagttattattatgaactgaaatctcgcagagtcaggcatttggcatggtattcacggcctctccccacctaaccccagcccatcctagtggatttatctcccatcatgcttccttttccaccacccacaaaccttcccttcctcccatgctttaactccccacccccaaccttgttgggaggacttatagaacgatataaagcacccacaagtgggtctggcatgtccaggctttcagtaaatgctggtgcccttttcccttcttctctttccctttgcacaaaaagtcttcctattagaggtacttaagtcttgggacaatgatagaccctttaacagggtggtgatgagcagaaatgagcgaggaggagagtctgccctctccgccctctaccagcccctcttaggggcctccctctaccagcctactcatcaaatgctgcacattaataacaattagccacatggccgctgccatttttgtgcttctgccaccagcttttcctggttcatgcattatgtgtacacctcatgtgaaggaacgaaggaacagagaggttttgagatttttcttgaggccacacagcttataagtagtggagccgattcaaattcaggagtttctggctctagagctcacccctcttttccacttgtgctgaactcctattaacctcaatagggaaggcaccaagttcaagaggccgaaaaagacatctagagccaggaaatgagacatggggcttatttggggcctacatacagaggagagagtccagtggcggcaggctggacaatataaccacattgcccagtggtagcggactaggcaacttgcaaacagcatgcactctatacagcattttcacttaccctccccttaataacctccacctggcaaccttcatttaacccaaaactcaggtctcaatcccctgtacagcgcatcttccattggacaggccgggtctcagatgtttatcatagataaggaaggaatctctgaggtggtcactcctggattccctagctcagaacacacattcaggtgcatctgtcattcagggtcattctaagggcatacttaaattattaccaccaggtgcatttaccctgcaccactatgcaaaagtgtcttcccaaagactcaccgacttttggtcaccagcagcatttgtccccaacacctgtgggtgctcaaaccgtatcaggagaagaaataccccctcctagttcaggggtggctccacttgaaaaataacattctacaaagtaaaaattccattccatgtacagataaattgcacggataaatatcaagcaagaatctatttgctaacagaccacggaatgttgtccttcgggtgtttaatgttgtacttgaatatgctgtaaaaaacgccatttaagaacgtgtagatcagcactatccaatagaactttctgtaatgaggaacatgttctatgtccatactgtacaatacagtagccactagccacatgtggcttttgagcacttgaagtatggctcattagtgtaaccaaggagctgaaattttaatgtatttaattttaagtaatttaggtagccatatgtcgttagtatttaccattttgactgtgcagctccagaatattcagaaagattggttgtaggacaccaccccaactccattttcatagtgttttgcctataatctctattatatcattgcatctaattgcttaggtgcacccaccccactaaattataagcttgatgtcttattcatctgggctgtgatccctactagcatatggtctggcccgcagcactagatgtttaataattaatgcaagttaaataaatggatgtgaactggctcattcagaagccagattcctactgcttgctatcatctaattcactctttctcatgactttctcttatgactagactggtccccaaatctccaggtcaagcccagtctgctcacctgtaagcacatttttcttttctcaaacgaaatcgctcttttaagtgattgttttggtatttgcctctttctctctaaatgcatacttctattactatttctttggtgggtttttttccataataggcatcatcttccacagtggaagaagctaccacctccagccctaccatacataaggaatgccaccattctccactgaaccccctgcctttaatttgggttagaggaattttataactgtgtaaatacttttgaaagctaaaccagggagtggattaccattatatttccttttctgtacagtgtttttctgcaggtagcaaagggcttgtttctcatttattgaatgttctgtatacctaccactgattcaacctcaaattatttccatgttgtataaatctttatctttgggacactttagttattctgttcatttcatctcttgaaagaaggctgcctggctgggcgcggtggctcacacctataatcccagcactttgggaggccgaggcaggcggatcacgaggtcaggagattgagaccacggtgaaacccatctctactgaaaaaaaaaatacaaaaaattagccgggcgtggtggcgggcgcctgtagtcccagctactcgggaggctgaggcaggagaatggcgtgaacccaggaggcagagcttgcagtgagccgagatagcgccactgcactccagcctgggcgacagagcaagactccgtctcaaaaaaaaaaaagaaggctgctagagccttcttagcttctccaatctgaacaagctgtgccctctcttgtatacactggaggcattctgggatctcccatcaccatcatccttggtaatacttttgcctctcttctgtgtttaatgccctattttatctatcccttgtcattccctcttggtttactccctcacttgttttttacatcttctagtaacttctgatagcctgagaaaagatatatggatgataaacgttttgagacctttcatatctgaaaatgtctttatcctaccctctcacttaattggtagtttggccagatttagaattatttgtgtgtatatatgtttaagaagtccaaaatcatgctgatgcccagctctttgtatatcattgagttttttttgttttatgtttccctgggaggctactggatctttacttttatcctacttctgaaatatctcagtgatgtatgttgattttgattctatttttaaccatttcactgggcagttggtgagtcctttcaatccagaaactcatgtccttcaattacgtaaaattttctcaaattattttgtgacgaattccttcccttcttttgtttattctctcttcctgcaactcctattatttggatactggatgtcctggattggtcttctaatttttttttatcttttttattcaattttaaatgactttatctcttttgctaatttatgtgagatttcttcacctttttcttctagattctctgttgaaatagttatttttgctcttttgttttaatttcaaggagctgttttttttgttctctgattaaaaaaaaacatagctttcagtttgggggaacaagtaacatgatgaggatgttattgtcagtggcttggggtttgggttgggggttggttttttgtttgtttgttgttttggattttcttttttctattctttgtttcctccaagtgctttttgttggttgcttggttcttttttgtttttttttctgttttttgtttttttgttttttttgagatggagttttgctcttgttgcgcaggctggagtgcaatggtatgatcttgggggcacaacctctgccccccgggttcaagtgattctcctgcctcagcctcccaagtagctggaattacaggcatgtaccaccacacctggctaatttttgtattttcagtagagatggggtttctccatgttggtctggctggtctcgaactcctgacctcaagtgatccacgcaccttggcctccccaagtgctgggattataggcctgagccaccgcgcctggccaggttgcttggttttaatctctatctttatggtagagacttttgttggtagaaggtagctgccaggcattctcacagaaacaaggaggggagcaggctgcagtccccaacatttcctgtgcatgtgttcacttaatccccctgtttttggtatgaaacccctgccctccactgtgtgtcctctactgttgtttccagtccagaaaccctgtttcaccctttcctgacactcaacctgcattctttggctgagacggaaagtagaaaccactctaaggagtgcaggaagagatttggtaacctgacttcttaaaaaccttccaaactattcttattttagtcctccataattcactcttactttccttgggactttaaggattctaccatctaaattgggctaatcctttgttttccagagtgctgatttaagaggtcagtgactttactttctgtttttacctcctctattgctctccctttgggtttctgcctttgtttcaatgggaggtagttggacgtgtttgtcctgtccatcacctttctgttgtcatccccccattcattgtttcagctcagtaggttaactgataacttcaggatctctgaaactctgtatattgtcctcctgccaactgtctcatttatggaaccactgttcttccattctgtcagcctccaaaaataataattctaataattccttcttttatcatacaaattccttcttccatggaaatctggaactttttcccttaaaatatagtacatatttacagaagtcctactttgtatttctttttgaagaaataaagataatgagacctgatccttagattcaaggaacttccattgtagtggctgggagaaaaactgcaaactaatagatgatgagaaggaggatggggatgatgatgataacagtgatgaatcaagcaacagccaacactgttgaaattatactttgtaccgactgtgctccataccttactgtgttctttcacttaatcctaactactgtctgaaaaaggtactgagggaacagaaagaccctctcatattgttttatattgttttatactcagtacctgttttaagaaaaaaaacaaggaagtgaaatcaaagacaggcagcctggcgccaggcctaaaaccaggactgggcctgcctggcctaaacctggtagttaaaagtcaactcatgacttagaacccaatgttacccatagatttcaggcattgtatggaagaacattgtgaaactccctgctctgttctgtttcactctgactaccagtgcatgaaacacctgtcacatgtcccctagattgctcaatcaatcacgaccctttcacgtacaatctttagtgttgcaagcccttaaaagggatagaaattgtgcagtcagggagctcggattttaagacagtagcttgctgatgctcccagctgaataaagcccttccttctaaaacttggtgtctgagaggttttccctgcggctcatcctgctacatttcttggttccctgaccgggaagcgaggtgactgacagatggccgaggcagccccttaggtggcctaggcctgccctgtggagcatccctgcaggggactccagccagcctgagtgacgcgatccaaagaccgctcccaggtaggcaattgccccggtggaacgcctcgccacagcagcacgtagcaggcccctgcagtggctgagcaccaggaaggaactggcatttagagtctggacatctgaaactaggtaagaccagtctttggaacttgcccactccatttgagtggaagtgtggcctgatcacccacggcatgccttaatcggcactttgatgttgattttgggtttgacttggtttgaattgcttgacaggactggtcttgggaacttgcccactccatttgagtggtagtgtggcctgatcacccatggcgtgcctttatcggcactttggttttggttttgacttggtttaaattccttgacaagactggtcttgggaacttgccttctccattcgagtggaagcatggcctgatcacccacggtgtgcctctaccggcactttggtttttgtttttgacttgacttagattgcttgatactttggttttggttttgacctggcttggatttctggatactctgattttggtttggtgtgaactgcaaaagtgtgtgtgtgccctttttaagtgttttttgttttgtggtgtgcatgtggtgtgagtgtggtattttgtctcaaagaagcataggtcaggcacaaataagcccaccccactaggaactatgttgaaaaatttcaagaaaggatttaagggagattatagtgttacatgacaccagaaaaacttagaactttgtgtgaaatagactggccagcattagaggtaggttggccaccagaaggaagcctggacaggtcccttgtttcaaaggtatgacccaaggtaacctgtaagccaaggcacccagaccagtttccacacatagacaattacacctggttttagacccccttccccacccaacagtagttaagagaacagcagcataagtggctggcagaggcaaggaaagaccagcagggagaaaaagaggccatctataccaattctaagttaatttagactaaacaaggtcttattaatagcaaaggataattgaaatcccaaacttacaaggttttcaacagaagtgaagtttgctaaaatttaacagcgtaacatgtattatggtaacttctaatcttgtggccttacacagtctagtccaaagacacaaagaaagttctctttaaaaaaaaaaaaaatggttatcttcaaaaaaaaaaggaaaaaaaaagggggggaggcagaatttatatcaaaagagtgttatatggtaaattcttgtcctgaaataaattaactggttgtttaaagaaaaaactacttgtaataagtcagaaagttgagacacgttgaaaaattgtctgtgaaagtcgtgaaagaaaaaaagttataaaaaaaagttatgcaaaaaatgttgtataatttaaaagtaataaggcctcctgagtactactgaagaaacagtttatgtgcaaggtgtataaagtaaaatatatctttggtaaaaatattataaggaggcataagaatgtggatttttacctacattaaaaggttaaaaaaaagttattgttttaaaagtttaagcaagttttaaaatgttaattgtaaagaaaattctgtgtataaacatattagctaaagttaaaaaggtatcatccagtttttctgtgaactggatattaaaggaaaaatgcaacaggtttttcttaaagcatcaacctgctctttaacaaaaattataaaaggttaaaaaaaaagagtctataaaatcttaccttatggtcaaacatgaaaaattggataaatatgtctacaaggttttattaaaattaagtttaacattaataacacactaatataaaggtaaaatttagtttatctggtataaaaatcatacaagaaacattattaaacataaaatggtgtttagctttctttggtctaaaaactaataaaaataggtgctaaaagaaacattcattttactagaggatcataaaagttaaagacttaaactttggcaattaaaacagcataccaagatgcaaatgtctggttgaaatggatcaaatattccatctgcatgttaaacaaaagcaattgtgatgcttgtgcacatggcagaggccctgtttatctcccttccactaaggtggtcctccagtcgaccaggcatgggctgcatggtagctcttttccaggattctacagcctggagtaataagtcatgccaagctctctctgctatatcccggagtccctgcaggtcagacccgagggccatccagcctccatgccccaacactaagttcacttcgtgtctctcaccacagggaggaaacttagcattccttggagacctgaagtgatgcgatgagcttaagaattttcaagagcttatcaattagtcagcccttgttcatccccaagcggatgcgtggtagtattgtggtggacctttactgggcactctgccaaataactggagtggaacttatactttagtccaattgcctatccctttcaccctggcatttcatcaaccagaagaaaaaaaaaatggcatttggagttttaacccagactgtagggccctggccaaggccagtggcctatctctcaaaaacaactagctggggtttccaaaggctgacccccatgtctaaggtccctggcagcaacggccctgttagcacaagaagcagataagctaactcttaggcaaaacctaaacataaagtccccccatgctgtggtgactttaataaataccaaaggacatcattagctaataaatgctagactaactagataccaaagcttgctctgtgaaaatccccgcataaccattgaagtttgcaacaccctaaccccgccaccttactcctggtatcagagagcccagataaacataactgtttagaggtgttggactcagtttattctagtaggcccaacctccgagactacccttaaacatcagtagactgggggctgtacatggatgggagcagcttcgccaacccctgcaaagtgactctgaagaagacagcaagccctgctccagtcacacccagaagctgactggtccacacaggccgaagcatgaggaaactcatcgtgggacttattttccttaaaatttagacttgtacagtaaggacttcaactgaccttcctcagactgagggctgttcctagtatatacatcaagtcactgaggtaggacaaaagattgctacagtcctattgttttacagttattgtgaatgcctaggaactccaaaaggaacctgtttgtataataacactcagtaccaagtatgtaatccaggaagtgaccagcccgatgtgtgctatgacccctctgaacctcccatgatcacagtctttgaagtaagactaaggactggtccttttcctggtgacacaagtaaagtaatagctagaacagaagaaagaggggtccccaaacatgtaaccttaaaatttgatgcttgtgcttctattaatagtaatcagcaaggaatagggtgcagttctctagactggaaaaaaaagttacacagtaaaaaaaaaaattaagtatatctgtcaagaatcatatttatgtgagatgtgtcaatactggtcttgtgtcatttggacttacttggaaacaggattaaaaaggtcctgtttggctccagaaaggaaaagcagccccactgtgggagctgcagccctttagaactggtaatcacaaacccctcacacccaaaatgaaataaaggaaaatatgtatcattgagcattgatggaaaaggactagatcctagtgtaaacatcttaataaaaggagaggttcaaagacgctctccagaacccgtatttcagactttctatgatgaactaaatgtgccagtacctgagattccaggaaagactaaaaatttgtttttgcaattagccgagcatgtagcccagtctctaaaagtcacttcgtgttatgtttgtggaggaactataacaggagatcaatggccatgggaatcccgagaattaattcctacagacccagttcctgatgaattaccggcccaaaagaaccaccctgacaatttttaggttctaaaggcctcaattattggacaatattgcatagctagaaaaagaaaaaattcactcattctgcaggatgatttagttgcctaggacaaaaactgtaataatagtaccataaaaaaaaaacagttacatgatagagttccagttacatagacagagatccattcagtaaatttccaaggttgcagactgtctgggcccacccagaagtccactgggactggactgcccccagtgggttatactggatatgtggacatagagcctatgctaagctgcctgatcagtggacaggtagctgtgtaattgacaccattaaaccatctttctttttactgcccgtaaaagcaggcaaattcctgggtttccctgtctatgcttcccacaaaaaacgaagcgtagccataggtaattaaaaagatgataaatggccccctaaaaaaattatacaatactataggcctgccagctagacacaagatggctcatggggatactggacccccaattacatgctcaacagaatcatatggttgcaagctgttttagaaatcatcactaataaaaccagtcaaaccttgactattctggcccggcaaaaaaaccctcagataagaaatgctatctatcaaaatagattggctctcgactacttgctagcagctgaaagagaggtctataagaaatttaaccttactaattactgtctacacatagataatcaaaggcaagtactcaaagacatagttagaaatatgacaaaactggcacatgtgcccgtaaaagtgtagcacagattcaaccctgaagccatgtttagaaggtggttcccagcactagaaaaatttaaaactcttataataggagttataatagtaatagaaacctgcttactgctcccttgtttactacctgtacttcttcaaatgataaaaagcttcatcgctaccttagttcaccaaaatgcttcagcacaagtgtactatataaatcactatcaatctattgcacaaaaagacataagtagcaaaaataagagtgagaactcccactaataaaaagtgagagtctcaaaggggggaaatgagggaagagataaaccctctcatattgttttatattgttttatactcagtacctgtcttaagaaaaaaaacaaggaagtgaaatcaaagacaggcagcccggggccaggcccaaaaccagacctgggcctgcctggcctaaacctagtagttaaaaatcaactcatgacttagaacccaatgttacccatagatttcaggcattgtatggaagaacattgtgaaactgcctgctgtgttgtgtttcactctgactaccagtgcatgaaacccctatcatgtatcccctagattgctcaatcaatcacgaccctttcatgtaaaatctttagtgttgtgagcccttaaaagggacagaaattgtgcacttggggagctcagattttaagacagtagcttgccgatgctcccagctgaataaaacccttccttctacaactcagtgtctgagaggttttgcctgtggctcatcctgctacagtactattatcattgtcattttatgcataaggaaggagctagtgaggctatgtaactcttgtacaatactatgtgtaataaacatataaaccaatgtgctaagagaaaccaggggcagtagaaattaactcaaaaatccaagaagtcttgaaataaaatcacttccaaatttgctccttcctctggattccctttgatgccaccacacgccaggcttttttttatctcatcattaaattgaaagggtaaactcttagcaagtctttctgtacccaacccttttcattttctctgcttaccactggtaggtcatgctttgtaatatattgcttccatcttgtcattcaccacttcagaacctaatttgtttgcctatcatgccatatttggtcttctggacctactttcagtaacctggccatataggccatatccatcttgtaaccccaaaatccaacatgggtctctccattgtctttcacacaagtcctgttcttttctacctttttgcttttactaaaactgtcctctccgcctaattaatttctacctatctctcatggcctcatttttccataaagcctttcctggcagcttcgttgcagtgggattacattttctcccaaactcccataacgcttagtgctgactggctgtaccaggcatcaggtcttccccatgtacaagcaatagcttgcccaacaaatgagttatttatacttgtatccctgtatagaaacacatattttccaggcaccagcagtataccaaaaaatatttatttttgaaaagatttatcacttcaaaaagtcattctgggaaaaattataacttctttgatgcatcttatttcatggttattgttattttgacacctgatctttatagttcttggagctgataaacttcttactttacccctggatgttgttagtttcatcttagaaggacttctttgtataactgtgcacaacgtagacacttgtttgatatagggtattgtttgtaaaatttttgcataatatattgctgaaataaactataatatgggattaatgccacatttcattaaatattagatgccattgattgtaacatgtaccattatcttacgtaacacaaagatagaaaataatgctgccaatgtaaccatgatgtgccaatgattgctagatacattccaattccagatatgttaaaaggtaaatgaatacacgtacatcttagaatcgataaaatgtgagcgttgttgtgttataatattatgcattggtattaggcatctttaaattgccaatgatatttttaagtcaaattttttaaaacatgcaaggtaccacctatatgcaagtcactgtgccaagggacacaatgtgcagataaacactgatgaaaccatggctttctctactgagggtttatagtctgatagagggaacattgtataaatgaattatgtactataatccaagacggaaagtgatcagagctatccaccttgatacagtgatatagtttggctgtgtccccacccaaatctcatcttgaattgtagctaccataatccccacgtgttgtgggaggtaattgaatcatgggggtgggtttttcccgtggtattctcatgatactgaataaatctcatgagatctgatggttttataaagggcagttcccctgcacacgctgccttgcctcctgacatgtaagatgtgcctttgcatctgcttcaccatccgccatgattgtgaggcctccccagccacgtggaactgtgagtccattaaacctctttttctttataaattacccagtctcaggaatttcttcatagcagtatgaaaatggactaatacaaagagcttaaagatcctttagaaatatttatttatttatttatttagaggcagagtcttgctctgtcacccaagctggagtgcagtggtgcaatgagctcgctgcaccctccgcctccaggttcaagcaattctgctcctcagcctcctgagtagctgggactacaggcatgtgccaccacgcctggctaatttttgtacttttagtagagacaaggtttcaccatgttggtcaggctagtctcgaacttctgacctcaggtgatccacctgcctcagcctcccaaagtgctgggattacaggtgtgagccaccacacccggcctagaaatattttaaatagagtaattacctttattttggaatttttcaaagtcttcctggagaaagtggtgtgtgaaatgagttttgaaggatgaatagaattttgcaaactattgattggtaaggaggtatgccaattggggaaaataatatgtgcaaaggtatagaagcattggcattaaagaataatgaaaagtctagtttggctggaaatagaaagtagctggaggagttccccagataaactaggaaggccatggatgtcgtattgtagaaggccttgaatgcatagctgaggatatttaagatttggtaggcaatacggaaccacttaaggtcttttaacagtgcagtggtttaatgagagcttttcattacatagctggctccatctcatcttttagatcccagtttaaatgctaccctctcagagggtccaaccctcactctaagtgaattctcacctataactccaaattgccacatccagttggtttcctaggaagcacttaccactggttttgatctgtctaccaaccacctggtaagttgcatggtagggcaagtagggcgttctgttcccctttcatactctcagtgcttagcactctacatggcacttcttaggcactcagtaacagcttactaagtgtgcagacatctgagagtagcttctaacagacagttggatactttgttcaaaacaaaaacaagaattatgtgacgttatcaattcatagaggacactctgagacaggaggccaggaaacaagtcctggctcctccctaccgattccttgcatggccctggataagtcactaagactcatgccctctggtttgtttatctttccgaaaatggttgtggaggaactgactgctgaggtcttctcttcagaaatgctgcatcatccacatgcaaaatatgggtctggtgcttaggagacaaagggtgtggctcgagaggtggattttggatttgttctacagggaatacagtataatcaaagtcaagataaggatccagtttttaaaatggtctcgatcctctgcacagcatttgatgctgttggactggtagctgttctctttatctgaggcactgtagagccctgtacctcaaaccttttctactgctgcttgtctgtttctttcacccagaacccttcaccccacagatgtagatgttcaaatcatatggttctgccttcttccctcttcacatctcactccctagggtgactcttaacactccatggaaatccttgttccccctgagtctcctccttaaacatcaagcaatccagaatatttactgctcccatcaggctgttattctataggatgcaccacctggcatcccaccctattctttccacgtttcattaaattttctaacagtctttcactacagtttttgttacctaaaatctgcagtttcctgtgcatagcatagggcttgtcacacagtaggaattcagaattctttgttgactaaatgatactccattctttctgcctcatctctgtcacattccccttgcctaaaacgccctcccgacacacctggtcactattagtttttcttttttattttctttttcttttttttgttttgttttgtttttttgtttttttgagacagagtttcgctcttgttgcccaggcaggagtgcagtggcaccatctcggctcactgcaacctctgtccccggggttcaagcgattctcctgcctccgcctcctgtgtagctgggattacaggcacctgccaccacaccaggttaattttttgtatttttagtagagacggggtttcaccatgttggccaggctggtctcgaactcctgacctcaggtgatccacctgtctcagccccgctgagtgctgggattacaagcatgaccacgcccagcccctttattagtttttcatccgatatgattcctctctgtttcagtgcctggctcaggtactgtcagcttctggaagcctcccagttacactctcttccctacctgaaccacctcaggattttgttggtgtccccttgatggcattgtttgtactctgaatgatattgtagttcattgtaagctcttctcacctctttgcttttccctgctagagggttatctccctgcaggcatggacttgtgtttctcatggcttccttatcaagtaatatttaaatgaattgtgaatactatgataaaaaataagaataatagaataatcatgggacaatgtttgagcagtgtatcagagcttaaggagttactgaacaatttaaagaaataaccaagtgagaagatttcgctgacgagaatataaaattaaatcactgaaagggtgtaaaaccattccaatatcataagacagagctcattatctcgatatacagtctacttgggagtggaataagagcctttcttgaaaatgatgtgtccatgtgtagtaaattattctaataatcatggagaagtgaatacaaatctgaacacttgttttactttcttaagttctatacatcataaacaaagatattttctaaatcatgtattttattgaaataccacacatttattcattcaattttgcttgtttttgttgttgttttgtttttttgtgggatttttcgcttagtcaaaactttgtccatcagagaagaggcacattgtcatgtaatgtttatcaatagtaataacaactagaatgtcttagtccattcagactgctataagaaaataccagaaagtgggtggtttataaacaacagaaatttctcagagttgtggaggctggaaagttcaagatcaaggtgccagcagatttggcgtctggtgaggacctgcttcatagataaccatcgttcgctataacttcataaggcagatggggcgaggcagctctctgggatctctttaataatggcactgattttatccccagagggtcctgcctcctaataccatcacactggggattggtttcaacatatgaatttgcagggggcacagacattcagtccatagtagatggcttttggttattggacaactccaacatttccagtgtgtgatcaacagtttatatgatgttccatttaaatctcactataatattattttacagactgaaattgtggttaactgtgagttgattgctgagtgtcaggagctgggctgcaaaccccagcctgataaatgtgaaaccccttgccttcctgggcaaactgttccaagccaggaactccttccccacattactgcccagtgccctttaggaaatgcttcctgcagtcacactcacgataatacctgactgtgaaaagaaggcaacccacagatctcaatgttcaacttttttgttgttgcaggaagagaagttaaacttctagagaaacctaacagacaatatccacaacaggtaagctattttatctttccatgctttggtgagaaaatctattctcttcactttctgttaaattttctatcatttggtcttctgctacagtttttattacctaaaaccttaaagccagtagacacagaagtccccaaagtctccttctttctgactcactcaggtttgagtagaattgctgtttcctttttacgtttgttttttggacatacaattctaaaacgagtgtgataatgcatggttcaaccaagtctccacactgaaaagatttccagttaatctatccccccgtccccaggcaatttcaagcttctcccgtaatgtccatgcctcagaacagtggctctcagcgtgtggtcccgggacctacggcatcagcctcacctgggtacttgttagaaattcagtttctccctggaagaaaacctaggcattaccattcaggacataggtatgggcaaggacttcatgtctaaaacaccaaaagcaatggcaacaaaagatgaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaccaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaatcacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaagatgagttcatgccctttgtagggacatggatgaaattggaaatcatcattctcagtaaactatcgcaagaacaaaaaaccaaacaccgcatattctcactcatagatgggaattgaacaatgagaacacatggacacaggaaggggaacatcacactctggggactgttgtggggtggggggagggggaagggatagcattaggagatatacctaatgctaaatgacaagttaatgggtgcagcacaccagcatggcacatgtatacatatgtaactaacctgcacattgtgcacatgtaccctaaaacttaaagtataataataataagataaaataaaataaattcagtttctcaggccccatcccagacccactaaatcagagggtccaggataacgactagtcctcgagatgattccagtatactctcctgtttaggacccaggtactgtgaatacagaccttccttctctttatttctctctgagtctccttcccaagccctttaccatttccatctttgtccgaacttgcattataatcttctatatatttttactccagtggaaccagcctggtcccctcactctgtgtctcctgaaagtggtgcatgcattattcttgttcccctttgcaaattctagatggtcaagctgcctcctatctgcaaaccttatcttcctttaaggttcatgccattggcctattctgtccttttccctacttgttgcctttatctggggacttcccagtggctctagatcattcaataccataggcccaaagcctttctgactttctgcactctagtcatcctcacttccactacatttcactttccatggccacatcctggaccatgtccttcattgtagacactaatatgccaatgccaccatctcttatggctccaaattctcatgctcaaggatgccaggtcactggtcttgcttttgttccccctaacctcattaggatcctcaccctgcaggactctttcttcttccttagccaacctcttggccacacagccctaaccttttagtgcaggctccaggtccattgcttcagccatgcttgccagcactctcaagacccaagccctgttgccttatacctcaacctgggaccagggtagtaacccacattctataggcctttacctggattgccgggcactgctgggagagggaaagaatgccagaactacatgcattggcatcactcagatttttggtggccagctgaggccaaccctcagcactgctcagctgcctttcagtcgttgctcttcccctccaccacacaccattccaaaccttgtcactttgagctttcacatctagccctttcagcagacaccttgcccctacatcaagaaactcacagcttacagtcttccagcttccctccctgcatctagaactgtctccacttaaaatcacccttgcctctttccctctaggctccaaaggaaaagtgtatatctgtacatctttctaaggtgtatttcttcattagtgatcttgacttgatcctagattttcccccattgtttctactattctcagtttctttcaactatctttttcctccttggcttataaaaggtatttatctttcacctgctacgaaaccatcctataatcctatatctttgttcactgtgactgttcccttcatcttttccatctcagccaagctccctaagagttctctctcctccttttcatatgccccatgcattccttaacctgctgcagcccagcatgcacctccactgctctacaaccttcctgcatttcccaccaacaacctccttgatatgaaattcaggtgcactgttccatcctttccttatctctgaggcacctgacactctttgatggaagactgtctcctctcctgcttcttgataataaagcccaattccctccttcctctctgagcattcttcccaatcctccttatatgctcatcctcctctgcctaagagcaaacaagcagagttaagacttgcaggcaactcgcaagccccaccctcatgagttgaatagttgagaaggcaggaaagacgtcaaaaaatgaattaaataaaactgtaagttgtgctaagaatgtaaagtgaaaggtgatatgaggtggaataacagggtttaaaactggctggtttagattgggtggggtgagaaggcaaaggaaatagtctatgacaaggtccttgagatcaggagcaaaacataaattttaaagacttgaaagaaggccaatgtggccagggaaagaaaggggggacaatacaccagaaagctgtgtatgagatagaaaagacttcatctattattgtataagtttcttattaattttaagtgagttactgcagtcgacaatcataattcactgtagttatgttctataaagtcacttcaaacaaggagttagtgaatactgcacaattgctctcaggggaaatatggggttaggttcctagaagcctctggtcacaatattttcatcaactgatcaatatataacttgttttatgtgtgtttcagttgttaaagcactttatttgcatatgtattgttaattcattaacattgagctcagggctaacagcactatgactcatttctgaacaaagcttatctaacacacacattttctctgtaaggcacatcacagcattcttgcacctaggaccactagacaacacgtcagcactatgcctggggctatttttaacagtgacatcaccaacaaaaagcacaaaatgcaaacaatgggtccatgagaagaaacccatttacagtatggcacagtgccatcttgtttgagctcagctagaaacataagcatctaatgactcaaaatattttgcccactctgcacatgtccaggaatggccacacaagcaccatgagtattgatttgggggttacaaattaacgttagtaagtcagtgaattcacaaatacagaatccacaaataatgagaaccaagtgtatatgtaaagcatatcgatgaacaccaggtacataagaaggaatatgtacatttgatattttaatcatcttcattattgcatgctactaaatatcctgacagcatgagatacctctgaaaagttttaggcaggggaagtgataatgatccagattcatggcctaaaaagatcgtgactcctttgtggcaaatatgttagccagagacactagcaggtataggtgatagtaaggcgatgttgcagtcagtaatccaggtacaaaagagatgatgctgtttgaggacagggcagtgggagtgcacatagttctcctggaatgtgctctggaaatctaccagaaccactgtctgcccacctttgcccacaagccttttctaatcttcctacggttactccggagctccttgtcctatatagcatattatatgacatatttgaatctagtacttatgacactatattagtcatgtatctatatacttgtctcctttcctggacagtaaactctttctacatccctggaatcaagttcggtacttggcacataataggtgctcaggaaatatctgttgcctgaatggttggtgagtcatttaacaaacagcagagatcttctacctcttagtgtcttagcaattagcagagtgtcttacccctagtaggggggtgtttaaggcctctaaaccgtgctcagtctttccaagtgcaaaacctatttttactgtactttaaaggaatattgggttccaactctgcacacgtaggttcatctacaattaggggacaaattgtaggttttttcttgtcttccgaccagttcttgcttccagtcttgagtccggaaaaacatttataaaataaaatagttgggtgggataacttctaagattctttcaaatcagagccctatatcactctgctaaggctaccataacaaaatactctagactgggtggcttaaacaaaagaaatttattttctcagagtcctggaggccgggaggtccaagatcaagaagtcggcaaattcgattcccgggagagctctttccagcttgcagatgccgccttctcactgtgtcctcacgtgccctctcctcagtgtgctctggacccaccagcaccattcgctttcgctcacaagccttttctaatcttcccgaggttgctcaggagggagtgctctctctcctcttaaggccaccaatcctcttatgttaggaccccaccctgatgacctcatttaaccttaattacctccagaaagccctatctctaattacactcacaatgagttagggtttcaacatgtgaatttgggggaagacacaattcagtccacagcgggtactgtaagactctgggaattaccctgaactagtttattccaagcaggtggccctgagctgtgcttcctttaaaatctatttgtagccttaccagactatattatataaactcctctccacatggccacctctaaaacttcctcagcatttttagaacttaattttgtccaaatgcttcaagtttcttccagatgtctgccatctcccagatacagctacttagcaaaatcagagacattccctgtcatggagacacggcccagttcccatgtggttccagggaagatttggtcaaaacattgcccatttctacacagtgtctaaatggaactagcacccaatggttaaagaatattctcagccagggacagtggctcacctctgtaatcccagcgttttgggaggctgggacgggtggatcaccggagatcaggaggtcgagacccgcctggccaacatagtgaaaccctgtctctactaaaaatacaaaaaattagctgggcgtggtggcaggcacctgtaatcccagctattcaggaggctgaggcaggagaatcacttggacccgggagtcggaggttgcagtgagccaagatggcaccactgcactccagcctgggtgacaagagtgagactctgtctcaaaaaaaaaaaaaaaagaaagaaaaaaaaccgaatattctcgcagacaattgccatgaacatgcaaacggccaacatttcctaagcacctactatttgcaagacacatattgccagccctgtcacatgcttaagtcatgtgatcctcataggaccctgaccagtacttctggtaatgcagccataaaaatgaaagttaccatgcactgatgccaggggtgtctgacttttttatttatttattttttttgagatggagtctcactcttactgcccaggctgcagtgcagtggcgcgatcttggctcactgtaacctccgcctcttggattcaagtgattctcctgcctcagcctcccaagtagctgagattacaggtgtctgccaccatgaccagctattttttgtatttttagtagagatggggtttcaccaagttggccaggctggtctcgaactcctgacctcaggtgatccacctgcctcggcctcccaaagtgctgggattaaaggtgcgagccactgtgcccagcccggtgtctgacatttttcagcagatcctttagtaatgattgatgctgagcttgttagaaacacaggctgtcaggccccactcagagccaggtggattcctcatgacccagtgccctgtgctcctatctgtctacaagattccaccccgtacacacacacacgtacacacacacacacagacacacacactagtctttattcattaacaaactacatcttgtctgctccaaacaggagcctacttccaggaatttacagtccagagaatagggacatagcttctcaaacttttcccttaaactgtccccacgagggtacaggaggatctgggaggctggggagtgtggagaggatgaccacaagctactggcagaacttgacatctctgtgtgccttccgtttcattctagtcattcacacaaatgttgccttttcacccatgatattctgagttaattttatataacaaataatgggcttctccccccaaaaccttcgcatggggccatatttattttgtggcttacctttccctcccagctcatggccatgtatcctcatgtagaagggggggctctgagattggctcacaacacgggcagcctctggatctgggagaagtgcaaggtcagccatggaggaggagcagcaccgggtctaatctgggggaaggaacaggacccccttgactccacagacaccttcctcccccaggctcttccacagagttattgtccaaatgtacagtgggcagagaccaacccagatggagttctgatgtgcagtgattgtgtgaagaggcctctgtagaatttcaggagccttttgaccccaccattgcttggccagaccagaataaacccaatgtctagccagtgctagaggaagccctggtctcatcaggcttaaaggtgacagtaactgtgatggttaatattgagtgtcaacttgatgggattgaaggatgcaaagtgttggtcctgggtgtgtctgtgagggtgctgccaaaggagattaacatttgagtcagtgggctggggaaggcagacccacccttaatctgggtaggcaccatttaatcagctcccagcgaatataaagcaggcagaaaaacgtcaaaaggtgagactagcctagcctcccagcctacatccttctcccgtgctggacacttcctgcctcaaacatcggactccacgttcttcagttttgggactcggactggctctccttgctcctcagcttgcagatgagctattgtgggaccttgtgattgtgtgagttaacacttaatattacctcccctttacatatatgtctatcctgttagttctgtccctctggagaaccctgactaatacagtaaccatctaaaataccacatcacctacttcataaccttgccgcatagcacaacacctacactacttgggccataatttttgtttctttttttgttcttttttttttattttatttttttttgctttttgagacacagtcttactccatcacccaggctggagtgcagtggcctgatcttggctcactgccacctccacctcccgggttcaagtaattctcccacctcagcttcctgagtagctgcgattacaggcgcacatcaccacacctggctaatttttgcattttcagaagagataaggtttcaccatgttggccaggctggtctcgaactcccgacctcaagtgacccacccatatcggcctcccaaagtgctgggcttataggcacccaaaattcttgtttctgaggctttttattttattttttgagacagagccttgctccattggccaggctggagtgcaatggcacaatcttggctcactgcaacctctgcctcctgggttcaagtgattctcctgcctcagcctcccaagtagttggactacaggtgcaccaccacacccagctaatatttgtatttttagtagagatagggttccaccatgttgggtcaggctgctctagaactcctgacctcaagtgatccgcccaccttggcctcccaaagtgctgggattacaggtgtgagccaccgcgcctggtcctgaggcctttcttgtaccaagtccttctcttgagatgagtaaaataaccgctatatcctgccatctgctggtgaattgatgcaactgcacctataaaattcagcccaaatctagagaatccagttctctcttgcaaaagctattggagcacaaactgcttcttgcataatccagcggacaaaaaaaaataaaataaaataaaataaaataaacttactaggatggatgccagaaatattatagtaataaaaacaataacaacattaataataccttcactatcctactttcaacttttacaaccttgggcaagcaagttatataacctcccatttagttatctataaaatactggttcccaccttaaagggttgttttaaagttgaaatgagttaatacatgaaagatgaaagtccccaaaacagtccttggcacatagaaaacactcagtggctaactgcttattgtgattaagtactggctgtatgccagacattatagcaagcgctatgcatacttatcttagtgttcaaaacaatcctcataaactgtaactatcatcattcgcgtgttgcagattaggccactgaaactcacggaggggaagaaacttggctagaagtcacaaagctagtaagcagtggaggtggaattgctgactactctgatcctaagtcactcgcttaaccactctgctgaactgctggtgtggtgtgatcaatcttcctgaatgttcgtctaaatgccatccggcttcaccagaatcaatctctctctctctctttctctctcacacacacacacacgactatacgctctcccagggagcacccgggtgccatcatatccccagaacctagcacagtgcctggtgcataccaagacccagtggagccatcgtgaagtcagcgatgttgcacacagctgtgagcattcgtcacacacctgtcttaaggatagcaggctaattactagatggggggaaaaaatagtatcagatcttgaataaagggccacatgaaatgtttttcaatctatgaaaatgtctgtgatatgctatcgtaaagactacaggagggacaaaaggagtgacatcatcactatgttgtaataacaacaaaaaaaaccacattgaatgtgtttccacattcaacatggatatcaaagatcctgtgaacccagcagcaagaaagtcctaggaccaggccctggcctgttcctcagcattcctacagtggaagcacctctcaggtgcacagggccggcaaggccagccttggtaaaggctagagaggcagcccttctagtggtatgattccagagggttcagggccacctgtcactgagaaacaccaatttcaacccagacattctaccctcagaggctgatttctttggctcctgggaacttatttttttacatagttttctttaaaatgcaggaacaccaggaggcccagggttgccaccagtgctctgaaaaccactctgccctcctgcctggcagcatgcacctctcagcccattcccagtggagaaggggggtcactttctccatcaggagtctccctggtctgagagcctcgtccctctcagggactttgctgttacacacattctgtcccaatctcacagttcctcctggcagaggctgaagaggcatttccaaaagagctgcagagttcagggaataagacagagaacttggccttttatcattcagtcaagatcatggcctggggtgagtgtggacgtaggacccagagggcagtattgcgaagagctagttcacaaaccactgggcgtggtgccccacgtgcagcacggaagtactgaagcatgccttcagcataattctcaggatttgatgtgataacaacaaggaaatcaagtcaatgagttgaagttccccttttttcccactttatcgtttagattgttaaatttcaaagagagctttgattcacaaactcgttttgcagataaagaaactgaggactcaagagattacagcctgggcaacaagacaaaatcccatctctaccaaaaaaattaataaataaaaatagctggacacggtggcgtgtgcatgtagttgcagctactcaggaggctgaggtgggaggattgcttgagcctgggaggcagaggttgcagtgagccgagatgatgccactgtgctccagcctgggtgacagagtgagaccctgtctcaaaaaaaaagggggggagagattaaacaacttcaccatgtccatgccattggtgatggcgttatggctaggaggtaagaagtgaatttctttatttttattttattttattttattttgagatggagttttgctcttgttgcccaggctggagtgcaatggcaagatctcggctcactgcaacctccgcctcccaggttcaagcaattctcctgcctcagcctcttgagtagctgagattacaagcacctgccaccacgcccagctaattttttgtattttcagtagagatggggtttcaccatgttagccaggctggtcttgaactcctgacttcaggtgatctgcctgcttcggcctcccaaagcgctggggttacaggtgtgagccaccacgcccggccccgaggaggtggatttcttatacctgggcacagactttgcctggctaagttcacccaaacaccatatagcttaattagtttgaggagtaaaactccagtgataattaggactgtcattttgatagcagatttttcagaagtattctacaaaacatgagatctgttggttgttaataagtttgttatgagaaaaaaagttctgtagcccaataatgtagggaaataatcgggttaaacagagtgaaacagttccttctcataaccatgaatttcttcatctttaatttctgttgttcccaaacctgttttgaccagggagccttttccagggagaaaacccatgagcacttccctgcacacaaatatcccgtcaaagccagcgctagaccatgctaacacttctatcccagcacactggctattgagaatgcatgaaatggactatttgatggtgctgataacaaaagtctgcatataatccttttttttttttttttttgagacggagtctcgctctgtcgccccggctggagtacagtggcgccatctcggctcactgcaagctccgcctcccaggttcacgccattctcctgcctcagcctcccgagtagctgggactacaggcgcccgccaccacgcctggctaatttttttttttttttttttttttttgtatttttagtagagacagagtttcaccgtgttagccaggatggtctcgatctcctgaccttttgagccgccgacctcggcctcccaaagtgctgggattacaggcatgagccaccgcgcccggctgtctgcatataatctttcaagttctctaaaataacagaagcttagcctctgtaggagaaaagtaaacacatcagaaaaatttgtcccgtgagttttcaaagactgcccaaaagagtaggaaatgtttctgccaaaaaaaaaaaaaaaaaaagattgagctgtcaaagagtttatcttctagtcctttttcaactatagattcattactgtctataatgttgggcaagcagtctctagtttcttctataaaggcagcacagctcctggtagttatttttattcattcttcttgggtcaggacctcagtccctagtagcggctcactaaatatttgtctacttcgccttctggccaggttatgtgaaatctcaagctgtgttttctaaacattagcaaattgttggaaatttacatgttccattctattgtatctcctcccttccaaatactccaacttctataaacgcaaaccacctcccagcagccactttaaaagtttgttgaatagaacccttggagccggacgtccttgacccttggaattgcataatagaggttttgctgtctcccaagatgggaagggggaacaacagtctctcccatttctccgagctcctgcctccggcttgtagtttggaccactgggtagtatgagatttgattgtggaaaagggtatagaccctctgttagaatagtttatcatatctcatacccatcatgccttcattcccacgtgtcattcagcgccattccttcatttaaatagtaagaatgaagtgccccatacaagctagatgctggttggattaggcattgcctgtggggagctcatgtgtagtagggaaggcagacagccaacaagcaccaaagtccccctctaagatgcaacaacagcctgaagacaggaaccataccctttatttgcctctagagttctcatcctgggactatatatggtcttcagtatatacacaggatgatgtgtaggttggtagacttttgatgagctgccttccaagatctctctccatggtctaatttatagagactattatccttttttttttttttttttttttttttgagacagacctcactctatcatccaggctggagtgcagtggcacgatcttggctcactgcaacctccacctcccgggttcaaacgattctcctgcctcaccctcccgagtggctgggattacaggtgcctgccaccgtgcccagctaatttttgtatttttatttttattttttgagacagagtctcgctctgtcgcccaggctggagtgcaatggcgtgatctcagctcactgcaagctccacctcccaggttcacaccattctcctgcctcagcctcccaagtagctgggactacaaatgcccgccaccacgcctggctaattttttgtatttttagtagagacggggtttcaccgtgttagccaggatggtctcgatctcctgacctcgtgatctgcccgcctcagcctcccaaattttgtatttttagtagaaacagggtttcaccatgttggccagactggtctcgaacttctgacctcaagcgatcctcccacctcggcctcccaaagtgctgggattactgacgtgagccgccacacacagccatatagggaatatcttaataacatggatttcctggaggtgtcaagtcccagcccaggttgtgacaggcagagtaagaactgaccttagattcacacgtttgtttttaacttcacaccttttttttttttttctttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttttttagtagagatggggtttcaccgttttagccgggatggtctcgatctcctgacctcgtgatccgcccgcctcggcctcccaaagtgctgggattacaggcgtgagccaacgtgcccggccacacctttttagaacattttattttgacattatttcagactaacagaaaagttgcaagaaaaatgcaaagaatccccataaatcctctacccagagtccctaaacatgaacatctaccacatttgctttgttgttctctctgtctttatatacacacaattttttttctgaatcattttaagcagttatataaaccatggtcctttagctctcaaatcagtttgattatcctctatccaaaatgcttgagaacagaaatgttttagagtttggatttttttaaaattttggaatatttgcatgtatatcatgaaatatcttaggaatgggaactgagtctaaatatgacattcaaatgtttcatatataccttttacacatacctgaagataattttatatttttaataatttgtgcatgaaacaaaatttttacttcgttttcactgtggcctgtcacatgaagtcaagtgtggtatcatgtaggtgctccaaaagtttcagaaatgggagcattttggattttggatttttggatttcagatgctcaacttttactttactgtgtatttcctaaaaacaagggcattctctttttttctgccttcttcccaacattgtattgtattttcaaacatatagcaaagttgaaagaattttgtagtaaatttctgtatacccaccaccaatccatcttatattttgctgcatttcaaagtaagttgtggacctcatgtatttcccttctctgctttcacttaagcatgtatatcattaatgagaattctgtacgtgtttgcattttttgaaatgactttcattacaaaagtaatgtgttcattgtagaaaattggtaattgcagatttaaaaatctacaaatctatcagttagtagtcatttgtaccagatattgtgctatgtattttatcaacatcatctctagtcatcctttcacaaaccctaagaagaagcattatccccattttacagacaaggactctgtgagcaagttgctgcagttcccacagtggcagaatcaggatatgcatccaagtctgtcccatcccctgactctcagctgcatgccatcctgctagccttgtgtctactccaccccactctgagataaccactgttaacccttctctctcaattcttttccaggtgtgtagatttccacaaaactgtgattatattatacaagtcattttgtaactggcttttttgcacatatgcaaacctctttctccagcaccttgttaatggctgcagggtattctgttgagtaaagataccatatttaagagctaccttattgttatttatttttcaagttttcactattatgaaatcttcttgcatactactaattttatccttagggtcacaagtagaattgctgagtcagagattatgcatagtttccactgttaatacagattctcaaatttgctttcaacatctcctaccagtagtaaatgactagcagatttccctacatcctacactgacatcaagtatacattttaacaactcatttttatctgggtgcagtggctcatgcctataattccagcaccttgggaggccaaggtgggtggatcacgaggtcaggagttcaagaccagcctggccaagatggtgaaaccccatctctactaaaaacacaaaaatttgctgggtgtggtggcacgtgcctgtaatcccagctactcaggaggctgagacaggagaatcgcttgaacctgggaggcggaggtagcagtgagccaagatcatgccactatactccagcctgggtgacagagcaagactccatctcaaaaaaaaaaaagaaaaaactcatttctagttagataagcaaaaacatgtatgttttgtttagcatacctttgattgttaatcaagttgaacatattttcacatataaggctttccctttcatatactacttgttcaggtccacacggttctttttttaagttggtctcttgaataattccaacccatttcacattaaagccaatgttaagagtgaaatttttatttttcaagcagattttacttcatttatttttattttaagtttttaaaattatttttaatttttgtgggtacatggtatatatatttatggggtatgtgaaatattttgatacaggcttgcaatgcataataatcatatccaggtaaatgggatacacattgcctcaagcatttatcctttgtgttataaacaaacaagtgatattctttaattatttttaaatgtacaattaaatacttattgactgtagtcacctgttaagctatcaaataccaggccttattctttctttgtaacttttgctttgcccccattagccatccccacttctctttcacccccacccccaactatccttaacagcttctggtaaccatctatctactctctatctcctgaagttcaattgttttaatttttggctcccacagataagtgagaacatgagaaatttgtctttctgtgcctggcttatttcacttaacataacaacctcctgttctatccatgttgttgcaaagtaaaggagctcattctttttcatggctgaatagttctccattgtgagaactctataccacattttctttattcattcttctgttgcttccaaatcttggctattgtcaatagtgctgcaataaacatgggagtgcaggtatctcttcaatacagtgatttcctttctcatggatatatactcagcaatgggattgctggatcatatggtagctctgtttttagtttctgagaaacctcaaaactattctccatagtggttgtactaatttacattcccaccaactgtgtatgagagttctcttctccacatcctcaccagtatttgttgttgcgcatcttttggataaaagccattctaacagggttgaaatgatatctcattgtagttttgatgtgcatttctctgatgatcattgatgttgagcaccttttcctatactgtttgccatttgtatgtcttcttttgagaaatatctattcagatattttgcccatttttaattggattcttagattttttttttcctgtagagttgtttaagctccttacatattttggttattaatctcttgtcagatggatagtttgcaaatgttctctcccattctgtgggttgtctcttcactccgttgattgttttctttgctgtgcagaagctttttaacttgatgtgatctttgttgtccattgttgctttgggtgcctttgtttcttgggtattactcaataaatctttaatcagtccaatgtcctggagactttcccttgtcttcttgtagtagtttcatagtgtgaggtcttagatttatgtctttaatccattttgacttgatttttatatacagcaagagagagggatccagtttcattcttctgcatatgaatatctagttttcccagcaccatttactgaggaaactgtcctttccccagtgtatgttcttggttcctttgttgaaaatgagaacactataagtgtattgatttgtttctgacttctgtcttctattggtctatatgtctatgtttttatgccaaaaccatgctgtaccgattactatatctctgtagtgtaatttaaagtcaggtaatgtgattcttccattttgtttttttcgctcaggatggctttggctagtctgagtcttttgtggttccacatacattttagaattgttttttctatttctgtgaagaaatgttgatagagattgcatgggatctacagattgcgttgggtagtatggacattttaacgatattgattcttccaatccataatcatgaaatatctttctaatttttgtgtcctttttaatttctttcaccaacattttatagtcttcatagtagagatctttcacttttttggttaattgctaggtatttaattttatttgtatctattagaaatgtgatttttttcttgatttcttttttggattgttcactcttggcatatagaaatgctacaggtttttgtatgttgattttgtatcctgtgactttacttaatttgcttatcagttctaatagttctttggtggagtctttagatttccccaaatataaggttgtctcatcagcagacaaaggtaatttgacttcttcctttccaatttgcatgccccttatttctttatgttgtctgattgctctagctaggacttctagtactatgttggataactgtgatgaaaatgggcatccttatcatgttttagatttagagaaaaggctttcagtttttccccattcagtatgatactagctatggatctgtcatatatggcttttattatgtcgaggtatgttccctactatacccagtgtttttagggtttttatgaagggatgttgaactttatcaaatgccttttcagcatcagttgaaatgatcatatggtttttgctcttcattctgttgatatgatatatcacattgatttgcatatgttgaaccatccttccatccctgggataaatcccacttggtcaacttggtcataatgaatgatctttttaatgtgttgttgaatttggtttgctagtattttatttaggatttttgcattgacactcatcagggatattggcctgtagttttcttttttttgatgtgtctttgtctggttttggtatcagggtaatactagcctcatagaatgagtttgaaaatattccctcctcctctatttttgagaagagtttgagtaggattggtattagttcttctttaaatatttggtagaattcagcagtgaagctgtcaggtcccaagtttttctttgctgggagactttattacaactttgatcttgttattggtcagttcaaattttggatttcttcatcttcaatcttgataggtggtatgtgtctagtaatttatccctgttttctagattttccagtttattgacatataattgttcatagtagccactaatgatttattgaatttctgcagtatcagtcgtaatgtcttccttttcatctgattttatttatttggatcttctctcttttttcttagtctggctaaaggtttgccagttttgttatcttttcaaaaaaaaccaatcttttgttgatcttttgtattgttttcttcatttcaacttcatttctgctgtgatctttattatttcttttcttctgggtttggtttactgttgcttctctagttctttaaagtgcattttaggttatttattccaagtttttctttgtttatgtaggcctgtatagggataaacttccctctaagtactgcttttgctggatcccatagattttggtctcgtgtttccatgatcatgtgtttcaagaatttttttcagtttccttctgaatctcttcattgacccagtgtttatttaagagcttattgttgaatttccatatgttcatatcatttccaaaattcctcttggtattgatttctagttttactccattgtggtcagagaagatgtttgatatcatttcaatttttttgaatgttttaagacttgttttgtgacctaacatatggtctatccttgagaatagtccatgtgctgaggaaaagaatgtacattctacagcagttggatgaaatgttgtgtaaatatctattaggtccgtttgatctacagtacagttaagtgcaatgtttctttgctgatattctgtgtggaagatctgtccaatgctgaaagtggggtgttgaagtctccagctattgttgtattggggtctatccctctctttcgctccagtaatatttgctttatatatctgaatgctccagtgttgggcgcatatatatttacaattgttatatcctcttgctgaattgaacccttcatcattatgtaatgaccttctttgtctcatcttaaaggttttgtcttgaaatctattttgtctgacataagtatagttattcctgcccttttttggtttccattggcatggagcatctttttctatgtctttattttcagtctatgtgtgtctttataggtgaaatgtgtttctaataggcaacagatcattaggtcttttgaaaaatctattcagccactctatgtcttttgagtagacagcttagtccgtttacatttgatgttatgattaataagtaaggacttactcctgccattttatttgttttctggttgttttgtggtcttcctttccttcatttcttcttttctgtcttccttctaatgtaggtgatattctctggtgatataatttaatttcttgattttaatacttttctgtattcattgtatgtttttttaatttgaagttgccatgaggcctgcaaatactatcctaaaacccattattctggcctggtgcggtggcctgtaatcctagctctctgggagacagaggcaggtggatcacctgaagtcaggagtttgagaccagcctgaccaacatggtgaaaccccatctctactaaatacaaaaaaaattagcgaggcatggtggtgcacacctgtaatcccagctattcgggaggctgaggcaggagaattgcttgaacctgggaggcggaggttgcagtgagccgagattgcgccattgcactccagcctgggcaacagagcaaaactccgtctcaaaacataaataaataaataaccattattttaatttgataacaacttagcattgcttgcataaacaaaccaacaagaaaaaaaaccaaaaacaaaaaaacaaagattctaacttcatcccctcactttttaactttttgttgtatctatttacatattatcgtacagtctatgtcttgaaaaatttttgttattatttatgattggttcatcttttagtctttctattcaagagacatttacataccacagttacaatgttataatattctgtgtttatctgtttgcttatgattaccagtgagttttgtacctttagattatttctcattgctcattaacatccctttctttctgattgaagtactccctttagcatttcttgtaagatagaactggtgttgatgaaatctctcagcttctgtttgtctaggaaagtttacttcttcatgtttgaagactatttttgccacaaacactattccagtgtaaaagttattttccttcagcactttaaatatgttatgccactgacatgtcatatctctcctggactgtaagatttccactgaaaagtctgctgccagatgtattggagcttcattgtatgttatttgtttcttttctctgctgctttcaggatcctttctttatccttgacctttgggagtttgattactaattgccttgaggtagtcttctttgggttaaatctgcttggtgttctgtaaccttcttgtgcttggatattgatatatttctctaggtttgggaagttctctgttattatctctttgaataagctttctacccctatttttctacttctccttatggccaataactcttagatttgcccttttgaggctattttctagatcttgtaggtgtgcatcattgttttttattctttttttcttctgtgtcctctgaatatatttttaaatagcatgtcttcaaggtcactaattctttattctgtttgattaattctgctgttaagagactctgatgcattcttcagtatgtcacttgtatttttcaactccagaatttctgcttgattattttgtttcaatctctttgttaaatttatctgatagaattttgaattccttctctgtggtatcttgaatttctttgagtttcctcaatacagctattttaagttttctgtcagaaaagtcatatatctctgtttctctaggattggtccctggagctttagttagttctttcggtgaggtcattttttttttttttttggatggtcttcatgtttgtggatgctcactggtgtctgggcattgaacaattaggtattcctcatagtctttccagtttgggcttgtttgtacctgttcttgggaaggcttttcaggtattcgaagggacttgtgtgttgtgatctgagccatatctacattagaggcaccccaagcccagtaatgctatggttcttgcagactcatagaggtatcaccttggtggtcttggataagatctgaaagagttcactggattaccgggcagactcttgttccccaaacaaaagtttctctctctgtactgagccacctgaagctggggatagggtgacacaagcacccttgtggccatgatcactaggactgtgctgggtcagacctgaagccaacacagcactggatcttacccagggccctctgtaaccactagctagctagctccaatgtttgctcaaggccctaaggctctacaatcaacaggtgcaaagccagccaggcttgtgtccttcccttcagggtgacaagataccccaggccctaagtgggagctagggactgaagtcaaaatccttagagatctacctggtgctctattctactggggctgagctgtcactcaaaccataagacaaggccatttccattcttccctccccttttcccaggcaaaggatcctcttcctatcaccattactaccacaggcccacagagagtattgccaggctactgccgatgttcacttaaggcccaagggctcctcagacagtttatagtaagttctgccaggcctaggacacatccttcagggcagtggacttgcctgtggtcaagtgcaaatccagaaatgccatccaagagccaaggccttgaattagggactccaagagctcgcttggtgctctaccccactgtggctgagctggtacctaaagtgcaagacaaagtccactttacttttccctctgcttttctcaagtagaagtagtctctccccatagccaccacagctaggaatgtgctgggtctcacctgaaaccagcacatctcagagtctcacccaaggcccatagcgtactacctgggtattcctgctggttattcagggcccaagggctctccactcagcaggtgatgggtcttgccaggacttggtccttcctttcaaggaagtgcagtcccttctggcccagggtgtgtctataaatgtcatctaggagctggggcctggaatgggggcctcatgactctgcctggtgccctatgctaatgtggctgagctggtatcctatggtgtaagacaaagtcctctttactcttccctgtcttttcctcaagcacaaggaaggggtcactttcattgctgtgagctgtgctgcctgggttttgggacacgtgacacaggttctcccttagccactctggtgtctcagtagatcaggtgcccccccaggtccactggctctggccccagcacagtactgatatcttgcctaggaaccacagttcttgtggcctaggctacccttcaagtgtattaggattgcagagcactttagtccatggtggtgcggcttgccaaaactcaagttccaacaactggaatatataatttccctctggctagatctggtccaaatgctccctctgtgtgtgggtaggctggggggtcgtggcttagctgatttcagcctggttttgctttctgctctgatagggcagcactgagttcaaacgcaaagtccccaaatcactgtactctccctcccccaaacacacagatgctctctccacgacatgcagccactgccaaggaatgggcagcggcagttcaagattgtctttcctactaccctctttagtgcctctttcagcaatatgaagttaaaaccaggtacactgattgtgtacctgatttttggttcttataaaggtgcttgttggtgtagatgatagttgttaaatttggtgttcctgtggggcaatgaagtgaacatcagtggaggcttctatctggccatcttgttctgcccttccccaagagcattctcttatataaccccagtacaatgttcaaaagcaggtaattcacatcaatttaatacgattacctaatctacagaccttattcagattttaccaattatgtcaataacgaccttttagcaagaaggacatgcagtgcatcggctgtcatgtctcttaaatctccttgaatttggaagcattcttctgtctttctttgctttttcataacattacattattttaagagtacaggccagttgctttgcagactatccctcgttgtttcaactcagagtatgctcttttgtcaggaaatcacagaagtgaggctaagttctcagtgcatcctatcaggagccacatgccattgattagtctcattatggcactattacctttgattacttggttaaggcgctgtatgccgggtttctccaacgtaaggataatattttgtccttaatcatatgggggggagctactttaagactaaatatcctgtcctcctcaaaatttcacccactagtcctaccatccattgatacttcttactgacatcaattattattatgatggctatcaaatggtttttctattattatgatggctatcaaatgatttttctagttccagtatttctcgtatgtttgttagctggtttcctacttgtaaggtagagtgttccctttccctttatgtatcttagtgtggactcataagtccttgttttattcaattggctacaaatgctgtagattagtaattattttaatattccagttgttccacatttggccagtaaaacttctacaagtggattcctgtgtccttttaaaatgtccctgtcattcttcaaagctatcactatttaaaggcagcttccagatgggttgagtcttttcctatatgcccttgacttcctaatgaatactcagttaatttctctgcctggctggagaactcctgggcttccctggacttcgcccttcccctacctccattgctaccctcccagcaaggaggcttcaccaatgactgacatggcattagcatggccttctttttttattgtttgtttgtttttgtttttgtttttttttttttgagacggaatctcgctctgtcgcccaggctggagtgcagtggtgcgatctcggctcactgcaagctccgcctcccaggttcacgccattctcctgcctcagcctcccgagtagctgggactacaggcgcccaccaccacgcccagctaatttttttttatttttagtggagacggggtttcaccgtattagccaggatggtctcgatctcctgacctcgtgatagcctggccttgtttaaacacaaaacagagtcagcccccaacacagggctgcagaagcaggcggcagcagcattgggtggacacagccatcctaatggtgtttgtttttcccctgtgtaaactaagaagtggttgtgaaggattttccctttgttgcctgttgcttttttatgctccaaagaggaagcaaattttgattttgctcagtaataaagggtacccaacaactgaattcttacctttaagctagctgttgccaaaagggaggcaaggaagacagctgatagactgctcattttgaacccaatcttacgtcaaaagagcatatttttttcattgctgtgtgtcacatgctagacccggagcatttccttgttgcccctgggcttaggagaagtccttgctaaatgcaagatgtagaagtgggagtgacatatgaaaaaagaaatgaattaaatttgatatgacacatcatataaggaagaataattgtagacacaggcatgcaggggttgggtgtgagtacattagtccccacccttttcgtcagcagtcacacaaccttggacattagagcctgtccgtctgatctagagaaggaatgttgctggggaaggaaaactcagggcgaggtgagagaggacagaacctctaaccaggaagaggctgtccccgccaagctccggagaggcgcggaagcatgaccctcaggtatgggaccaggtctataggaaacccatgtggtgtgccctaatgggaggcaagccggggaggacccaaactggaaacctgattctgaaagaggaaaaccaccacaacatcctttgtaattgtgcagcttggaagaacagtatagatcctgtggttttcctggggaaggaggggagcctaaaagccgcaaatgatgtatatttccttcagaagcagggaaggggcagttttcgagtacggctgttaaatctcagcactcacttcattcggtgcaggctgctcctgtggtcttggctatagcagcagaaggcggggatggagggtgccccagggtcaatcttggtcagcctccgaggagctgggagtgcaaggtgtcactctggatgtgcctgcctgcttttcctcgccttcttgccctccttcgcctttcctccctcttttctttcctcctttctttcgccttcccctgtacacctcttgaattcaccatcataaagttgacctgagatgtttcaatgagtaatgttttatgattgcttcagttacattattacaatccagtctgccttccttgtttctcaaacagttctaagctcttttctccttttctttgacttgtttttttttttttttttactacctatcctcctgactagttgttgttgtttgttggttggtttgcttttaaagagtccaggataaacaaagtattgcaggcatgaaaagggtcaggatttcagagcgaattgtggagggggagggtcaggaggggaggggagaggaggggagaggagaggggagggtggaggagaggtattgagggaggggaggggagaggagaggtattgagggaggggaggggagaggagaggtattgagggaggggaggggagaggagaggtgttgagggagaggaggggagatcagaggtgttgagggagaggaggggagaggagaggtgttgagggaggggaggggagaggagaggtgttgagggaggggaggggagaggagaggtgttgagggaggggagggtagaggagaggtattgagggaggggaggggagaggagaggtgttgagggaggggagggtagaggagaggtattgagggaggggaggggagaggagaaatgttgagggaggggaggggagaggagaggtgttgaggaaggagaggggagaggagaggtgttgagggaggggaggggagaggagaggtgttgaggaaggagaggggtgaggagaggtgttgagggaggggaggaggtgcacgtgcttcttctcgcctgtcctatttatccagctcatctatgaattatcagcagaaaaggaaagtaaaggaggagtagaggctgggaataaaatcctgggctttagaaatggggtagtttaagagtattctgaaaggtacaatgttacacatgtgtacacagttccatagcaaaagcgatttttctgtctacgggactgttgttgtacttggggttttctatctttcaattggtgtcacagttgatagaaatataccatgtagcccttattccagaaacaagtcctacttgacattgttaatactcttgtttgtatgcataggttctggcaactagattatatctttcttggatactagacctccatctttttctttttggggggtgtgttttaatatgctgtatccaaatggggtggttaagacacccctggtctatgtttattatgaatgtttgctcatatgacccccagcaacactatatagtaggaatattattatccccatctacaggccaagtgactgaggcccaaagtcccacagtagcagggttttctgtctcctgagcccaccctcataacacctgggcgacacggctggcacaaactggaaatgtcttgattggttgcagacacacaacaggttcactgatagtgctctcgtttttaatccatagccattaaatcattcattcattccacatttattgactgcctgctctgtaccaggtgctgtcctaagtgctgagaattagacttgaagaagggtggagcacggtaaggaaagagggtggcaagagatgcacggctggtccgagggactcttctacattccatgagtcctcccaggaagagttggaaggacaaggggtttggtcctcaagcatgaagtgatttggggatgttactagttttctgtgctgctgcagcaaattactacgaacttagaggtttaaaaaaatggaagcagccgggcatggtggctcacgcctgtaatcccagcactttcagaggccaaggtggatggatcacctgaggtcaggagttcaagaccagcctggccagcatggtgaaacctcatctctactaaaaatataaaagttagctgggcgtgttggcaggcacctgtaatcccagctactggggaggctgaggcaggagaatcacttgaaccagggaggcagaggttgcagcgagccgagattgtgccattgcactccagcctgggcaacagagtgaggctctgtctcaaaaaaacaaacaaaacaaaacaaaacaatggaagtttattctctcccagttctagagaccagaagtctgaaattggtatcagtgggcttgatccaggggtgggtatcagggatcaaggtgtcaccggggccacactctttccagaggctccaggggtgaatctgttccttccctcttccagcttggggggctgccagtactcttggtttgtgacctccttgctccaatctctgcctttttggtcacattgcctcttcctcttctgtctataatcaaatgtccctccacctccttctcataagcatttatttaattgtatttagagtccacccagataaactaggcaaattgtaccatctgaaaatcctacacttaatcacatctgcaaatacctttaatttgggggctggggtggcatataaggtattatttataggttccagggattaggatgtggatatctttgggggccatttttcagcctaccatagggagttatttgtggattttatttttttaatgtaaatctagtcccttttaactaagcaaccaatctgtacttcttaaaaagcaccagtcatattcactgtggacaaaagcttatgaagcagcatccctggaaattcacctatgattgaaagaaggaaggagggacaacatgggagacagagacacagccagcaatgaatgatgtctctttctggtgcatgtgcttcatggagacagggagactggggatgcagattctgttttggcttgtctttttaaaggctgtaggcccgtcacagtggctcatgcctgtaatcccagacctttgagaggccaaggcaggcagatcacttgaggtcaggagtttgagaccagcatggccaacgtggcaaaaccctgtctctactaaaaatacaaagattagccaggcatggtggcacccgcctgtaaacccagctacttgggaggctgaggcaggagaatcgcttgaacctgggaggcagaggttgcagtgagccgagattgcgccactgcactccagcctgggcgacagagtgagactgtgtctcaaaaaaaaataataaataaaaataaaggctgtagatattagaaatgaataatatctaagagatgcttccatactcatttttaggatgttctgaggaaggaagaggccaacatggtcagttttatatgaagagaagattttgttccaaaggaaatgatggggaaaagcccagcttggggaggggtcagggaacagtgggcaagtgggaaatgagtccaccttctgccaggaagcccaagggggcatgtctttgagctgcaaaagaacaggtccacaaatcatagctgagattggcccagcggtaggaaaagcaacacagaatcaatttagtgtggttgaagcttgtgcgatgactcgggctatcacgctcctcagggcctgaatcatgggacacaatggatccgccagcttattccggcatcctttaactcttgaggagcaaatgccctggcaaggaatccgtcagaatctccttcccctcctgctgctgcgtgcagtgggccgtgccctggtgaggttcctgtgtcctctgtagaaggtaacagattagaaaagcagaagtcccttctctgtctagcatccttccaccttcttctcctcatctgcaaaatggggatgaaacacataaccccagggttgggagaaaggtctgacacagaggcaagtgtcagtgaacgtttgagaactctgaagcggtgatggaaatggggtattcctggtaaccagcaccctctctgacccacgtggtagttatccttttgccaaaatgtgtgactctcttaatacattttgagtctctagggaaaaaaaaaggcaaacttaattcctactaatatatcactcactgtgttctctaccttttacgctttcttttccaggtggtaacagaaaacaatccagatggggtgcaggtgctgtaaaataatacaaaggtaaagctggagaaatactacttctaaatggaggaatttgtgatgagcgtggggtcacttttaaagaccatgcgtgtattcagtgcatttatccagcttggggcatgatcaacattgccaacacattaagagtttggaattgttataatatcatttaaaagaacatgtgccctagatttttttaactttttttgctcacttctcaaagcatgttgggaacaccatcattttctgaggctgaatttggtctgggtttctgaggatgcctgaaatggcatcgctgaaaataaatcaccccaatcacatatgtgcttttaattttgtccacattgcatttcagaaaattgtgagtaacgtgaacataaacttctaactaagaaaaagggtaactgatgatcttgctttcttaacaaatatactgtctttttaatcatagttctattctagacctatatataaataagctgtattccactgtaatcatactgtgatgtttggctttattcaaaaactatgtattgtaagtatcattcctgtgactacagacttcatatttatcattttagtgactgcataatattccactgagaggatatactccttatggccctgttagtggacatttgttttatttgttttttattttaaaattctatgaaccactttgtattttacttcaccccttacccctccttcctccttttggctctcttcttaagagtatttcaggcagaaccttgtttatctttttcaagactgtctcgctctgtcatccaggctggagtgcaggggcgtgatctcagctcactgcagcctccgcctcccaggttcaagcgattctcctatctcagcctcccgagtagctgggattacaggtgcctaccacctcacccagctaatttttgtatttttagtaaagatggggtttcaccatgtcggtcaggctggtctcgaactcctgacctcaagtgatccacccgccttggccacccaaattgctgagattacaggcgtgagccaccaaacatttttataccaactatatctatttgatttagacatacttatctaggttgaaaagtaatcacagaaattaaattagcaggaatcgtagaaagaagcagggcctgtggtaaaaagcattaatgatggagcagacctgactggttttcattgtctttcctgaagctatctctttgatccagttcaagtgccctctcctggctatgtcaatgaagtcaacagctgcaagctagatgaagacgacactgataaattaaaaggcaaatggagcagtgaagtcttggtgcagaaaaatgaccctcagaggcagggctcaaagaagactgagagcagcagcaggacagctgatccatgggagccctgctggcctcaccaagggccgctcccacagggggacgctggaggggaacaccatgcctgcggtgtcaacggcatcggccctgctgccactccacagcccactgggaattccagccccacccaggatgacaggggctcctgggccagtactgcaaatactgttcccccaactcaacccttcctggaaggagggggcaccaggaaacaggactgtgtgctgctggcctcagaagggacccaagtcatgagaaatggagactccagagctccttctgaggcagaaagttttgccttggaagtacaagaccatgtcttccagataccagccccagattaccttcagcattggggcccagctggagacaacgttgatcataatgaaaaggactgtgttttcaagaaccatactgaggatgaatccctagagggaattcagcccccagtgggggagcatggtttgaatacgcccttctctgtgaggagaagctgggattcattgaatgaggatgtggaaacagaagttctaagcatctgctttaatgagaagggtcctgttcatgccatgcctgtggttgactcaggaaacaggcaggaggatacccatggctccgatggagatggggatggggagattgtggacgaggatgcagcggtggcggaggcccttgcagctttagaagctgctactgcaggagaagatttggatgagactgattaggggaggggatttgcacagggaggtaagctggtgtcatgctgagcatgcagatgcatttgctccctggatgcatagcaggtgattctgccagcatgcaccagtgcagccttaccagttgtttacatccagcatctgttctgattgtcagcatctgtcccatgctgcttgtcacatatctggagtttcactctgtgtagatgagctgtcattcaggacactaggagaaaaatctgagtgggtcattgtgcccatatccacagaaaatgcagaagttgaacagcttgcttgacaaccctcaaacatctttgagcacctggtacagatgtttatgagaatactctaagatctcaacccttgatcccaaaggcacacaatcacagagcattccttttgactgtaaactgtttaccttgcttttgagagccaaacattgtacccaacctggaaaaagtaactaccccaattaaagtgcctcatgtgtccccagagcatggcttaacttcagggacaatcacccagggaactaataactaaccagttgttcaacagcgggttaagctcagcagttttcacagtagagcagaagtccccaggaaacaaagggttagtcattagctgagatgttgattttaaaacaccttgaccttaacttttttacattattacttttaaatctcctttgggattggggaggctggccaaaataagtcttaaaactgcttatgtcatatttggattttaagttcatgacattcggaacagcaaagccatatatgcaatgtttttatgccattaaatgtctgattccaattaaaatataacaacgtatgtgtctttctagaagtcttaactcaaaggtggttctaattttctcagaatatcagtgaccctggatgttactttcaatgtaaagaactaatctagatggccgggcgtggtggctcatgcctgtaatcccagcactttgggaggccgaggcgggtggatcacaaggtcaggagttcaagatcagcctggccaacatagtgaaaccctgtctctactaaaaatacaaaaaattatccgggcacggtggcgggcgcctgtaatcccagctacttgggaggctgaggcaaggagaatcacttgaacctgggaggtggaggttgcagtgagctgagatcgtgccactgcactccagcctgggtgacagtgcaagactccatctcaaaaaaaaaaaaaaaaaaaagagctaagctaggcacagtggctcatgtctgtaatctgagcactttggaaggctgaggtgagaggattgccagggccaggaattcgagaccaacctgggcaatttagcgagaccccatctctatgaaaaaaaaaaaaaaaaaaagagctagactacaaaattatactcaaggaagggaccgagctggtttgcagagccatagctttggctttctctctgtcaaacttgatgccataactaaatgtcctgatcttacctcaaagatgaacaagccctctctggatttcagccttctaattcactgaaacaaggacaaccattctaacgtaactcaatggagaatttaaaggcattaaggatgctcaaaactatctagaaaaaaataaacatggaagatgctttagtttggtgttttgtaacacagaattgaaatctgactgaacttcatttgatttccagctttgccatgtgaccttggacaagttatgtatccctttacccatctgtaaagtgagaagaataattgtatgtgcttgtaaaggttaaatgagatgatgtaagtgtttagcacagtgcttggcacactaggcactcaaaaatgatgttttactagttgaaaacaattcctttaacaaacatttttacatccccacaactgaaaactctaaaactgggaagtatgtataatgtcattatttgactttggcaattatttagtataaaacatgatttctgagccttccagcacctttaaggacggcacccttacaaatgcttaatgagcctatgggtttgtttggtactgtaatgacaagccatcgcaagtgacctctatatacagggtcactcagagcccttaaaaagataaagtcttggcattgttaattgcattagaggtatgtctccttttgtatttagtacaccaaatacttaatatttcagaatgcttattccttcaatgatttcctaagtgtatcagttgagattatgttcagttgtatgggacgagtgttttatacaaatagaggcttatttacctcttatgtaaaagaagtctggagttagtgatccagggtggtagagaatgtatcactggcccgtgtatcaatgacccacatatcaatgacccacgtatcaatgacccgcatatgaatgacccatgctgcttcaatcattttggtttccttctcaagatcactttgtagtccataatggctgctgtggcttcagtcattacatttgcattccatgttggaaaaagaataaaggaataaaaacccca

SEQ ID NO: 849 - DNA, 95579 bp, Homo sapiens
agaagttctaagcatctgctttaatgagaagggtcctgttcatgccatgcctgtggttgactcaggaaacaggcaggaggatacccatggctccgatggagatggggatggggagattgtggacgaggatgcagcggtggcggaggcccttgcagctttagaagctgctactgcaggagaagatttggatgagactgattaggggaggggatttgcacagggaggtaagctggtgtcatgctgagcatgcagatgcatttgctccctggatgcatagcaggtgattctgccagcatgcaccagtgcagccttaccagttgtttacatccagcatctgttctgattgtcagcatctgtcccatgctgcttgtcacatatctggagtttcactctgtgtagatgagctgtcattcaggacactaggagaaaaatctgagtgggtcattgtgcccatatccacagaaaatgcagaagttgaacagcttgcttgacaaccctcaaacatctttgagcacctggtacagatgtttatgagaatactctaagatctcaacccttgatcccaaaggcacacaatcacagagcattccttttgactgtaaactgtttaccttgcttttgagagccaaacattgtacccaacctggaaaaagtaactaccccaattaaagtgcctcatgtgtccccagagcatggcttaacttcagggacaatcacccagggaactaataactaaccagttgttcaacagcgggttaagctcagcagttttcacagtagagcagaagtccccaggaaacaaagggttagtcattagctgagatgttgattttaaaacaccttgaccttaacttttttacattattacttttaaatctcctttgggattggggaggctggccaaaataagtcttaaaactgcttatgtcatatttggattttaagttcatgacattcggaacagcaaagccatatatgcaatgtttttatgccattaaatgtctgattccaattaaaatataacaacgtatgtgtctttctagaagtcttaactcaaaggtggttctaattttctcagaatatcagtgaccctggatgttactttcaatgtaaagaactaatctagatggccgggcgtggtggctcatgcctgtaatcccagcactttgggaggccgaggcgggtggatcacaaggtcaggagttcaagatcagcctggccaacatagtgaaaccctgtctctactaaaaatacaaaaaattatccgggcacggtggcgggcgcctgtaatcccagctacttgggaggctgaggcaaggagaatcacttgaacctgggaggtggaggttgcagtgagctgagatcgtgccactgcactccagcctgggtgacagtgcaagactccatctcaaaaaaaaaaaaaaaaaaaagagctaagctaggcacagtggctcatgtctgtaatctgagcactttggaaggctgaggtgagaggattgccagggccaggaattcgagaccaacctgggcaatttagcgagaccccatctctatgaaaaaaaaaaaaaaaaaaagagctagactacaaaattatactcaaggaagggaccgagctggtttgcagagccatagctttggctttctctctgtcaaacttgatgccataactaaatgtcctgatcttacctcaaagatgaacaagccctctctggatttcagccttctaattcactgaaacaaggacaaccattctaacgtaactcaatggagaatttaaaggcattaaggatgctcaaaactatctagaaaaaaataaacatggaagatgctttagtttggtgttttgtaacacagaattgaaatctgactgaacttcatttgatttccagctttgccatgtgaccttggacaagttatgtatccctttacccatctgtaaagtgagaagaataattgtatgtgcttgtaaaggttaaatgagatgatgtaagtgtttagcacagtgcttggcacactaggcactcaaaaatgatgttttactagttgaaaacaattcctttaacaaacatttttacatccccacaactgaaaactctaaaactgggaagtatgtataatgtcattatttgactttggcaattatttagtataaaacatgatttctgagccttccagcacctttaaggacggcacccttacaaatgcttaatgagcctatgggtttgtttggtactgtaatgacaagccatcgcaagtgacctctatatacagggtcactcagagcccttaaaaagataaagtcttggcattgttaattgcattagaggtatgtctccttttgtatttagtacaccaaatacttaatatttcagaatgcttattccttcaatgatttcctaagtgtatcagttgagattatgttcagttgtatgggacgagtgttttatacaaatagaggcttatttacctcttatgtaaaagaagtctggagttagtgatccagggtggtagagaatgtatcactggcccgtgtatcaatgacccacatatcaatgacccacgtatcaatgacccgcatatgaatgacccatgctgcttcaatcattttggtttccttctcaagatcactttgtagtccataatggctgctgtggcttcagtcattacatttgcattccatgttggaaaaagaataaaggaataaaaaccccactcactctctattaaggaccccacagaagtataattcatcccttccacattactctctttggtcaaaatctggtcacttggccacatctagctgcaagagagactaggaaatcgtcttgctagtggtgtgcgtggctttgccaaataaactcagaatgcagttactaagaaggggaaatggacaatgagtttcgaggcggtcagtttacagtctctgccacaggaggtctcaaaacccaaaagcctgggatacagctggtttcaaaagattggaagatcgtgtgtacattcagtgtgacaccaaaggggcttccacctttggtccgggggaaggaggactggacagctaccgctgctccaacttcccattgataactccaaaccggacgaaaagaagaaattcagacaaagaaggggtagggtaaggtatcagggcagacaagtctctttctcttacccagacacacactttcgcatttatatatgtatataattttacatcttagaacagctgcagagttcaccataactgacagctctgtagttttaaagattctcttttatgaataactgctttgaaaaggtcgacagatggccaatactttcaagagttctttaaaagtaattctggcccctttcatctttactccagtatccaggatcccccaaaggaaatgaaagtaaaaaatctttaggttgaaaagtaattccagcttttagccttatctaccaggttgtctaacagtgagctgtctgagcacgcttatgtgtgtagtgtcttctttctgcagcctagtgccacctcttgtcagaaaagtgatgttgaaaatagccaaccttttcaaacattgtggacaatatgaaagcacaatgcactctgattggaaggcactaactgtgattaggggcagacttcacagttccccatgaaccttaggcaattgcatcacgtggatatttaccatgttaaatcctgattttgaattaagattattttatgtatatattacatataggtttcttgagctaagaagttagatttaactttttactgggggaaaatgaactatcatataaatatgaaattaaattttttcccctcattgccaaagcagatgtagtgaatagttataactggaaaaaccagatacccaaaaaaacgaagagaattttaggtttcttacatagcacatgcccatctgtccatgctcagtaagtgctggccattcgtcattttcctccctctgccccgctctgtctctctgattctcttctcttcctacctctcccatccgtacctccaagcaggaggccttagaaagaatgaatgagacaccagatgcaagtgcaagtgcaaagatctcctgacttccctggtttggtcgtctgtgtgcaaccatgcagcagatagagcacagtcactactgcagcacaggatatagcctcctttcctggacttggacttaactcttcatcaagggcactgcttttcacacaaccaggctttatgacgaaaacgtagaaattaattgctttctggtcttgtttcattttttttctctagattaaacctcatgcatttttaaatcctctattttggagttggtgacaaacacagacaagctgacatctgtttttcatggtaaatcctttccctgttaactaatagaacaataagtcattcatttatagatttactaaatttgtaagtttctcatatgtatcaggttatacaaaccacacctaagtggtctgctaacttctgaagcactcccagccactttaagaaacattttatgcaagtcaatgtgttgatcgtagatgatgcttacctgcacatttagtcacttggagtcaactattagcaatttttttcaactgaaatatctgtactaaaaaaatgcgtttggcctgagatctaagttagtgtacggcacaaggggggaactcaatacatatttgttgattgaaagaatacataaaagaagtctggagttagtgatcttttcccggtctggttggggagatatcatgcaggtagccaggattgtgctggattgtgacatggtgtaataaaggtatacatggtgtaataaaggatgtgggagcacaaatccataggaatttgagagtttaggaattgtatttattattcaggcccttcactctcagactaccctgctctatttgaataatgaggcttgtggtggtctgtggaaaagtggacagagtagaatttgggcagctgctgaaggtttggtctctagaatgagtccacgttaccctaaggacggtaatcccaaattgagacaaaaactttaagaaaaccaatgtttggggccaagcaatggggagcttggccgacctcgttttttagtgattttgaactcaatctttaaaatcctggaagagaaggaaaaaaagggtgtatattcgtgtaatgacatccagatctcaccgttctcttggctcctagtgatgggggaaaaaaggtgcgcccagggttgacccttcagtaacacctgcagccatgcgtcatgacctccaggtgttcagaggccctgcccatgtgacacgtgcctggtacttcccatacatgtgcctctttaatcctaataaacctggggtgaaatccggctgtgcctcttgctcgctgtgtgaccttttgactttaagttccttaacgtttctgagcctcacttttctcatctgtgaaatggggatcattcctatttctaagaattgaaagcgcacattctcaaacttcagtgtgcccctgaggcatgtggtgtgcttgtttaaaaggcagatttctggacctacctctaggaattcagacttaggaggtcttgagtggggtcctggcatctacatcgtttttgtaagtaattctccgcacttggagaaacacataagactccagcagggattgccacaccttttttttatcttgcaccagttatcagtaaaaagtactgcacacacccttaatataagcacttttacaaccatactgtcttctaatatgttatatggtttacagtatttagcaatactaagatgaagtaacaacatatcagagcattaatatttttttcactcccctggggtatgtgaaacctactttggaaaccactggtttagaagatcaaatgaactagtatatataaaagctctctgtaaatagacaaaactgggcatatatatatatatatatatatatatatttttttttttttttttttttttttttttgagatggagattcattcttgttgcccaggctggagtgcaatggcacgatcttggctcactgcaacctctgcctcctgggttcaagcgattctcctgcctcagcctcccacgtagctggaattacaggcacgcgccaccacgcccagctaattctgtatttttactggagacagggttttgccatgttggtcaggctggtctcgaactccccacctcaggtgatctgcccaccttgacctcccaaagtgctgggattacaggcgtgagtcaccgcgcccagcccgggccaatatttttgaaagcacatagagcatacacatgagtgtggaccacgcacttataatataagcccacttgcaaatccagtcaacaccactgacctgcaactcttcctcctcacctgtgctgccctctgagccttgttcctaggagacttctgtatttactgcctttaagcattttggaatagttaatacagaactaagggaaaatatgacctagagaccaaaaggcagacaaagaattttacttatctccctaatcaaaactacacattccaaactaaaatgagtgaggcctttgaggaacaggctaattagaatacttgtttagtcagaatctggctactttgaaagcacaacaatgcaatttctcttgacataagttaccaacttaaaatcccacacaaaaaaatccatttctaggtccaactcattcttttccattctccaaaatattcctaaagctatggagaaaggtaaacctcagaatttacataaatcaggaagagttcacaggccacagaaggtccatagcctctactcatcagccgacgtgctgctctctctgtcttagatgttgatgcttagaaaggaaacaaaagctttaaattaccaatttctgaagacacaagatctaaggtccaaggttttcatggcatcagccataagccgggtgacaaaccatcaaggactgttgtggtttttaaattaaaatttacaggggctgggtgccgtggctcatgcctgtaatcccagcactttgggaggccgaggcaggcggatcacttgaggtcaggagttcaagaccagccgggccaaaatggcgaaaccctgtctctactaaaaataaaaaaattagccagggctggtggtgctcgcctgtaatcccagctacttgggaggctgaggcaggagaattgcttgaacccaggaggcagaggttgcagtgagctgagatcgtgctggtgcactccagcctacatatatatatacacatatatataaaatgatatgtaatatatatatatcataatatatatatatatataactcctcctatagctacttttctgcaaataactgcattagtcatgagttctttttgttggttttgttggttggctgcaaatgacagaaacccaaactagataacaaaagaatttccttgaatgttctgttctgggaaacaaagtgcaactctgtctcaaaaaaaaaaaaaaaaaaaaaaaaaaaaaaaagtttataggaagaaaatatatagagaaaaaatctgcaaagacattacttcaaaataatttgccaaatattaacgtagaaattgtattcagtaattaatttctgggagccaacaagttatgggttttggtattttgttgttgtttttagtatttttataggtatgactatagcttaacattttcagtactgctatgtgttaagcaccaaatgcagtcagccttgttctaagtactgcacgtgaatcatctcactgaagtctaccgtgacgccatgagctataggtatgattgtccccatttcacacatgggaaaatggaggctcaaacagctaaataactcatccagaatcacacaaccagacagtggcagaatctcaactgaacccagactgaacaacaaaccggtgcttttttttttgagatggagtctcgctctgtcacccaggctggagtgcagtggtgtgatctcagctcactataacctctgcctcccagcttcaagcgattctcctgtctcagcctcccgagtagctgggattacaagcgtgcaccaccatgcccagctagttttttgtattttagtagagacaaggtttcaccgtgttgcccaggctggtctcgaactcctgagctcaggcaatccacccacctcaccctcccaaagtgctaggattacaggcgtgagccaccgcgcctggcccaaacctgtgcttttaaaggtgacataatatgcctctctgtggcaacatccatgttgccattagacaaagataagggctgaatcaaaatgtgagacaacccaattttgtatatgtaaaattgtatgtattgtcaattgggattaaaagggggttttgttctggttctaaggaagattgtaataaagaatagaaaagttagtcaaggccttgtaaccataataggtctgctgcccaacgtgccgcaagtcaatagctgagacacggggttgccgcagagcaagaggtttaatgggagggccgctgaacgaggagatggaaggaaacctcaaatctgtctccctgaggagtttggggctaggcattttaaagggtttggagtaagcctaagtgtggtgatagttgattggtcgaagagtacagggtgaagtcatgggacagggtgatgaagaaactgtattctcatgctgatcccatttgtctgggtgggttggctgtcagctgtttcactggaatttgggggaaaacaccttaagcaattctaacaaaagctttatgattctaatgtcagaaatcctatctataggaacaatggggatgcacatggccaggatctagtgctactacaggacttttggtgacaaggaagtgggccaaagtacagcctgattaatgcttaatccagaattcttgttaaccctgtgaggacagcttcagctttatctgtaaaatctctgagactgtctactgtcaatggtatttttgcggcaatcgtaagaccatgaatttcctttccctacaaaggttgaggcagatccaggggccatatgtccccacccatgaaccacccctacatagcttaagattcctttcctcagtttcatcatctgtatagtggaggtgatggctaggcccctctctcggccataatgagatttaaatgagataaaaagtgcttagcacgtacccagcacaaagtaaacaataaatgttagatgtaattttgtccgagtacagtggctcacgcctgtaaacccagcactccgggaggccgaggcaggcgcatcacttgatgtcaggaattcaagaccagcctggccaacgtggcaaaaccctgtctctactaaaaatataaaaattagccaggcgtggtggtgcacacctgtaatcccagctactctggaggctgaggcaggagaattgctttaatccagggggcggaggttgcagtgagccaagattgcgccactgcactccagcctgggtgacagagcgagactccatctcaaaaaaaaaaaaaaaaaaaaaagttagatgtacttttattatccagcgaaggtcactggcccacttctatgagtaacactcaatgcttttttaaataactagatctttgttgctacccaccaaagctgtatgaatcacttctaataatactaatttctaaactgggtaagttctgttctacctacatcattaataatcgtctaaaggcaaaaatgcatcttgggggcacttcaattttagtgtatttttattctcattatcttcatcatttaacaattgtagaacacacgggaatttatcctttgaactttaagtcacattgcatttgaagtgaatatttatagcattaaaattgacctttcttttatctttcctcatgccccaaataagattttataaaataaaatgcatttttaatacaaaacagaaaccatggaagatttgggagggttgattggttattttggagaggttgtgtctggcttgggttttatttagtatggatttgtgcgtgtgtgtgtgtgtgtgtgtgtgtgtagtttttgtttgatttggtcaacactaatattcatctgtaataagtaaacccatatattttttcaatttgggtataatgttatgatttcaagagtattttgtctatgatttctcagctagattaacttaggaatgaaaataaattgagttacttttaaactcactgagatgcctatgctacatgcacatcttgtcataaaagggttaagataaaatttcagcctgaacaaacagaggaagagaccatgctccttagctggtagatctgggttcattcaacatcagtcaaggcaagaaagtcattctttccaataaggcagttgacctgccatcaggagaacctcaggccccataggctttgcagttacatcttgtacctggttccgcccccagcccaccttcgaatgttataaacaatatggctgtggcagaaacatcaaaaactaactctcaaaaggcaaaatccccatcatttattccactacagagggttggaacttggcatctctgtggccaatagattgttctgtttcatctgagagaccactgagtgagcactgactgtgcctggcctgtactaagtgcattacacatctgagctcatatgatcctcacaaccaccctaaaaggcacatattatcttcattctgtagttagaagacggggtccaaagagtttaaggtcacagacagcaaaggcatctgaatgccaaatctgtgctcttatcgggagctgtaagaatgagccctgtgccaatccaggaaagatggtgaaaggaaattctcctgaagcaataaaaggaaaagggtttgcaaaagcatttcacaacagaaaccgcaccatggccaggccttctggcgatggagtgaaggcagctctaggaagtctcagctgcagggctggatgccagagcttcactttccatgtggctctataactcctcctatagctacgtttctgcaaataactgcattagtcatgagttctttttgttggtttggttggttggttgcaaatgacagaaacccaaactagataacaaaagaatttccttgaaatgttcgtgaagttcagaagggcaactaggccttggggacaactgaatctggggcttgaaagcaaccaggctgggcacagtggctcatgcctgtagttccagcactttgggaggctgaggtgggcagatcgtttgagctcaggagttcgagaccagcctgggcaacgtgaaaaaaacctgtctctttgaaaaatacaaaataaagtagctgagcatgatggcctgtgcctgcagtcccagctacttgggaggctcaggtgggaggattgcttgagcctgggaggtcgaggctctggtgagccatgattgtgccactgcattcaagcctaggtgacagagtgagactctgtctcaaaccaaaaaaaaaaaaaaaaaagcaaccagcactgcctgtcttccctccgcacattccctccctttcatcacaccaggaaagaagactacacagcaggaaatatggtcttcaccagcccctagcccacagctttagccaccagagcaataaaccattttttccagcccatttgctggagaaaatggtttattgctctggcggctaatgctgtacctttagccatgggaaccctcatgggcttccccatgaggctatggaactctgtggctcagttccacagcaagcaactggccggctcaactcgactcagacaaagttgtgtgtgctggaccagtcacagccactctgatcagccgtgggggatggacgcatgtagacccttcaccaagttaccaaacatgccgcttacagcagtcgcgccctcggtaggggtggatgagaagacagaggatttgcaggcatttttctgatccttaaaactcctgtgagacaggtcattttacagatggcattgaggctcagaaagataagatacctttctcaatgtcacacagtggtgagtgtggggctcaaacgcaacagcaaaggtcgtgcctacttctctgagaccacaccacttccatgacagcattcagcgcgcggggttccctccaaagcggaaccgaatcattctcaccagtatccaggtaacacctgcagtgacacaagctcccaggtgagaaaatggagcgtccgatgagaaaaacaataaagacaaactggcagtgccagaaaatcagttagaaaaaaactagacttgaacctttactctcacaaaatagctaatggtagtctttcgtttttaaaggtgggcttttgtttatttattcattcagcaaaaaatcacgagtactttctgcaacaccagggcttgaaggaagatacagcaccaaccccccaacggccgtgcagttctccgattcggccagcagagggagcgaagggccagctctgtgggaggacctgcagagctggacaccagctgaaccgcgtgggcagccacaccaccccctggccacgccacaaaatgcccaagacaaagaagtcccagctgtcctttaggtgtttagagctacagtgagggtaccctggggagatctgagaacagtcctgcagcatggttctgggaagatgaggagaggagggaatccttgggtagaaccaacatgccccacccagactaaagggtcggaggatctaagaactggcaagtcaaacctcagatacaaaacatagtcctctttgaccacacaacacgccctcagtgatactatgcactaaatcgcgcgacgccatttccaagcccccaactctactgtcctcagtgagacagaaggaagggttccccgccttttggggtggaggaagcctggatgtgaagacagatttgaaaaagaagtgcaggagcattcaagaccatgggcaggccccctggcaaattcacccagggggctggtggagactatatttcctgctgtgtagtcttctttcctggtgtgaggaaagggagggaatgtgcagagggaaaacaggcagtgctggttgcttttttttgttgttgttgtttgtttgtttgtttgagacagagtctcactctgtcacctaggcttgaatgcaatggcacaattatggctcgccagagccttgacctcgcaggcttaagcaatcctcccatctgagcctcccaagtagctgggactgcaggcacgggccatcatgctcggctactttcttttgtatttttcaaagagtcagggttttttcacgttgcccaggctggtctcaaactcctgagctcaagcaatctgcccaccttggcctcccaaagtgctggaactgccagggtggggagcttgctgaaccaattgttcagggccagcgttgtgaggctagcgtccgtcaccatggggaacagaagggtcatatgtgccacattgccagctgcccactactcccctaatgagccaagaaagacatgaaagccagttagtgaccaaacgtccccattctacattacacatgtactagaggggatatcaaaaaggccaattaaccaaaaactaagcccgtcgtccccaagtgacccctttcaactataaatcgggattggaggaattctaacatccatcctagtgcacacattctgagtttctggttctcatgttgtgacttggtcacaaatgaccaaatcaacctttccacttcctcagcataagctgttattgatcatcttgttttcaaggacatacacacgcgcacacacacacgcacactccaaatcagaatcctatgaggtaccacacagagtgaagtttgctgtctatacattttaaaaatctcaaccaggatatgaaggagagatggaatgcagatggtgacaaatgactctgtgttacaaatgagtcacattaccatgcagaagcgggtggggaacaaaggagctgacttaagaaactttggcaaatacagttttgacagaatactgtaaggctaaaaacaagaaccacacacacacacagacacacacagacacacacacagacacacacacagacacacacacagacacacacatacacacagacacacacacagacacacacacacagacacacacacacatacacacagacacacacacagacacacacacacacacacagacacacacacacagacacacacatacacacacagagacacacacatacacacagtacttcagttggaaagtgtgtttctcacagtaatatattttcaaactacttaatatgtatgctagtgttgaataaacatgtaaaaatatcatagataataagagccaggtttcctcactgttggagaagaaagttacaaataaggaaagcaggaagcttagaacgagtactatggagcaagcctggagtcagaagtagcagtgtgggcacatgcttttgttttacagatagatacaaaaaatacataaagatgtgtgtatccgcatgggttggtgtgtgtgtatgtatatatgtgtgtacagggggcctagtagctgtgacatcccagcatcaatgaggacacctagtcctctttatttctaaacatcattgtccaataaaaggaaccagggctccttgggttagtggttgatttcagggctggggcaaggaaaatacaagacaagatgaacctggagaatcttgtggtgccagaaagtaataaagggctttcaaaaaagaaaggacctgtaatcctagcactttggaaggctgaggtaggtggatcacttgaggccaggagttcaaaaccagcctggccaacatggtgaaaccctgtctctactaaaaatacaaaatgtagccaggtgtggtggcgtatgcttgtaatcccagctactcaggaggctgaggcagaagaaccacttgagcctgggaggcaaacgttgcagcgagtcgagattgtaccactgcactctggcctgggcgacagagtgagactttgtcaagaaagaaagaaaaagaataaagaaagagagagagagagagagagaaagaaagagaaagaaagaaagaaagaaagaaagaaagaaagaaagaaagaaagaaagaaggaaaagaaaagaaaagaaagagaaaggaaagaaggaaagaaagagaaagaaaggaagaaagaggaaggaagggagggagggagagagagaaggagagaaagaggaagggaaggagagagggagggaggaaggaagggaagaaggaagagagggtagaagaaaggaggaagagaaagagaaggaaggagaaagaaagaaaaagaagaaagggaaggaaggaaaaagatgcaagaaaggggaaggatggaaggcaagaagaaggaggaggaggagaaggaggaggagaaggaaggaagggagagagagaaagaaaagaaagaaaaaaaggagaaagaagaaagaaagagaaagaagaaagaaagaaggaaagaaagaaaaaggaaagaagacaagagaaagaaagaaagagtgtgtaataggtggaggaaggagaaaagtaaaggatggaaccacatcaagggacatgggcaccaacctgaaagggctcctaccacagacatagccactgcagccaggatccaccaatggttggtgtggtgggttgaatgatatcccccacaagacctgttgatgttgaagtcctaccttctgagacctgtggatatgaccttatcaggaaatgggttctctgcaaatgtaatcaagttaagataaagtcatactggattagggtggaccctaaacccaatgcctggtgtccttgtaagagcagaggactccctcacacaggaaagaagacacagaatgccagaattgccagcaaccatcagaagctgggagggaggcatgggccagattataccccagagatatcagaaggaatcaaccctgcagacaccttgacttcagggtctggctttttagactgtgaaagaatacacttctgtgttctggggcacccaggttttggtaatttgttatggtagccctagaaaactcatacagatggtaaaattaatgtgtgaaagtttaagcagaaataagatattggcctaatctctaagtatctcccatctaatattcattaattacaaagggaaaatagtaactttaccaaaatgaaacctggcagacaccaccttgggcaatgatgaagattgacatcacgggtaatatgtaccatcacgttcctgacatgattcaatgggaagggcacatcacctgtatggtgtcccttcccttatgcaaaacctccgtctaatcacaagaatcagctgaaacacctaggttgagggagagtctacaaaagaactgatcagtacattcgagtgtcaagatcacgaaacacaagaaaagactaaagggcaaccacagatcagaggggacaggatccaacaactaaatgcagtgggtgatcctggaacagcagggggacattagtgagacaatggatgcaatccaaagaacgttgtggtttaatgaatggtactgtaccactgttagttttttagttgtgatcacttttttatagttaagatggtaacatacggggaaatggagggaagggtttacatgaactctgtactgcttttgcaactcttctacaagtccaaaattatcttcaaatttaaaaagcagtaacaggcatacctcattttattgcactttgctgtagtgtgctttgcagatattgtagggttttcttgtttgtttttgttttgttttttaatgaaccgtacgtgtgtggcaaccctgcaagtcgagaaggtccatcagcacttttctttcttttcttttttttttttttttttgaggtggagtcttgctctgtcgcccaggcaggagtgcagcggcacaatctcagctcactgcaacctcctcttcccaggttcaagcaattcccctgcctcagcctcccaagtagctggggatatagacacgcaccaccacacctggctaatttttttcttttttttgtatgttagtaaagacaaggtttcaccatggtggccaggatggtctcggtctcctgacctcgtgatccgcctgcctcggcctcccaaagtgcagggattacaggcgtgagccactgcgcccagccatcagcaccacttttccaacagcatgtgctcactcatgtccctgtgtcacatatgggtaattcttgaaatatttcaaacttttcaattaattattattatatctattatagtgatccgtgatcagcgatttctgatgttactattgtaattgttttgggatgacatgaactgtgcccacataaaatgacaaacttaatctgtaaatgctgtgcatgtgtgttccaactgcccgaccaaccagccgttcccgtctctctccctctcctcaggcctccctattccctgagacaaaatattaaaattaggccagttagtaaccctacaatggcttctcactgctcaagtgaaaggaagggtcacatgcatctcaccttaaataaaaagctagaaatgattaaggcgtgtcaaaagccgagacaggcagaaaattaggcctcctgtaccaaatagttaagttgtgaatgcaaagcaaagcaaaagttttgaagaaaatttaaaatgctactctagcaaatacacgaatgataagaaagtgcaacagccttattgctgatacggagacagattcagtggcctggataaaaaaatcaaaccagccacaacattcccttaagcccaagcctaatacagagcaaggtcctaactcttcagttctataatgactgaaagaagtgaggaagctgcagaaaaaaggtaggaagctgcagaaaaaaggttggaagccagcagacgttggttcataagatttttaaatttaatttttttttttttttttgagacagagtctagctctgtcacccaggctggtgtgcagtgactgcaatctctatctcccggattcaagtgatccttctactgcagcctcctgagtagctgagattacaggtgtgcaccattatgcccagctagtttttgtatttttagtggagacagggtttcgccgtgttggccaggttggtctcaaactcctgacctcaagcaatcagcccgcctcagcctcccaaagtgctgggattacaggcatgagccactgcacccagccagttcataaggattaactaaagaaaccattgccattatacagaagtacaaagtgaagcagcaagtgctaatttagaaactgcagtaaataatccagaaaatctaggtaagatcatggatgaaggtggctaaatgaaaaaacagatttggaaggagatgacatctaggattttcatagttgagaagtcaatgcctggcttcaaaacctcaaaagcacaggctctcattttaggggctaacatagctgtcaactttaggttgaagccaatgctcatttaccatcttgaaaatcataaggcccttaagaattatgctaaatcgactctgcctgtaaacagcctagataacagcacatctgttgacagcatggtttactgaacatttaaagcccactgttgagacctactgctcagaaaaaaagattccattcaaaataataactcattgacaaggacctggtcagttacccaagagctcttatggagatgtacaaagggagaaatgctttcatgcctgctaacacaacatccattctgcagcccatagattaattcccactttcaagtctaattatttaagaaaggcatttcataaggctacagccgccgtagacagtgattcctctagtggacctcagtaaagtcaattgaaatcttctggaaggaattcaccattctagatgccattaagaacatttttgattcacaggaggtaaaaatagagacattaacaggagtctggaagttgattccaaccctcacagatgacttggaggggttcaagacttcagtggaggaagtcactgcagatgtggtggaaacagcagcagaactagaatcagaagtgagcatgaagattgaactgaattgctgccatctcatgataaaacttgaatagatgaggaattgcttaacagatgatgaaagaaagtggtttcctgagatggcatctactcctggtgaagatgctgtgaacactgttgaaatgacagcaaaggatttagaatataataatacataaacttagttgataaagcagcatcagattttgagatgattgactccaattttgaaagatgttctactgtgataaaatgctatcaaacagtactgcatgctatagagaaaactttcatgaaaggtgaggtcaatcagtgcagcaaactttatcactgtgttattttaagaaattgccacagccaccccaaccttcagtaaccaccaccctggtcagtagccttcaacattgaggcaagatcctgcagcagcaaaaagattatgacttgctgaaggctcagattatcgtatttttttttagcaataaaaagtattttaaattaaggtatgtatgttttttgacagaatattattgcatatacttaatagactatagtatagtataaatataacttttttatatgcagtgggaaaccaaaaagctcatgtggctggcttgattgcaatatttgctttactgcagtaggccggggctgaacccacagtatctccaaagtatgcctgtgttaggggaaggggtactgcaggaggggaaatctcatgaggaaagtcagccaagtgatcacttgatatttcaagacacaagaaattcagcactgtaaaaaattaagctcaataattatactgccacgactgtatttccagtgtacaaggcgccaataattggatcacccacaagacaacacactgcgtttaacatttttatttttaactccgctttggtagtacaaaagtcataaaagtacaaaccagacagttaaaaatacacttgacactcgaaatggtgaaaattttccttacaaatttttacatcaaggtagtagccaactcattgatgacaccaaaaagttgtccatcattagtgttttctagagaaagtctgttgtggattccctcatccttagaaaggaggaggagtaacacaagacctgtaaacatcagttgctttgggaacacaggaattctcatcagatagttcagtataaaccagtaaaaagcgtatgtgttgaaaatactgaacgcttaattttggcaaatttggaagcctgccagacaaaaaccgctcaagtatttattagaaaatatttaaaacatactcttggtatcaatacagttttaaatatttttgagtattctcttgcctgttgtattgctatttaaaaaaaagtgctctgacttgaataagatggaaaaataattaaagctaaagaatatcttacattttatcccccaccattttgagggcatatttttaaagcaaaaaagtatgcttatttgtttttaattaaaatgattagcctagactgcacatatattatttacactaatacatacccctaaaagtcctatattgctactttctggatctcagtgaaatttatttccatactgactttctccagtccacagtgtatatgaatatgtacacatacagtgtttattagttgtcagtaaaaattctcatgaaactaaattccccatttatttaaaaggttagaaatgtttagtttgatgctggaaataaaatcattgaagtctatgtacagtaaatactttgaagtatatttttatggaaatcatcttttgggagacaaatgaaagatgtgcattttcctatatgaaataaaagaagtgctcaaggcaccccccaacactgacatggaggcgggtcttggagaccttgtaactggcctcccccacagctcaccccagagctaccataaatcatgtaatactatttatgcctctgggtcctttcaggtgttttgtaaaatgtacagttataaaaaaaaaaaagaaaaagaaaagtttgccaggcctaaagggaaaagtaactggagtgttttaaataatgagcattagttacaggatgaaaaacaggaaatacacaaagaaaaacatgccagaggtaggtgcaggcccatcttatatgagaagcagggttctaggccgggcgcagtggctcaagcctgtaatcccagaactttgggaggccgaggcgggtggatcacgaggtcaggagatcgagaccatcttcgctaatgcggtgaaaccccgtctctcctaaaaatacaaaaaaaataagccaagcgtggtggtgggcacctgtagtcccagctactcaggaggctgaggcaggagaatggcgtgaactcagaaggtggagcttgcagtgagctgagatcgtgccactgcactccagcctgggcgacagagcgagactccgcctcaaaaaaaaaaaaaaaaaaaaaaaaagagagaagcagggttcttttgttttggccttgggttgtccaaacaaatttgtgtgtgtgtgactttcaaccattttctcctttattcaatggattaaccaagaatcgctcagctaaaggttaaaaaaaaaaaaaaaacaaaaaaaaacaaaaaaccgggtgcagtggcccacgcctatattcccagcactttgggaggccgaggcgggtagatcgcctgaggtcaggagttcaagaccagcctgaccaatatagtgataccccgtctctactaaaaatacaaaaattagtcgagcgtggtggtgcatgcctgtaatcccagctacttgggaggctgaggcaggagaatcgcttgaacctggggaggtggagattgaggtgagtggagattgtgccactgcactccagcctaggggacacagcgagactctgcctcaaaaaaaaaaaaaaaaaaaccttctcaaaatgtgtaagtgctgtaggagtgacatggtggtggcaggagttaatgctgaatttgtggtcaaggaatccaaagtctagcatctggtcccatctgactccatggtcccttggggaatcaactcctcagggctaactagattatttccactgagcttttaccactgaagattcatcttttatcttttgtaacagctaacctgtatgtatcaagatcttcttacaaccagtgtcaaaataggatgcaggaactggaaaaagaaacacacactcacgtgcacacatgcatacacatatacacacacacccctgagcataagctcagactgtacatgaatagtatcactgcacatactcatcataatggaaaaactacagtgtgtacaccaaggcctgggattaggggctgggaagagtagaggctgggagtggttaagaagataaaaacagctctttccttccctggaagtataataaaattttcaacagactctttcaaccaaaacttgtttcaaagcaaactgaattctgtatatggcacagcaataatattcccttttaggttttatccacgtgcctgctgactccatgatagaaactgtataaaatatataaaaatattcccaaggcaacttcatataagttttcagtctcttagagctcttcaagtcaagtcattgctgcaagagaaaacaaaaaatgtagatctttaaccaagggtaagcatcatatcacatattaatctgcctgaatatttaaaaacacagaagaattataatctattcttaccctgtcccatcccatcccaccccattccttctaccactgtacatttttttctagaattcaggctaaagaaatttaagtaaaatataattaattccaagagttctctcgagatctggctgtttaaatgtatgtgcccctccccctttctctctcttgctcctgcttttcccatgtgatgtgccttcaataggtgtctttctaaagccccaccaaagccagttcactggaagtctctactgaccatccaagacagcacggttgggatttcaagtaagaacacaatgattaaatattccatcttaggtctttattgtaccttcagggttctggattgtatttttaagtcattctaacaactggcccttgtcaatgtctacgtttacatcacaaacaaaggcccatacttgtaaaatagctccctgcttttcaaatgactttctataactatctcatttaatgaacagctctgtgactttttactttcctgttttacagactggcataacccaggacaggactaaaattatagagctccccgtgtatgctgaaatacacataccatgcaggtgaacccacacaaggttaaggaacgaaacgttctcccacctgccaaaatcatgtgtaccctataaacactaaacaaaaccagagatagacccagcttgcagaaatatgaagaaatagcatgaagttgctagaagtgttttgaagaacatactttttacttattttacagcttgtccttcaagatatgtaccttattattatctatgttatcctcttctgtcatttggtcatccataatattcaatggtatattcaatataatattcatttggtcaaccataatattcaatattatattcaatataatattcaaagagaatagagacagagcacaagaggaagaatgagggagacagacagaaagaaagagatttatttcccaaatgagatgatgagtaaaggacctttatccccttagctaaaaaggaaacactgtccaataaaacagcatggatcaagtttttaattctaatgaaatacgtaataccctgcactgaattgccaaaactgtacaagaactgcagatttttactgtaaaactgaacaaagtcaagtctggaactactttcaggtaggtgtcaattcatataaacattctagcagagggggaaaaaaggtagaaaggccagaggtagagacatataaaaatggccctaaaaaaaaaaaaaggaaaaaatgagagggaattttccaggcaaaaccttaaactaggccattatctagaaaacaggtatggtattccactgtttttatgtctcctctttatgtgctcccttagaactagacatttttgcatcaaggaaaataacaacgtcaaaggtgggggatgtcaggcctagaaactaatgtttcatcacagtaacagttttcactgcaacctagaaacactcctcattttgagtgttttgcacagatttgaccggctttaagaactgggcatgcaagaatacaggctaagctaaaaaggaggggcctggattcaaatccagacccctactcccagccgtggaaccgtggctgtttctgtagcattctctcctagggttactggggatttgacatgagatgatcctatgcacaacgcttaatacgaggaaaagcaatcagtatgctccgaaaggttaactattctggtcattaccatcatccaattctctgctctcaacaatcacattagctttcttcaacagctgccttctgcagctgataaaaactgcactatctgtaatatctttgagagaggaagtaaaaaatacaaatcactgcttaaagtcctcactgctaataccagaaactaagcagaaaagggaaagctaatcttattaaaacccttgcagttctggtctctaattacaaacacacatttattagaaggtagcacattactggcacaacactatgaccttccaggtatttctttaacccagaacaataataaaagtgttacaaggtgccttccatattgtcctgcagcagtcagaaatcatgtgtgggtgggcacagagacaccagaaaggctaacaggagtgggtgagagaggaaacacccacccactcactgttcccagttgccatcacatgggaccacaccacactgagcaagcctggcctatctctcttcgggagaaattttgtgatgacagtttacacaagtgagtactcaagctggaaaaaattaagcgaagttccattacatggaaaacagaattcagaaatcccaaagtgtaaccattttgcttataaaacaagactgatggataaaaattaagaaccgcccagaagatttatctggaacaaaggaagaggttgtctttttctttagagtttattgcttatgacataatcttataaagataaagccataatcctctcattatactatgggtccacggaagctgccatatgtctctgattaggatatacatacaaatatctatgccttgttaaaaaggattctctagaaaaaaaaaagaaattgatccctttaaaaattagaaacatgttataagaaactaggagcctaagcggattaatgaacagtaaatgctaaaatctctaagtgtaggatgttaaggaagaaaaagtctatctgattaataataacagcactggcatttgcagagcactttctctgtgccaggtactgtcatgctaagcactctagggtcattaactcaatcttcccgatgactccataagtcaatgattcctattttcataggaggaaactgaggcttccaggttcaataatttaccaaaggccacacaattagtaacgggaaagtaggaaatccatcccaggcagtaagacctggaagaccacaaagctacctccatgctgcactgctatccagtcaccccggacacacccacagcatcactggaatcctctggtaccctcgcttctctgctccccacctgtgtggcaggcaacagaaaggaaatgcagaaactagaaatgctgccagggtctctctcaggggaaatcactgtggttgcatgaacagttaaatgatgctaaaaacctatactttaaaggggcccagtccctgggaagatcaaaagtatacacctacacaacactgaattctgatctcattctaagacaaggctatggaaccacacagtcggattaataattctcttgaccacttttaaataaaataaatagagaacgttgtttatagagctacatgacagcaatattaacactgaagtcccggagctacatttaagtgatcaatcactaataatctgtgctcctttaaggctcacacttcttagttagagatttatcttgttccaggctctactgaccattctgcagttacacgcttgcaggttatgatggctgtgcatgtgacaccatggtcctgcaatggtactgcctgcgtagatcggcatcttggcagatatcgattaatggaatcacatcacagagtattcagtgcttatagtcctttaaatcttgctctggtctaaattgtgtgttaaattttataaattaacacggataccttcttattttaataaaggctcttgtttaacaaacccaatagattcatgctaatctaggctaatccatgcaatcttttaaaatcagtgtttcccagaatgatcagcagaacctgctttagaatcggcttaaatattaccaaaaacttcagattccttgggcctctccctgagacctactaaatcagagtctacggggttgcagtccaggactctgctttcctataaggtgcttcattgattctaatgcacgtatgaaggtttaagcttttaggtaagacccagtactaatgtttttcaactgattaaaaacagcaagaattaaatccgcttccaaagggtaaaccctgcaaacacaacactataaagtcagcggaggtcaaaaaatacatctcagaaatgggggcgaaaacaagtatgacaaaatcacttaaagactgaaatattaattaaaaacttcagtaacttggccaggcatggtagctcatgcctataatcccagcactttgggaggccaaggtgggcagatcacttgaggtcaggagttcgagaccagcctggccaacatggtgaaaccacgtctctactaaaaatacaaaaattagctgggcatgatgacgcatgcctgtagtcccagctacttgggaggctgaggcaatagaatcgcttgaacctgggaagcagaggctgcagtgagccgagattgcaccactgtactccagcctgtgtgacagagtgagactccgtctcaaaacaaaacaaaacaaaaaatcagtaactcaattttaaaattacagaatctgtttttaaatgtatttcaaagtagttgggaactagaattcgactaatttgcagagggctcttgtaatgatgagatgaatgccatattatcacacctgttaaggaatcactgagggccaactatgtacaagatgccaagatgccacctaaagtctcagcaaaggatgagaagacaccatccaaaggcactgcccaagtcctgaaggagcttagtgtatgcagggaggaagcttaaacaatcagcttcgacgcaagaaaaactgagccatgctgcatatcatttttaaacacaactggaatattttataacttgtttttttcatctaataatatacagtagatgctctgtgtctgtacatataactctacatcaatctttttttctttttttttaagagacagggtctcactctgttgcccaggctggagtacagtggcacaatcatggcttgctggaacctcgaactcctgggcttaagtcatggagttcaagctaccactttatcctcccatgtagctgggactacaggtgcatgccaccctactcagctaattttttatttttttttatttatttatttttttaagtagagacagggtcactatgttgcccaggctgatctcaaacttctggcttcaagcagtcctccagcctcagcctcccgaactgctgggattacaggtatgagctatcacacccagcatctacttcaatctttggcatttgcaggccattatgaaatgcataaggcacaattcatttacttaatctcccattgatagatgtatttaaagatgcttccaggtacttgctactatgtaaataatgctaaagtgaacaactttggacattatctttgcatttatgcatgatatttattaattggaataatttggtcaaagagtacatatttaagtttttacagttccagattgccaccacaaaggtctagaccattgtagcctcctgctttggtgtgggataatgtccatctccctgcaccctcttgatttttgtttggttggttggtcgtttttcttttcttttcttttcttttcttttgagacggagtttcgctctcgttgcccaggctggagtgcaatggtgtgatctcgtctcactgcaacctccgcctcccgggttcaagtgattctcctgcctcagcatcccgagtaggtgggattacaggcatgcgccaccacccccagctatttttgtatttttaatagagatggggtttctccatgttagtcaggctggtcttgaattcccaacctcaggtgatctacctgcctcagcctcccaaagtgctgggatcacaggcgtgagccactgcacccacctccctgcaccacatttttttttttagaaggagcctcgctctgtcacccgggctggagtgcagtggcgcaatctcggctcactgcaacctccgcctcccaagttcgagcgattctcctgccttagcctcccgagtagctgggactacaggcgtgcggcatcacacctggctaatttttgtatttttagtagagtcggggtttcaccatattggccagggtggtcttgaactcctgacctcgtgatccacctgcgtcagcctcccaaagtgctgggattacaggcgtgagccaccgcacccagcccctgcacccttttaaccaaggtgaccacatgaaccagtttgcctgggaggtcttggtttatatatgtttacccagaataattattcacagtgttcccttttattctctgcagagtctctctctgtcacccaggctggaatgcagtggcatgatcctgactcactacagcctccaactactgagctcaagaaatccttccacctcagcctcccaagtagctgggactacaggtgtatgccacatgcccagctaattttttaatttttaatttgcagagacaggatctcactatgttgcccaggctggtctcaaactcctggcctcgagccatcctcccacctcagcctcccaaagcactgggattacaggtgtgagctacctcctcattttggatgtgagttatatggtcatgctagtgttaacattcatctttgtcaccagagaagcaaaaagtgatctcagtttggatttatttcattattagtaaagttgggcattttttatgtttattgactactacatcttccatgagttgcatattataacccccaatttgagaagggggcttaataactaaaaccttaattttttaatatcaatagtgagaagctttctatgtatgtgggtcaattcaggaaaaataatgtttctaggtgtgtttctccattcaaaatagaaatcactttttttaactagcatagacagaaatgtatattcctgcaaattatattatcttctttgttgaataataccagtgagaaattttgcattccttacagttttgaatcttctgacattagatttagatctgaagtctgaaggttgttctttactgggttatattctcacagcaatttcaacatacttatatatttagcaacaatgggtttcccaagtgacagcaactgaacacttgtgatttaccagcctttgagatggtagaatcagagcaccttattccaagtaaaatgtaactgacatcaaaagttattctgtacctggaaaaacaaggattcaactggaaattatttaaatgcaattcagcagttccctactagtctcaacacacttctgatttaatgtctacactaagctacaggcagaataacttattactctgaatagtaccatctctttctaataaggaaaatggaacaagttagatattgcctctctactggcttgtgagctagacagagttcagctaactggccttcagtaagcctccacttgaatatcaaatggacaatactgctattaccttataggttatgtctaacctggcctctatgagcttcaagagaatcaagaaatatcaaaaacattaattttaacacttttattggctacatgtttaaatagggctgatccgatatagtaatttaacacctaacctattttgtacttacttagggcaaaggaacagtatccctacgaagtagtagtagtattattatccccacttaacagatggagaagctggggcatcagaggctaagtaatttgcccaaagctagatagctaaaaagtgacagccaagatcttgagcgcaagaagtctgattccagaacctctatggtggaaccactacagtatcctatgtcctgttacttacagaaaataggtactgttttaacttaagctatttaatgttagtagaactcaaggtctcaaggcacaaattaagaaaaatcggccaggcgcggtggcttacgcctgtaatcccagcactttcggaggccgaggcaggcagatcacaagatcaggagatcaagaccatcctggctagtatagcaaaacctcttctctactaaaaatacaaaaaatcagccaggcgtggtggtgggcacctgcagtcctagctactcgggaggctgagacaggagaatggcgtgaacctgggaggcagagcttgcagtgagccaagatcgcgccactgcactccagcctgggggacagagcaagactccatctcaaaaaataataataataataaaataaggaaaaaaataaagaaaaataaaaatcctgattataaccattaattccattttctttctaattataggtaaaaatgtctccgaaagcctttcattttccgcttccctcaagcccccttgggtctgtctttaggccctccaaagtctctagcctccaacactgctcaatttctgcagtgaaaagagcagatgtcaaacaggtgatagggataaagaggaagaacagataagctctccttcagtgggtcaactcctggtcaacaataggaaggggccctggggcaggcccctgcccagggagatatgtgttaggaggagatggcttgctttggtggcaactcaaagcaaaacaaatcaaaaattcctggtcacccatgttgtctaaactctgggaatactaataaatatgttttagtatctcctgtgcacagaacaaggccatggaagaataacttagaaaaaacatcatagttgatgacagtaaagcatgtttttaggtccactcaaaaactcccagatcatggccataaatgtactggagccactcccaacaactgaggacaaatagggcatatagctttttaactgtgtctaccattttcactccttatggctcagtcaatgtgggagagtaaaagctggttcttcctcagtcatttgtgagtaagacaaaatctcaacagtcagggaaccacagaacctaaaaatcactaacttcaataaaaaacaaggtatgaacaagtgtagtatctatactctcatttgtagaagggcaaaaggaggggctttatatacacagatatattgcataagcatgtatatgcacagcataatcctgaaaggacatagtgaacactgatcacactggtgtcctcttgagaaaaggtttaagaggtgatacacgcaaagggattagcaggataaaaatggagcaaagatttatttttgggatttatttttcaccctgcagacttttaggctgtttaaatattttatcctatgcatttcttatatttcagttcttttttaaaaattccatttcaaacacttgtaatatccaatacactggagacagtaaaggaatgagctataaggaagcccaggtcctggctccgtaatgaactctcggcatgatcttgaacaacacatgtaacaacacacactaaacaaggggactgggaggtgcaggggagaaaagtctggtataagcactaggatagaagctctgtaagagtatggtcttcattgtctgtctgacacactgccacatccctaaacacagcaaactgcctggcacatagtagggtctcaagtaatgcttttttttttttttttttttctgagacagagtcttgctgttgtcaccccggctgaagtgcagtggcatgatctcggctcacggcaacctctgcctcccgggttcaactgactctcctgcctcagcctcccgagtagctgggactacaggtgcccgccaccatgcctacctaatttttgtatttttagtagagatggggtttcaccgtgttgtccaggctggtctcgaactcctgacctcatgatctgcccaccttggcctcccaaagtgctgagattacaggtgtgagccaccgcacccggccaagaaatactttttaaagatataattgtacctccattgatctgaactagcaatcacagctgctctggagtctgcaagtctatgaccttcatctacctggaagaaaactgaatggctcacacacctggacctgatccagacagagccttaaaatccatcagctgctcatcagatgatcccatcggatgccaaggaggccatccaaaggctggaatgatcagttctgtgagctattgagctatgtgaagaaacggcggttgatttgctttcttgccaagaaaagcaaagctccctcacactccacggccactgagcatgtaagctcccaagtataaatttcttcccatccaagccctctcactacctagccctgagatatggggaacattaatccctctaagcctggctcttcatctgtaaaataggatattattacctacaactcctaaaattgcttctaaagtcccatccttcactcagcttttctcttcatctggccggttctacctacctaggcttcacagagcagggcctgggcagatgctcacctccctccacctccacatttcagatggactcagtgggctcagtctcccacacaggagtacggcaggcatcacggcactacttttacctttgagaaatgtgtttagcaactgaaaaccaagccaggtggcctaatccatgcctactttaggtgcagtttctttttatattctgttgccccgtaagaccagtgaatcaagttaaagggttcccatcaaatctgagatccttttgctttttaaaaaagatgcattttttcctgaaaaaattacagctagagagaaaaaaataaactaactagtagtacctgcagtttctcatcattaactgcttcctggagagttaataaaagaaaagcaattgagaggactgcaaatcaagcagtacgacttccgagggggtccccaaggagcttctactataattcctgccacagagtccaaaaaaaggagccaaggagcctttcctcactgttagaggagaacatgaaggcggccgaaggtcagaagagccaccttgtgaccagccacagatgctcaggagggagtttgagccatgaaagagtcttgacaaagaggagacttttattccaaagcagaacaccggcacagcagtcacgcttaggccgaaaacgtctctgtccagcatttcaatttatcccaccctctgatttttataataaaaagaacttgtcagcaaaacttttccatctccttgttagtaattttaattccacctcttggaagaaggaaatggttctttctttctttctttttttttttttttttttgaggcagagtctccctctgtcgcccaggctggagtgcagtgcagtgtgcaatctcggctcactgcaacctccacctcccaggttcacgccattctcctgcctcagcctccagagtagctgggactacaggcacccgccaccacgcccggctaatttttttttttgtattttttagtagagacggggtttcactgtgttagccaggatggtctcgatctcctgacctcgtgatccgcccacctcggcctcccacagtgctgggattacaggcgtgagccaccgcgcccagccgggaatggttatttctaaggcctccttaatgcaaacaagaaaatggcccaaattcctaagggacttgacaaatactatctatttctgagatgtcctgagagtccaaagctgtaatgttcttaagatgtaaaaaggaattcacagtaccaaaagctgatgcttcagaaatgacctaataaataattaagaccaccagccatgacaattgttaacagcagtgaatgtttagcagatactctgtgccaaggattgacttatgaactacacatatatcgtatcatgtatgtccagcaacgatctcattttaaagatgaaataaccggggcttgaaaacattaagtaacttgcccaaaaccattggtagttaagtggcacaattaaaagtaaggagtttaaaacccagcttttaatcactgaaataaattactaaaataaaaatcaatacaatagtctgaataaaacaaaaataaaaacagatgtctaatattatgaatttttgttttgataaaagaaatgctactgtaatactgcaatactactagaaaaacacataggaggaaagttccatgacactgatctggacaatgattttttgataagatcccaaaagcgcaggcaacaaaaatggacaaatgggatttcatcaaactaaaaagcttctgcagagcaaagcaatcaacagagtgaagagataacttataaaatgggagaaaatatttgcaaaccatacatcttataaatggttactatccaaaatatataagaaacacaaacaactcaaaagcaagaaaacaaataacccaatttaaaaatggggcaaaatgggaagggagggttggggagatgatggtcaaaggacataaaatttcaattaggaggaataggccatcaaatccaaatttgagcaaaaacctctttcaggaaaaattacaactctaaagactgtatcagaaatctattgcacaatatggtggctacagttaataacaatgtattgtattcttgaaaaatgctaagagagattttaaatatcctcaccacaaaaaaatgataaatatatgatgtaatacatatgtcaatcagctcaatttagccattccataatgtatgcatgtttcaaaacaacatgtcgtacataataaatatagataatttttgtcaataaaaataaataaaatgttaaaaaaattgtaatgggcaaagattctaaatagaaatttctcaaaagaagacctacaaatggccaacaaatatatgaaaaaaaggctcaacattactaatcatcatggaaatataaattaaaactataatgagataatacctcacacctgttagaatgacaattataaaaaaagtgctgatggggatgtggagaaaaagaaattcttgcatactgttagtgggaatatacattattacagtcatcatggaaaacagtacgcaggtcactaacaaaaattaaaaatagaccgggcacagtggcttgcacctgtaatccaagcactttgggaggccgaggcaggtggatcacttgagatcaggagttcaagatcagcctggccaacatgatgaaaccctgtctctcctaaaaatacaaaagttagccaggtgtggtggcttgcatctgcaatcccagctactcaggaggctgtggcaggagaatcgtctgaacccgggaggcagaggctgcagtgagccgagattgtcccactgcattgcaacctgggcgagagtgagactctgtctcagaaaacaaacaaacaaattaaaaatagaactaccatatgatccaacaatcccacttctcagtacatatccagaggtactgaaatcagtatgtcaaagagatatctgtactgccatgtccactgctgcattatcccaatagccaagatatggaatcttcctaagagtccctgaacatatgaatgaataaaatgtagtatagatacataatgaaacactgttcggccagaaaaaaagaaggaaatcctgtcattgaagataaaatggataaacctggagcacattacattgagtgaaataagccaggcacagaacgacaaataccacgtcatctcacttacatgtggaatctaaaaaaagttgaactcatagaagcagagagaagaaaggtggttagaggtaggggcgggggaggggttggtcaaaagacacaaaattttagttagaggggataaataatttcaagagatctattgtacaacatggtgactgcagttaataacaatgtatcatattcttaaaaattgctaagagagtagatttggagtgttctcaccacgcaaaaaaattataagtatgtgtggcaatgcatacgttcattagctcaatttagccatcgcagtgtacacacatttgaaaacattacattgcacatgataaatatatgcaactttcatgtgtccattaaaatctgattaattttcaataaaaaattttaaagtatggttatgtaaacttactaaatcaatgtttccaacaggacactatcagcgaatggaacaaaagagggcagacttcagaaacatgcgacacagaatgcttaggacaggatcatttttaaaaagccaaagaccagtgacaatgaagacaaggcagtggcatttggaggctgaaagcaattcaatttatttaactttgaagaacaaaagcttattcttctcaggagaaaccaaaacacattttctgcagaaaaaagaccattttaaccgcattgccaaaataaatcaggcagagggcaagagggcaagttagatgtagccacaaacaagaactcagaccaacaaagcagggttagacgaatggggaggccatgcccaacatcagatttggggttttaaagggagaaggaaccagaagggagagagagaaatcctgccacagtcttgataacattctatttagaatataagtttagtttctggtaacaaacaccttaaacaaaagaaataaaaaaagaaacctaaccaataagtggatatgcatttgtatttgaatatttgagtctgttctacaataaaacaaaacattgcagtaaaattgtttggctaaaaatccaaatttgagcaaaaacctctttcaggaaaaaatacaactctaaagactgtatcagattgtagaagagacacatagcactcctctcctgcttcactagctgcattccagtgcagatcttctggcttcgtctagaaccagagagtctggcccagaagtaaaattttcagaatttttctagttggaaaatcaagtcatgttaaatgtcccaaacatactttttttggggggatgagatttgaaaagaaaaaaaactgcaagaaaaattttaatgaatacataatttttaaaacaccaatgaatattcccttccttcctttttcagggcctatacttcattggggtaatcagatagggccacccagcaggtctcaatctgagcaggctctactcatgggacctgctcgtcttggacccagttgaatgaagtctgtgacacctgaagcaaggctgcccaggttcaagtctaactctatcacattcttgctggtatctctaaacaagttgtttaaactctctgtgcttaagaccttcatctgcaaaatggggtactagcacctatagactgccgtggcgaggattacagaaattagctaatacacggaatgtgcctttcaaagcatgcccaagtacagaatacccaaaaaactgtaggtattataattaatttactccatggatcatggacatccatgatactattctacttttgagtttaaaatttttcataacgaagaattaatttttaatttgaaaatcaattacaacaagttggaggctcggaaaacacgtcaccctttgaaggccactcgtgctcattgtgatttgagcagcacaacacaatatgactaccttctactgagaaccaactacattccagactttctcttggctcttggattaaaacaatgaatttaataccttatttcacgttcaaggaaaccaggggtagggcagttaagtacaatgtccaaattgtgaagctcagatttgcacccatgtcttctgatcaaatccaatcctcgtttatataatcctgttgaataacagtgtgctgtgcagagaatatctcattgtaaatcagttaaatgtggtcaggacttcagatgcttggaccaaatttctataatcagaatcagacagattcgggccaaaaaaaccagctgagcaatcctaattccttctaaccttcccagatctagagtaccgctctctgggcagtggtggccaaaatcagccatggcactagttagccaagctctaatcagaggtgagtctgacaagaggatcatcttgcagttcctaatcgagggcaagccaggtcttctggtgcaatcggctccatctctcaactcactgcccagttgatgactcatactcagcctgtccttatgacccatactttctttgcagctaagctggctgggccttcctcacctaagacttgaatagccagatgcttctcttcccagatagccaagtccttcactgaccttaatcagaatgctcctctttccagctatatgaccttcaacatgtaactcacctttcccattcatcagtttcctcatctgtaaaactatgatcatagtactaaccccatttggagaggtttataatgatgacatgtgagaaacacatcagtaccatgcctagaagactagaatattgaattaacgttagctgctgttattacccatcttcatcatcctcttcttaaattcctcttgactcccttccctaaggtcaccagtaactggctgagaagccaatggtagacttttctgtactgtttctctctttaagaaggctcctattctgctcctaaactcaggaagagacgccagatctccccacaggcaaaaccgcgagggctaactaacactagaaaatgatcagagtccctatgtctcagaaaatttaggtgcacagagttgttccagattgcttccagagcaccttcaaccctctgagcccggcagattatcagagaagcttcacccaaaagccacatctctcctccactcagccacaccgaccaaaaatgaatgaatcacatggtaataatcagtagcatggacggagcatttcccacgtgccaggccctgccttcacacgtgcaacttcatggaaatctcactcccgcccctgaggcaaagagcaccacttccaatttccagtgaggcatagaaagctcaagtatcttgcccaggtcccagggttagtgagtggcacactggagcttgaacctggcagtctgactccagggttcatgtcagttttgctgtgtccctgcctgacctctcccccattgcccgccctcccttccctatgtaagtgtaaactcttctgccttcatgttcaggctctgatggttccatggagcacttagggcatgatccctcccaaatcgtcaccgttgctcttttacaagggataagaaacatggaaaggataaataccactcaagccggaacagaaataaaggagttaagatgaaagttaagccactatcaatttatcacagggttctggtgcgtgtgtgtgtggttttttttttttttttttttttttttgagaccgagtctcgctctgtcgcccaggctggagtgcagtggcgtgatctcggctcactgcaagctccgcctcccgggttcacgccattctcctgcctcagcctcctgagtagctgggactacaggtgcccaccactacgcccggctacttttttgtattttttagtagagacagggtttcaccatgttagccaggattgtctcgatctcctgacctcatgatccgcctgcctcggcctcccaaagtgctgggattacatgggattacaggcgtgagccaccgtgcccagctgcgtgttgttttttttttaagcagtgtcttgcaaaattaaaattgccaaatcaagaaataaatcactgtggcttttcaattgcctcaaaatatttggtgggaagagaaatattcgtattgaggtttcagaactgtgacacaaagaaaactggtttccaacagaataaaaggaaaaagcattggtttgtttgctccagactttttcaagtcacagtttacctaaaaatggtgacaagattacaagtcatttggcctgcatggttgtttaaaaaaaaaaaagtaagctgccaatatcgaaaatcagtgattttacattttagaagtctggattttgtctttttttgcgtaagaagatgcagcaacactaggtgctttctgcctcgtggtaatgcaagccctatatggtgggtgatgtgaattctagtttgccacaatccccaccatgccacattgcctcacaagtaatcctctatcctcattatcacacaggccaagcccctggaggcactaagtttgtgacttctttacaagaagctctaggcagacaagtaatcatgttcagtccccctcagtcttcctgggtcaaggaaagctctcccacttccctgtcaaataccattcctatgctgccacagcacctgggaggctccaagtaccttctcctcaccctgcaccactctgcccccaatgtcaccaaaaccacggctcacctgctactctgtgccactgcgttctctcttcacaggtgttgccggcacctccccattgacggtttcagccccactaacagacatcaggcttctccgttccttctggtttgacttgtgctccacttttgtaactctaaatctgaggggggaatggggagaggtgatggggtttgcttttctaataaacaagaattatgaataaagcaaaaatcatccacccagaggatctcaaatgaactcagccaaaagttaggacacaaatgaaaaacaacatattcgaacatgcattcctatccagtacattcccctggcccctgcccaaccttccagctgatttctactcagccacatcacagactaagccggatattttacagagcatgcaaaaggcatttaaaaactcaggtattggccaggcatggtggcttatacctgcaatcccagcagcactttggaaggctgaggtgggtggattgcttgagcctaggaatttgagaccagactgggtgtatggcaaaactctgtctctacagaaattacaaaaattagccaggtgtggtggtgtgcacttgtagtcccagctactcgggaggctgaagcaggagaatcacttgagcccaggagctggaggttgcagtgagccgagatcacgtcatgcactccagcctgggcaacagagctagaccctgtctcaataaggaaaaaaaaaaaaaaaaaaaaaaaaacacctcagagactcgaatattaaacagcgtcagagttgtcgtttctaacaatgatcagtttttttgtttatttgttttcgagacagagtttccctcttgctgcccagactggagtgcagtggtacaatctcggctcactgcaacctccacctcctgggtttaagcgactctcctgcctcagcctctcaagtagctgggattacagccatgtgccaccatgcctggctaattttgtatttttagtagagatggagtttcaccatgttggccaggccagtctcaaactccaacctcaggtgatccacctgcctcagcctcccaaagttttgggattataggcgtgagccaccatgtctggcctacatcagtttttttaaccacagaaacctggttaaatgctcaactggtttacaaattagactgacgtaaccagaatgtttaccagaagatgacgaacttccgaaaatatgcaactgtcaggcagtcctatctcaacacacacacgcacacacatgctctcacacatatgcagaaaatctgaagagccctagaaacacattttatcagcattagggtttgagagtaagcctttaaaaaaaatgggttaattttcattatagattaaggaaaaactaaaggaagttaaggaagagattttcattaagaattaagagttaaataaatgtattcagtttaactgttttttctagtatatcatcaccaaatcctagagtctttcataacagcttctttctagttctggtcttaatttcccttaaaaattatctgaaataaattctccttctgtgtccaaaataagatcaccaaccctgaagagaaggctctgaagaagtgaaagaaataacagggaaactgtaaacacaaatctattctgtcaaactgtaagactctcttaagtaatacatgctgaaaaacagcctggaatcattaagcgctcctagtatccaatatccaagaaagagagttggatttggggcattttaaaaagccatgtttggccaggcacggtggcttacacctgtaatcccaacactttgggaggccaagacaggtggatcacttgaggtcaggagttcgagaccagcctggccaacttggtgaaaccccgtctctcctaaaaatacaaaaattagccaggcatggtggcgggcacctgcagtcccagctactcgggaggctgaggcacgacaatcgtttgagcccaggaggcagaggctgcagtgagccgagttcacaccactgcactccagcttgggtgacagagtgagactccacctcaaaaaaaaaaaaaaaaaaaaaaaaaaaaaaaaaaaaaaggcatgttgaatctgagttgaaaatttcagcagatttttttttaaggccaacaaaacatgctttgtccaaacaagctacaggttctcactgctttgcattcataaattcccatgactctgcttcttaataaaacagtgtggtcatgaattgtgctgttttgctgtaagtggcaaacagccctgcaagtcttctccatgatgcttgtgcaacacatgatgaaactcaactgaattaaaataaaaataataccagccaacatttcttgagtgcgtaagtacccaaagctggtttaagacctttatgtgagtcacctcacctagtctacacacagcaactctatgaggtgagtgtgactgtccttctcactttacagagggggaaactgaggcatggagcaacgtaacagtttgtaagtagtggtgccaggacttgaaggaggtagaagtgacgagttcaggttactcttcccaggggggttgtcagtatactgagagagaaggatcatgtaagcagcactgttgactttcgctcagtgctcacccggtctcactccagcatgtgtgttccttaccagtactccccactgtctttccaaatgcaacatcggcaatgcagttcctgcatgggactcagcatctaacagcagaactgcaaaagcatcccactgcaaagatgcttcaggtaagggccaatggattcatcacttgaactgcaagatctccacctcacatatgggtcacaagtgaaaggtactaggaccaagaaagccaagacacagtggaaagcaccacccactaaaagaaagcagtcaaagcaattcacatggaacttaacagacagacactggagggctgtggaccagatccacgtcttctcccttcccttgcacatggcttgatgctatttctcagttccctgaaagttagcttggctgggtgatcaagttccagccagtggagtgtgagtcaaaatgatacgagccactctcaggcctagctctttcaaaacccctcgtgaacaaccttccacagacctgctcctttggctggcaaacctggcagagccacaaacgaagggggcctggaaccctggacaagtacttgaagagccacccattgatatctcaatacctgccctggattccataagtgaaatataaatgtctattctgtatacagttgaaaatctgggctttatctgttagagcaggtaggtatttatcttaatacatttaccatctgatctagcaacagccaccttttaggattcttctgttgttggaaaaatctaggactcacaccagaaaacatctaaaaagcccagagatataacctgagacaggcacagagaacatattctacatctgacaggtaagcagaagtccacacaccagagcacccatgtcacacacaaaccaaaagcatctgaagggatcttacctgccaacagaaaggaccgtgacctcgccttggcgccgtggtctgctctctctggacttgttagtgggctttataaagtgccaccgcttgtgcctacaccgatgacacacatccctctcgacaacaccgcccaccgtatgcagatgatggccacagacgtgcttccctggcgtcccccctggtgacaaaggcccaggactcactggcgggctccctggtgtgctgggggtcacggggctaatgtggggaggaaaacaaaaagagcaactggttaaaggaaatatcagcgaaggtgatctctctccctgtgatgacagaagcagtttaaattgaaagaaaaaaaaaagcgtcttccaattgtacaaatggactttgtgaacagacctcagacagcaggtactcagttctcatgaccatgcgatgacagtttatcttaagcaataataatatgattcacggtcaggcacaacagctcatgcctataatcccagcattttgagaggccaaagtgggaggattgcttgtggccaggagtttgagaccagcctgagcaacatagagagacctcgtctctgaaaaaaaatgaaaaaattagtcaggcatgatggtgcgtgcctgtagtcccagctacttgggaggcagtggtgggaggatcacttgagcccaggagttcaaggttgcagtagctatgattgtaccaccgaactccagcctggatgacagagtgagacctgtctctagaagaaaaaaaaatgtgatttatcacttctagaatggaatttattagctgggaataaaccactgcttctaatagtgatacactggctttaaagtattatgtttctttctaaaacactgatctcctttctcatgcaattatcctaatttctcacataccagagtgtctgcctatcactctaagcaaagagattctctaagtatatatgccctggaaaagggaagaacccaaattccatcaaattatcagataacttagagaaaacatttgatcaaatctccattatatcaaaggaggaaagcctttaggcaaagatatcaaaagtgatgttcaaaacagatgttgatggtgttgataacagtcataattaaatagctaacagtattctaagcatcttatatgtatatgttaatggaattaatccttataaaatcttatgatgtaggtattattaatttcttccttttaacaatgaggatattgaggcagggagaagtgaggtaacttgcccaagatcacactgcaaataagtgctggatctgagatccaaacctagaaagtttaattccagaaaccatgcaattaatcaccttgctatacagtatagtgcttcagaaacagcagagaccactttgataatctggaatatatttggctagaccatccaaaatataaaaagcagaaatatggccaggcgtggtggctcacacttgtaatcccagcactttgggaagccgaagcgggcagatcacgaggtcaggagatcgagaccatcctggctaacacaatgaaaccccatctctactaaaaatacaaaaaattagccgggggtggtggcgggcgcctgtagtcccagctaatcgggaggctgaggcaggagaatggtgtgaacccggaaggcggagcttgcagtgagcctagatcgcgccactgcactccagcctgggtgacaaagcaagactctgtctcaaaaaaaaaaaaaaaaagcagaaatacatagtcgagataagagctattttcaaaaagcatgtgtgaaggctctggcccagcagaaaaggaggaattctaacctaacagagccaaactgagcaggaatcagccctctggtgcaggtgggagtactgagggtggcgtggcacccacagcctgacacctggactgtggcaagagccccagagacacacaggaggctgtgatggcagaaaccagccttttcggtgatgcaaactggccacctacacacttaaaaaagaagtagagcctacggttgaggagaccgcctcaaacatgactgagccaaaagtcttctggtgctctttagggatgccttcctacctgttaaaataaaaacacaaagcagtaccttcctggagtaaaataatgttaaattagcaccacatattagaaagctgaatgcaagagtttaacaacattcattcaacaagcatttctcaagtaccagctatgtacaaaacccactgacgggcactacaggatgcccaaagatgactgagacaaagacaccttgagctaagatggtcagaacaccagccgtctgtggccaggactggaatgtgggagaaatcagagctcttctgtctctatgactctacgtctctcctaaactcaactccttgcattctgagttacctttctaaaacacacatctaacgtagccagtttgacaaacacctgttaaacatctaaggtgtgctgagtgcacaacccacatagcaagtgaagaaagatccagcccctttgccatgtcagttggcctggccaccctggactgaacccttcacaggtgagtcccaggctatcatgatgtggtgacttttcttctggcccttcttcctacagccagccctgactcttgtctccacctcctgcacgcctggttcagatggcacctcttccatgaaccttcctgaatgcccattggccccccggggtcccccagagccttcagtctccacccatcctacagcattcacaggctctccaccatgaggcctcacacacacatctccaatcctgtgttcctccatggcaagggtctgtggatgtccagctccagagcagcacccagcacacagtaggcatccaataaatgctccttgttgaagaaataatacttttatggaaatacagttctctgtaattaattatgaaggaatatgctgctcaacaaccataacctaaaatagtaatacaaaaacagaacatagcaggtagctccaaaccagcttgttcatttaatcatcattgttcatggaggtctttcaatgcttaaggtactctgtattccttataacaaccctataaagctggtactgtggtgatctccattttatagatgatggaactcagggtggtcagttaacttcctcaagaacagacagttaatattgtggtacaggcaggactcaaccacatctcccaattccaaggctatgttcttgcccttaacctctatgccttccttcttcccatcactattctctaacacagcagttctcaaccaggagtgactgtccccactacgggacattgacaatgtgtggagacattatgggttgtcacaccttgggagggtgggggcaggggatgctctgacaccttgtgagtgaaggccagggatgctatcaaacatcctcaatacacaggacagttccgcacagcaaagaactacctggtcccaaaataactatagtgttaaagctgggaaacctgctctagcagaagagcatttcagatggcgccatatctgagcaagtaactgaaaagatgtcgcactaagaaagaggggaggagcactcacctttcaggatcatacaggctgttatctgctaccatcgcctttaagacatcagcattcgctaaggaataaaaataaaattaaagaattaaaatagaatgaataagatgagtaatcacatcagaaaagctgttgaaaacacatctaattccattctttcagttcatagatgaagtcctgggggcctagagaaaggagggtctcccccaacataactgcataacatggcaccatctgtcagtaacttccaccccacaggaacttagtaagaatgacaaagaatctatggcaaggagagcagatctactataaggcattgcttcttacacatcaatagcaatataaagtagaagaaaccaccccctcaccccacaccaactccaccaaactaaaggaccatttatatgccgctgctcccttgcagttaactaattttgataaatatactttgaaaaatatgatagtgaaatgtatttcataagtgacctatagtctaataacttgtatgtgccaaaataattagccctaaactctgaatcctcctgtagcatcaattctatcccatatcgattcagggatgagagaaggttaattttccagatgagcttcaggatcatataagcccttgactggccagatatcttaaaatttcaagtattggccaggcgctgtggctcacgcctgtaatcccagcactttgggaagccgaggtggacagatcacaaggtcaggagatcgagaccatcctggctaacacggtgaaaccccatctgtactaaaaatacaaaaaattagctgggcgtggtggcaggcacctgtagtcccagctacctgggaggctaaggcagaaaaatggcatgaacccaggaggcgaagcttacagtgagcagacatcacgccactgcactccagcctgggcgatgaagcgagactctgtctcaaaaaaaaaaaaaaaaaaaaaaaaatttcaagtattgatcacaacatataagttatgtaatatacgctaactttaaaaaattagacttctaaaaaatatccaaatttgtagatgggaagctaggctgtcaacaaaagcaaaaaaaaaaacctaatctaagattcttgagtcccccaacccacacccacatccacatccacacgccatgtgttttctgcctccttgtagagtggtcacgctccccaggatgaaagactgaagtgaatgttcaagtttcccttggctatttaattggcaaggccaaatgttattactggcttgtaaccttttcaattgatttctgaagcactgttctcatgactaaccacaacaattctctagagaggaaagaacaaataaaaatcactatttaccatgtaagccaacaccaacatttaatgtttaacattcaaatgacttttctagagaaggaatattaattctagttccaactgctgctgtaagttttaacagttaagggcttacaatgtggtgtttctcaacctggctttcattattgccccacccaagagccttgttcaactattttaccctaatgactctcccattaatgtacaatacggcagatatattatatactcagttatgtactatacacatatctgtgctttacatataagagagtgagtttttttttggccccgatccaatttttatcttcttaggggacacattgccccattgcaacccttgagaacatatgggtttttgcttttttctttgaagaaatattaatacaacacttaatcttttgccaaaagaaatactttacccttcacaactatctgtggatgtccaaatgcattttcaaacacaaattttgatctaaataagacctcctgtcattacaaaaacattatgaaaacggatccatagtaatttctcctgcacaataaagaagacagttccctctgtaaaacacatttaagtataatccagtaatgtcagttaatttcccttttggctaataaatgaggattcagaaaaataatgtcgtttcagatactaggtttggatatacaatcccatatacaattttgtattttattgtatacaaaatacagtagtcctcagtatccatgcggggatgttccccagatccgtgcagacaccaaaatccacagatgctcaggttcctgatatgaaacacatctccccctcccccatacactttaagtcatctttaggttacttataatacctaatacaatggaaatcctatgtaaatagttgttatgctgttttatatgggaaataatgacaagaaaaaagtctgcacatgtccagaaggatgcaaccatccattttttttttctaattttattttatccttgattggttaaatccataggtgcagatctgatggatatggatggctgattatataaagtaatttgccacccaaacttactctgccaacatttaccatacttcaaaactataaacataaaaaagagggaaaacaacaccaataggtattaaaacagggacagcactatcagcacatacaggagtgagctttttaaaatcaaacgtttaaatcactgcctgagaaaaatcaatcacctgtaaaatgatgaccacctataaaatgaaaggtcaaattacaaaataattccaggaagataagatatattaaaatcattattaaagcttgctttttgtagatgtgtgtttctcggttattcatgaattcctgtaactcatctttatctctcaggaataattagtaaacatccccttggtttgctgagtgagtctctaggactcaccctgtggcatgtgggacacacacacacacacccacatgcatgcatgtacaggtacatacccacatgtacacacatgcgtccctgtctctgagctaatctccagggagtcaacttcagtaatctgtctattgggaacatttttggtttccagtgacgagaaggttttctaatataacaccaccgttaggactgaaacacatgccttaatttggttgtgaagttaccataaaagagcaatactgtgagttctgttgaaggtgtatctcctccttgcatattactcacagctacactaagccttaggtggttttctccacacttgccggcattttgtcaactacacttcctttccccaccttccccaaaatgggaggagctaggcacagggcaaggaaactccctcaagaaaagggaatatgttccaatgggtgacattttccagaaaagacctctttttctccctgaatccctgcttgataatatgcatgaaacagccaaaatcaggcaagaaaaatgtcttctgtctctcccatcactattctcttcaaagttttcctcacacctaaggcaaatttcccaagcaaaaactaacattgccatcaccaaaatgtaagcgccggcacgtgccagtcactgcctgaaagctttaccgatcttacgtgttggacttttctgatgaccttaacagtaggtagaattatcacccccattttacaagtatacagactaagacctaaagatcgtaactgactggccggagtcacacagctagagagtgacaggcttggacacaaaccctggtctgtctgactccagggtgggtgcttttaaccctgacatcttccttcctacccttcaatgtccaagtccccgcccaaagggacagaggttgaataatggttcatggcatgttgcataatcaacagagaaagtttcagaacccactcggtactcacagtcatttataaaggaatcttttctggcaaaatataaacgaagcctgaaggcaaaaacttcacaaaggcatctcttgcctagggatcagaagtactaatcactaaccagaagcacttgaggactatctgtagtactccctgcaatttttactaagcagccagttcaagggcctagcagaggaactcagctacagactcccagatactttccaaacatccatacaatgcaagaaaactccagcgactacccagacacgattcagttcggctctatttagaaagatgaattaaaagctagcactgccgtacatccaaccctttggattaggaaaatagtcagagtgcaggtgtggcataatatgcaacagatttggtcattgtcctgggttcctgtcacagagttcctaaaggccttggaatttcctgataggagtgtcttttgttattcataatgagcaccttttgatcacacctgggtttacactaatgcggtgacttggggtggagcccctaaacagtctcagggtggggccagtcatcattaagaccaagtgattagagggttggaactttcagccctacccagggacctcaggaaagtcagagcaggggaggacggggcagggttctgggactggaaattaaactggacaaaacaactcttgaacaacaagatttgatagcttccaggtggctgaacaggtgcaggtgccgggagggtggcgcacccagagagggcaggaaagctctgcgccccaccccaatactatgcatctcttctattttgttgttcgtgagttgcatcctctataacaagccagtacatgtaataaagtgtttccctgagtcctgtaacccattctaggattgtggatccctcctcccagccatttaagattataggtcagaagtaccagagccctggcttccaactggcatcccaagtaggggcagtcttttgggatctgacgctaactctaggtagacagagtcagaactgtattaaattgcagggttcggggatttggagaactgcaaagtatggaaaaaacccacatctttgtcagaagtgttgtgtgaggatggagacaaccaaacaaacaaagtgtgtttgcccagcaggtcagctgataatccatccttcaagagatatttatctaaattaaaattgacttccaacattaaagacataatgtgtttaaaccataaacaagaatgttaccatgagtacagttcaaatatcaccccatttgccaaacttaaaatgcgaagcagaaaccattcatatatcatgattgcaaatgtttacggatgcatgaatccaggaaaagaaaacctaaacacacgtgggaaaagggtaatagagagattgtgcttaattttattccttttttaacgtaaaggaaaagtcatggtacacgtatcacttttaaaactagaaagcaaaatttatattaattccaatttatcaaagacagaaaatatcaacagagaagtccaaattggtactaagttcaagttatgttaatcattgagacaaaaatatttttaaaaatgcatttagtccacaaaatagaggatttcagtctcaaagccgaactcaaacatgctaggttataaactggtaagagatcaaggctgcatcttatcaccaggctgtggttttggtgcaggctggaagctgaagaggccacagctggaaaggggtgtgcagcaacatcaggtattacctgagggcccaggaagggaaccaagggctgcgcaaaggattggagtcaccagctgtcctcacgggcccctggagaaaccgcaggtacacagatgaaggcatggacaggagaagaggggacccggggttgagaataagatagaaggcaaagagaactggggagcagaggagagaggagaaaaatggcacctccggtattgactgctcagtggtacctactggtgctaagcacagtaaaaacacaaaggctactttccaaaaggaaaacaacatcatttaaaaagaaaaagaaaaaaaaaccaaaacagccctattcgcccatgagtgtgggaagtgaggaaattatataatacgcctcctccaaggaccccaaacaccctctctgctgtaattaagagaagtgcttactgccagcaccgtcctgccatacctgcttgtgtgactttgaacaagtgtcttatcctctgggtcgctgtttcctaatctacaaaatagggtggtaacagggcctacgtcatctggtacttttatttttatttttatttatttatttatttatttatttatttatttatttttgagacagagtctcactctgtcgcccaggctggagtgcagtgacagtgcaatcttggctcactgcagcctctgcctcccgggttcaagtgattctcctgcctcagcctcccaagtagattacagacatgcaccaccacgcccagctaatttttacatttttagtagagacggggtttcaccacgttggccaggctggtctcgaactcctgacctcaagtgatcctcctaccttagcctcccaaagtgctgggattacaggcatgagccagcacgcccggccgctactttgaagaatttattgagttaatgcttaaggatttctacaaactaccccagctatatactgtccctctttgaaaggaataagttttccatccctctttcatgccacctggacagaggtactacagtaagtggttaaaataacagactatggaaccagaacacctgagctccaatcccagctccgccactttccagcggtgcaacactggcaacttagttaagtacggtgggcttcactttataacatgggaagaaaatgtcgagatcacagcatccctggaaagcccacagaacaggcccagcacatagcaaaccctcatgagtgctatgacgtcgatacgtgagaactttaacccctggcaaggttctcacagtttacttatttcgactgattcaactgccagtacccatttcatgcatcatcacaaatttggcaactgctccagcttttagaagcccgggtcccaaaggcctgcaagctccccacagccacgaaaggcagtctggaatgtgaaaggcacagaggcagtgaggcggtcatccatgccttacactgcacacttccagaatgggtacatcttctaggccaaggacatagtcatgcattgcttgggcaaattcaaaagcacttttttttcatataaaagaaacatccatgattgagtactcaagaacagtatcaccaactactgtgccctgaaggaaggtctctggaagacagagatcaaaatccaagtattctggtcttttttgttattttaaacatcatccgagtaagtttggttgtctgactttatagactgcagaaattgacaactgcatattagaagacaggagggacaatatcgtgtggttgaaaaggatgctgaatttgaaaccagacagacagagctgggctgctcactaaccatgtgaatttaattacttggaaccttctttctttatctgtaaaatgggtgtaactgaactaactttatagggatgttttgaagattaaatgagattacgtatataaagcacccagatctatgccaaaagcataaagcacattctaaaaacagcaatgaaaattatgctcaaccatacgaaactgctgtttctctaagtcaaaaaccgttgaagagagtcaaactgacaaacaggctgggcaggcaggtgctcttgtggagtagtgaggatctgggagtgtggggtgcccagggcagggcctgagggcagaggagcaggtatttactgatgagtgtggtgtatttcaacctttagacaaatggctcagctctatcaggctgagctctatcagtccacgagcccatgctggctaaagcacagacaaagcccaggggaaacattttcttttaaattgtaatgagaattcacagtgtgagaatccacagctattgagtaagtgggcaaggaatcccacacacctcaaatatcactgagggcatggtgtgctatggagggaataaccagtgctcagaacaataaccgtaaagtttctttactcaagattaaattaatcttccatttaagatgataatttagaatacatttcagggtgaaaaaatactaaatttcataaaagttcaactttgtaaaagtgttaacactggagaaaggatgacatagagtagacaaacagaagcacagcagcagctgccagtggacgggggaggagggaatggggagtggctgcctaaagtgtccagagcttcagcttgggaagatgtaaagttctggaactagacagtggaaatgcatgtacaacactgtgaatgtgcttaatcccactgaagggtgcactttaaaatggtaacagtactaaattttatgtgtattttaccacaatttttttaagcgcatgaaaaaggaacagacaatatttgagtacttaccatactgagcactctatgtgtgctatgtcccaacaatgctgtgaagtaaatattattattattattgtttcttattatttctttttttgacagagtctcgctctgttacccatgctggagtgcagtggtgtgatcacagctcactgcagctttgaaatcctgagctcaagtgatcctcccacgtcagcctcccaagtagctgggaacataggaatgtgccaccatgcctggctatttactttttttgaagagatggggtctcactattttgcccaggctggtcttgaactcctggcctcaagtaatcctcccacctcagccttccaaagtgctgggattacagatgtgagccaccgtgccaggctgaggtaaatattattatcctcattttacaggaagaaactctacctcatgaaacaaggcaatatagtttccccaaattgcacacaaccagtaagcagtgaggccaggatttgaacaccagctgacagcgcctccagggctgggtctctgcaacgcttagaccgactcacgcttagaaaactcactcatgtgaaacttgcgtagctgaataatgctggaagctgaggtgttagaaagcttaggtgaagtcagtaagagagtctatataaatcttgactcttcgaagcaggtttttaataaaggataggaatactgaattgttttggaacactaaaatgttcacaccttcatttttcatgatgtagtggacgatttgcccaacagtgtcactgttttcattcacactgtcattcaattctgaaagagaaaagaggaggggagaacaggttacaattggtcaccagcatcaagtcaatcaatcttagaacccaagacctcactgaacagtttccagaagcctcaggagatcacccatggtgctacaattctaggctttctccctccagccccaaacttcctaatgcataacaagcataaagagaaagtatcaaagctgtccatctatctcttctgaagttcaaatactcactttccaagacaataatttgaaaatgcatttgtaccagtcttcattattatttctctctcatcattttcttaaagccttatgagaaatgggaagaaagctcattaaaaaagaaaaagattctccttggattttattttaattgcagacttactatatcaatttacaatattaatttcctttttaaattggatcataattcttccatgttcatcagactgctgtatcctctgaaatacactttcaaattacctacattcagggcttggttatgtgtccacaaactcagtttactttggggactctgtaccaggagcatacatgacggtctttgggaaaaaaagcaaaccactctgaaaccaatctgcaaaatttgtttcaataagaacgaggaagggttgaaacgctccatcctagttcacagagaatgcatcaaggtgtgcagtgtcctactcatttacctggacaatgccttctccatccaaaggtcagctttcctccacgtgaacatgcatgtttggttagacagctcagaagctggctgctaagccaacctacagagcatctgggaaggaggagagggggaggctccactttctgttgacaaacacttggctttggtttgctcacaggctcatacatgactcatcatgcaatcctgttccttctcagcctcaaaggtcagtgggggtgggaaaaaccaacagtccagcaagctggcaaggaacgaggaacctcccctcagccagccctgctttgcctgaagggcgacctactccaatgtcacctttctgcagaaactgcccttagcagggctgaaaggaatagggggagtcacctactacctctcaaggcccaagtcaggaaacatccctaaagatgatgggaaagaaacatcagtggcgaaaacaggatttcgtctccccggtttttctaaacactaccttatgactccacattaggagaaacagatgagacagcctgaagttagtactaaggcaccagctcttgtcatacttttttctgcactgtgcacacgatcgtttacttaataaacataaattccaatcacaaatatttaagatagaactcccccagcaaaagtaacaccacaaacatggggagacctattttaatttttccttcactcttattcgaatctgattccataataatagtaaggattaatatttaatgagtagtcatatattccaaataccaaatgcatctttcctctaaatttcacagaaaccccaaaaggtaaggattattttcctcattgaaattaaattaaaatgtcaaatgaataagattaaattaattaaaaatacatttaagtgaaattatacatggcagagattcagagcacacaataacttgtctaaggccacagggcaagaaagggtgccctatctggcaggtattcagtaatgaaagcaagttttcaaactaggtgtgattactgcacaatctgcacttacactacactgcaccacctgccactaaaatggatcattctgcctcagagagatggaaagcatatatcactggtttcatatttaaaaactgtctcctcacccccaataaaaagagccctggttatttacctatcttttcaaccttttcctcttcgatatcttgctctgcttctgttgtacaacgatagcctttcttcttaagcaggtggcaaatgaggacgccaaagagacccatgataaagaacacagggacaagcgcgtatgcaatatattctgggtgtccattcccagtatcgttgctgggcgacggggtcgtctctgttctggagtgcaatgtgcggctgctcccattgtctacagaaagaaacatgcatgctgcattagatatctgtccagggcaagaaaaacctaatgactctcaggtaatgttcacagtaagtcagggtctgctcccgaaaccacaggccatgcagactggtgggtccagctgcacaggcaaaagatagcccaggtttgagctcaaacagtctgagtttaactctgctactcatgaaccaggtcccatgctgggtcattttttaaaacatcctttgaagacagcttcttcttcattgtggaatgagtatacagggttgtcgtgaagtgtccagcacagagtaaacacataaacattacatgtaacattacaaacacagaatgaacacataaacactacatgtaacattacaaatattacataaacactacattacattatagcacagttcttagtgattaagagcatggcctcagaacactcaagttcaattcccagctccaccatttagcagctgtgtgacaatggacaagaacttaacatcttgatgccttggtttcttatgaaatgggcatacaaatactacctactcacccttctaggattgttataaagatgaaataaattattacgtgtaaactagcaagcaacatagcaaatattcacccacatgccaggcaccattctaggcacttgtgatgcaggttcatcacactgagcaaaacaggcggagatttgttgtcctcatgcagcttacattctaggaggatttagtaaactagcagatctagagtatgaagaagagggaaaagtcagggatagcatcaagatcttggcctggggtgcaaacataaaaatggaagtgagtgcacttgtttatttgttcactaatcccaataaacattgaatgcatgccagttatgtgacaagcaccacactgggtgggaactggatagagtgatgaacaacgtaacgtagcccctgccatcttgaggctcgtatatgatggcatcagaaacagccattaaacaagtatacacgggcagatcgtgacagattgtgagaaatgctgtggaaggaaaacacggggcactagaagagaaaagaacagtggggatctactttatgacttcaagaatagggaagctttgaagtgggcatcttttggagaaaagggaagtttttgcctttagacatgtcaaagtatcacatgaatatatatatgagagacagtttgatatcttagcctgcaggggtgccacagggactccagaaagcagtgagcctggagcacacaattatacaatgtggccaactgagatcgcaggaagaacatactttgggaggctgaagggggtggggggagggggcgaatcacttgaggtcaggagttcaagaccagcctgggcaacatggtgaaaccccgtctccactaaaaatacaaaaattagctgggcattgtggtacacaactgtggtgccagctactggagaggcagaggtgagaggattgcttgagcctgcgaggcagaggttgcagtgagccaagaagtgcaccactgcacttcagcctgggtgacagagcaagactgtctcaaaaaaaaaaaaaaaaaaattaaattaaattaaaaagtattaaaaagttagccttatatatgttcctgtcacacagtaagcactataaatgtgttagctaccactattaatatttaggctgggcacagtggcacatgcctataatcccaacactttgggaggccaaggcaggcggatcacttgaggccaggagttcaggaagaacataccgtgtagcaaaagaatcagcagagcaccatgccatggaaaaatgaggagagaaatacaaaatgaagaggggagtcaggtagatgaggaccaaagaaaactgtggggtttgactgaaacaaagcttcagtatttggaatatcctgactctgaaaggataaagtgaggttttctacatcaagggaggttcacacacactgctcaagaaacccagaaattggaaagctagagacatttaaatataagctttctcaagagaattttggtgagaaaagaatccgtattgtaattgagagtggcaggaggcagtcaaatgcccaggcagacagggttgggtccctggtgaaaccccacctccatgctgaagaattttaaagcttgaaagccaagctacaagttaaatcctcggaccagatggaggacttgtcttcctgtttggtgcgctttcctcacaaaccaatcagcactcactccccattctgagtccataaaaggccccagacccagccacacaggaggaacttcaagtagaaccattcccccgagccccacattgcctctctgctgaaagccattttcatagctcaataaaattcttctccgccctcctcacccttcagtgtgtcgtgtatcctcattcttcttgggtgcgctacaagagcttgggaactgctgaaagtgggtacaagctataccacaggggagctgaagcacgccagcgtggccaagcagggcgtcgaggctggggcagagcgtcgccagccaggaggtccccagtttacaaagtgaccgagaagaaaactcctgcatcataatgattataatggggacaatatgcctggtatgaaatgagcacggttcatcacagcagcaaacaaacaatatcaaacagaagctttatttgcaaaccagaggccatagaacaaagactacctctctttcgcatggaaatatccattgtctttgaacatgaaaggaaataattggtttcttaggtttgtaagaggttgcattcattactttatcagacaacctccagaatttgaaatagccagtgttttctgatttctccctgaagaatcaatataataaatacatccctaaatatatgcaatataccgtctaagttagggtttaacctcatgccttattttcaggaaaaaccagaaacatttatttaatcccttttatggtcctaaaacaatgttttctttattaattcctttatataacacatattccacgcaacaagaataggtgaagtaggcagcatgctgagatcaaggagctttactcagaatcactgtctgtttcaatctgggggtgaaaataaattcttttttagggggacaatgggaaagagggatgaaagaggggctcagaattggagtcaaacacctccctctgaatcaggtgattgagaaggtgtcttcatcgtgaatttgacatgtggcaacccctaacaaacactaaatatctacagagctctgtgacttacaaacatgtgtcattcacttaatttcataattatcgtgccatgaaaaaactgaagatattaatctacattagtgaagcatataaattacagggagaggcaatatagcactcagattaaaagctcagacctggcagaaataacagacatgttattggccacatactagacatgtcaccttaggcgagtaattttaactgttctgtactctgtttcctctctgttaaaaggatcaaaatgagtgtgactaatctgtgataattttacaagatggccctgggaaataaaaatctaatctcagaccccaatttactatgccaaaaggaaaaaattaaactgaaagctgagtcattcaagaaattgcgtttccttttgttcttaggcagatagctactgataaaaggtgaagtatctgcacaggtagctactccatgctcaccttatcttaggtaaagtgctgactgactgacataattgactattaccctgcccgctccttttcccttgcaacaggtagattcagtaatgtgaacatctgctccctctttccccttgtattgaaacctcaatacaagtattgaaacctcaatacaagtattgaaacctcaatattcaatacaagtattgaaacctcaatattcaatacaagtattgaaacctcaatattcaatacaagtattgaatactcaatacaagtattgagtattgaaaccctcaaaatcttcttaggaaaatggcatgaaccacagattgttcctgtggatttgagatccttttctctggacatgtccttaacctttgcaaaataaacttctaaattgactgagacccgtctcagatactttttggtttccagcttcaaaattatttgatactgcttctactgagaggtgaggtctgtatctcgtccccttacatttacactctactctccctgacccacagaatgtgttgggaatgatgcattatcactttccagcctcaggcaataagaaactgacaacttccacttcctgtttcttggggcacttgctcttggaacccagccaccatgctgtgaggaagcctaagcttccctgtggagagaaaatagcaggcatcaacttatcagccagtaatagccataataaaagtagatcctatagtcccaactgatgctccatggggcatcagagctgtctctgatgaaccctgcccaaattgtataacaaatccttaaacaaaagaaatgattgttgttttcacccactaagctttggggttatttgtcatacagcaatagtaactggaagcctgctgcatggtgtcactgtgaagattaaacaatattaatatgtaaagcattcagaagagtgtctacaaaaaggtgggcactgtattttagtcataatcataaaagacctgcattattcagtaagatagccactagccacatgtagctatttaaattcaaatttaagccaaatgaatttaaataaaattaaaaattcagttcctcagttgcattagccacatctcaagtgcccagtggccatgtgtggctaactgctaccatactggacggcccagataatgaacatttccaccatcccagaaagtttttttggacagccctgttgtgcattataaagaatagctaacaagaaagatgcagagtggagaatatattgtgatctaccttaacaattcaatgaaaaatagcttttaaataacaaagtaactgttcatacataatgtctaaaacatttataaacttcagtaggtttagctttccttcaatttacactaataatttgctgagaaacactgtatcccttcttctccttcacccctagctgaatcatgtctgaatcacgaacaagttacttagtccaaatagcaaaggttgttgcattatttataaaagtcaaaaaatagcaacacctgcatatttgcaatgagatagtaaaaacatatctaaatcatggtttcatttgatgaaataatatgcactatttaaagatctatgaaattttttgtgaagatacaggaaaacactatgatccaatattgaatttcaaaagctggattcaaaaccttacatgcaatatgatccaactagtttttttaaaaaataaaaacgcatgaaggtataaagccaaaaccaaaatgctaagtgattctcggtactaaaataatgaaataaatttaattttatctttatacttttctataactttctaaaattagtatgtggtacttttgtaccaagatggtagacactttaaaaagtatgtagagcagaggctgttagtcatttgagagtcacaaacccctttgtgaggtctgatggatgctaggattcctatttcaaaattttgcctcccggttctgtgacttcttgaacccaaattaatgtaagggcaagtgatgtaataaaaatgacgtccaagtttctgcttgagcaacatagtggacattggacccattcattgtgatgggaaatatatatatatatatataaaaagcaagtttgcttggtgttatggtttgaattttgtcaccccctcctaaatttatatgttgagctcctaacccccaatacctcagaatgtatttggagataggatctttacataggtcatctagttaaaatgaagtcatcagggtggaccccagtcccatatgattggtgtccttctgaaaaggggaaatgtgaagaaaaaggcagagatctggatgatgcttcttctacaagctaagggacaccaaagattgccagcaaatcaccagaacccaggagagaggcatgaaacagattctctcatagccctcagaaggaggaaactttgctgacacattcctcttggacttctctgttgctgaaaccaccctgtctgtggtactttgtgaggcagctctagcaaacgaattcacttggcatcttgaggacaatgtcacagttcagttttgaacacgcagaaatagaggtaagcaggtgacatccagatggaaataggcattgagcaactggatctgctccactcagaagctgaggaagaacagccagagctccagtctaggacagaaaggaatgagtttccagaagaggtaagtggtcagctgggtcagatgctgtaagagagcacaactaaaatacgaaggaactgcaaaatggtgccgctgctatgctggatagtattaagccttctcgaaaggttaaaaatagaactaccatgtgatctagaaatcccacttctgggtacatatccaaaaaaagaattgaaatcaggatcttgaggagatacctgcactcccatgttgtctgcagcattagttacaacagccaagatgtggaagccaccaaaattcccatcgatagacaaagggataaagaaatcgtggcatatgaaaatggaatattattcagctttataaagaagaaaatcctgccaaatgtgacaacatgggtaaaccctgaggacattaggctaaatgaaataagccagacaccaaaggacaaatactatacaattctgtttatatatggtatctaaaatagtcaaactcatagaaaccagagagtagaatggtgtttgccaggggctgggagggcaggggaatagggatagttgatgatcaacaggcacaaaatataaattttcagttacacgagattaataagttctagagatctcacaatactgtattgtgcacttaaaaatttgttcagagagtagacctcatgttaagtgtttttaccataatttttaaaaacagagagaaggaaagaaacaaacaacctgctatagtttgaatatgatctgtcccctccaaaacacacgttgaaatttggtccccaatgtaacagtgttgagctgtagtgggacctttaagaagtgcttgggtcttggggactccacgctcataaaggagttaacgttgttctcacagaagtgagttagttctcatgggagggggttagttattgggagtttggattgttataaaagcgagttcagcttcctcggcactttcttgcttcctctctcaccatgtgatttcttccattttgtcactgatgtcatgaagcagcaagaggcccttaccagatatggctatccaatcttggacttcccatcctccagaactgtgagcaaaataaacctctattctttataaattacccagtcttaggtattctgttatagcaacagaaaacaaatgaagacacaacccaagagaaatctttagaaagaggcttgagaagaactcagataaatcaggccacacagaaattcctaagaacacatgggaaaccttcagtttctaatttaggagcagcttgggattttttaacctttcccttcttggattttgctccctgtttctctgtagtttcctgaagtaaacattctttaaaaattctaaagataaagtaaaataaaaaaggaaataaacaggcaaaaataaaatagaaagaaaaacaatccacagaagctctttggtggccttgctggagcagttttccaatgaaatggacggcaagatgcaagctggattccctgggttcaggaacagagacactgagctcattgtgctccttccagaagctccttctgagcaagcaaggagggtagggtagttcaccctcagggtgaagggaagaaatttttgtttggggtttattttttaagtggatgaaaccaaagtatttatatgtagaagggaaggagcaaaagggagagacagagcgggagtatgaagcaatggccttgagatgacttccatatgaaggaggggagttaaatatctgaatagaaaaggatacagtttttcctgaggccttcctttatagtgggtggaagaaagttgcgggaacaggtgcttctgttgccttttaacataaaaagcaaggcctggtgtggtggcttacacctgaaatcccaagattttgggagggcaaggtgagattacacattttgtgaaacctcatctctacaaaaaaatccccaaaaaataagatagctaggagtgcttgtgcacacctgtagtcccagctacttgggtggctgagatgggaggatcaaatgaggccaggaggtggaggctgcagtgggccatgattgtgccactctactgggagggtgggtcagcctgggggacacagcgagaccctgtcacacacacacatatacacacacactaaacataaaaagcaatggcaaaccagtgtaaaatgtacctgcagtcccaactactggggaagcttgggtaggaggattacttgagcccaggagttcaaagccagcctaaggaacagccagggaggaagcaatgacatctgttggtaactaggagggtgaggacagaagaggggacttcagcagacaggaggcttagcagagagactgaaggcaggtgtcagtgaaaataatgcacaatggcattcaggacacagctgagatgtgcaccccaaatctctaactgtatgagaccactcagggcatgccatgcaggctggaaaccaagcagaataacaaatcaggatcagaatggaaagcagacagagctagagtacgaaagagaacagtttagggtgagatggctccagaatcgatgatatctgattcacactagtttattacagcactatcaatactaacaacagccaccaccacaactatggagcatgtatgagccaacactaagctaagcattgaatcttcacagtaaacctataaaatggttaccagtgttatcctcacattacagatggggaaacagaagcatagaaaggtcaggcaatattcccaacatcaaggtcacgtggctaccaagtggcagtgcctggattcaaaccaggcagtgtggatcctgcatgctcaaacacactttatgttactctcagtgtctgcatacgtaaaacacgacttgtaagagagtgctgttcatctaccaatgcctaaagtacattttcattatttttctttcaacaatatttcatcatttagccacttttctgttaaaatgctaaatgatggcctattctttcctatttcacaacttggtttagaataaagcctccacagacttcaaaaccatggattccaattagcacagcaagaagtaggataagttttgaaaatgttcccaccagactccaaagcagttttaccagataaacaacaaaaaactctactatttgcccttatcaccaatcaatctccctcccaactcccaaatcacagctcgccttatgcaggtcataacctgggatccctacagccttgctggctcttcaaaaacaagcccatcacttcattttgagagtcttttgcacacagcaagagccactgaaataggcagagcttggctctagctggtaagtgtgattctcttccacagcaccacaaataaaaaatgtccaacacaaaggccagtgtttgtcaaaattctttgggtttttcctgggcccagtaagctttggtaaatttgctgtattctgaggacccactaggtatgtgtgttttgccaagatcctgctgagattacaaaagaaaacgtgagatgaaaaagatcaaagacagcagggaactgaggaggaggcatgaagcatggctggaagtcaacctaaaaagtcaaaagcaattttctagcttgtttccaagtaatacttgtatttccaactgaccccaatggtcagaggagccgagacagaatggcggggaaatggcatttctcacacccagtgggcatggcttgagggttgctaacattttttggtctagattaccaagatggctaaatgtctaaatgttcatttctcaaaaggggtttttcttcatccacctttgccaccagctacctctgtgatactgaacaagtcacttcacctccctgggcctcagtttcctcatctgaaaaattagaagcaggagctgatgtccttcatggttctcagaattccactattccccaaccttctgcagcctcattcactctgggctgacactgctggagatgaagacacgagcccatcctccatgtccacaaggccaaatccaaacagctctcaaatccaaccacagactacagacaaggcagccgtcctaatctctcccaagcactttgtgctgaccaagatcaagatcaagaatggctctgatagcaattcttcctctccttaccaggaaagggtgcgcattctcagaagctagggtttcctggcaaactgaaccaacaaactcttgatgggaaaggaacttggctgataagtggataacccacatcaaggttagctggaaaatagtttttaagcacacacacacacccatttttatttatttatttatttatttttaagctaacattcaaatcacagtatctgagaagggtctattttttggtctagattaccaagatggctaaatgtctaaatgttcatttctctaaaggggtttttcttcatccaccatttccaccagctacctgtgtgatactgaacaaatcacttcacctccctgggcctcagtttcctcatctaaaaaattacaagcaggagctgatgttcttcatgattctcaaaattccactattccccaaccttctgcagcctcatccacaattcactctgggctgacactgctggagatgaagacacaagcccatcttccatgtccacaaggccaaatcccaacagctctcaaatccaattttttcataactcctttgacagcaacatcaaatctgacaaattcatctggtagcaaaccctgcactgacctgatgtgtggctatttacacacactctcctagtaaggagaggaagaattgctatcagagccattcttaatcttgattttggtcagcacaaagctcgggggaagtcacatcatttagagtttagactaccagtcccaagggtttccgactgtcacaactctaagagtaaggagattggtcagggtactgcacttgctcaaggtcacatggttaaaaactgttaagaggccgggcgcggtggctcacgcctgtaatcccagcactttgggaggccaaggcgggcagatcacaaggtcaggagatcaagaccatcctggctaacacggtgaaaccccgtctctactaaaaatataacagattagccaggcatggtggcgggcgcctgttgtcccagctactcgggaggctgaggcaggagaacagcgtgaacccgggaggcggagcttgcagtgagccgagactgtgccactgcactccagcctgggtgacagagtgagactctgtctcaaaaaaaaaaaacaaaaaacaaaaaaccacaaacaaacaaacaaaaactggtaagaacctgggacaaaaatcttgtttcaggacagaatctgtaactagtccacctagttatacctactaggtgtactagtccacctagtagcctctcagtcctactttggtagagctaggacctattatctagtcagtagctaacagcttactactagtgcaaaacaacctgttttaagttaattctgtttgtttgtttgtttgtttgtttgttttttgagacagagtcactctgtcacctacgccagagtgcagtagcacaatctcagctcactgcaacctctgcctcccaggttgaagcaattctcctgcctcagcctccagagtatctgggattacaggcgcacgctgccacacctggctaattttttgtattttagtagagacggagtttcaccatgttgcccaggctggtctcaaattcctgagctcaggcaatccacccaccttggcctttcaaagtgctaggattacaggcgtgagccaccgcacctagccaagttaattctttaaatacagtttaaatcaattgcccacaataataaaagaagagaaaccaaagcaaattctacaaaataaaatcatccccaaattattcctatttggttacagagataactaaagtcacagtctctaagaccatctacccacagtggcaatcataaagacacagcatttgcccaagctcaagaatatgttgtagagagaacaaatgggcttaaacagaattggagaacactgtaagtcagtatataaataagtgctgaactctgtagtgaaacttgaggcagctaccagcttccagacaattcctagacaaacagctgctacaaccccacctttccccgaaaaggcagctatgactgggcagggaggggacacccagatggcacccacctgccaaagtccacccacccatgaaacaaaaccccacccaacgccagctgcatacagtccctcaattacttttattttgttaaaattcctgaaatgctaccatgagtcatgagccctggagtctgattctgggttgcaaagaccactctgggaacagatggaagctcagacaacttccccaataaaacgtgcagaagtcagcaaagcctagctataaatccttattttcagatgcatttggctaatggatgccttgaaaaattatcattactaatgataattatcatttttaatgggaaaatgcatttcaacttacaatctacttactcaaaagtagtatttggggcataacctatccttaagctggggctttcttcttaaataccacatagattgagaagggaagtaacaaagatgatccagaaagaaaaaggactttatgctgagcctcaacagaataactgaatttggctggacaaaaagggaacaggacactcttgacaggcaggaggctggggcactcagagcattcctgaaccccgggttgctaccagaacaaaggactgaaacttgagtgatgtcaatataaagaaacatcttaaaaaaaaaaaaaaagatgaaatctaaatattaccatccctggcttcaatttgaactgaagagagaaaaataactttgcagagtcagataaagtccctagcctactccacactgtctcgggtttaccatttgaagttatttcttaaagccacagaactccaacacagatgacagctacagccacccccatccccccatcttcccccacctcccacctcgcccaaagctccgtcttgggaggaaattaactctaggatcccggtgtcttgagaggccaaggacctcaacttctggactcttccagagtatctcaaacaatggtttgcattcaggatacaacagaaggctcatctgacctggcctcaccccagactggagcaaggtcagcttgccagttatttgctttgggatacaggccaggaagccaccaactgtgcctctaagacagaagactgaggagattcccacagaccctcactgatggctgcacacatcagtggggtcctcagagaggggcgtgaggaaaagcaatacccgtggggctcaaggactgggagggctccctgctgactctctccccatcttcttttcctgttctccagcccctccctccctctttcgctgcccctcctccttttgctatttttggtgctgtccatttggggacttttccaaagtctttatttactgatagcaccgtctgtctcctgggaaggggctgggtggctgcacaacaggaatggagagagcctctgactaatggctcttgcgaacctttaaaattacacattatgtccactcaagaaagaaatggaattctgaagaagtcatttgtttgaagtgaccttaaagcaacagggcttcagaaatctaatatttgcttcagattatttctgaaaggtggtacgtcataaagaatgagttgctactttaattgtcaatcgcagcattcacacggggtgttagtggtgtcaggcagtgttctggatgcttcctgggcaatctcattcttccctcgcagcatctgtaaggaagcatctctcattacccccattcgcagatgaggaaaatgaggcacacgggttcaataacaagcctcggtgtgtaggaggacaggatccaacccagacaatggaatcccggggcccacactcttagccatgttgcttaacagtgtctgtaagtggcggtggccttgggttttatctagtgacacatgcatttaggtggctttgttaaactgtcaccaatgaaccacacagctgggctgcatacaggtcaacattcacccacccaaggcccttaaacactaagaagctgcctctctccaatgaccctatgatatacgattaacactggaacttgcacatatcttcttctggtgtaaaaatcatcttcataaaaaaaagactgaagtcagctgtaggtgaatgaaatttgtagtggcttcattttttaaaaaccttcatagcacaaaatttcccaatattaattttaactgcaaaaaacaaaagatcgaccgggcgcagtggctcatgcctgtaatcccagcactttgggaggccgaggcaggtggatcacaaggtcaagagatcaagaccatcctggccaacatggtgaaaccccgtctctactaaaaatacaaaaattagctgggcatggtggcacgtgcctgtagtcccagctgcttgggaggctggggcaggagaattgcttgaacccgggttgaacctgggaggcagggcttgcagtgagctgagatcccatcactgtgacagagtgagactccatctcaaaaaaaaaaaaaaatcactcatgtataactacttcatctccctctataactatcataaaggtaaaagtaaaagacctttctctagctattgaaaagcaccttattcacagatgcatgtgttcacattattgctcaaaaactgttattcagtggttgccacaaacataatttgtactagcaatgttaattacatggcatctaaaaatctttcagaaaaaatatttaaaaagaaaggagaggaataaagaaaattttcaatcatacacatgagatagggacacacagtacaagatataaaagttcccacccaaataacacacttttcaatgcactttcacattcattcttttatttgaaatccctaatcccaagaagttaggtaatatcatcattctgtaaataaatcagtggcctacatgatatcactgggtcgaggcagagaaatgagccaagcagaagaaccaaagcttaggaggacattttccccacccacctcactacaacagcgcaccactcagacataccacggtcaaaggcaggaatcccagcaggacacagaactcgccggaaaaccctgactgaagtcaaacacctctttccctaagtggaggtggggaagtgaaggtttgtacctctaatccctaacacagttcctgcaacacagtaggagtgcctgaaacatctgctgcagcaatgttatatgtgaaagcaaattctctcattgcagaagggctcctgggtaatcaatcaagtccccaagttcacagtaactttataagcagttttgttaagatcctatttggtagaacagaatatccagtgtacttacaccccatttgccaaatgccaacagtttttacaaacataaataagtagattcttttcagagctggacaactgatacaccccactgcttcacccccttgttgggtaagtcctttctgaaggatgtaaatataccagcatgctcctgggttcatcgaaatcaacagaagtttctagtttgcaaagatccaaaagaaaggctataaatagcagcacattcctaaacccagcttggggaactagctctcaactggattttcacaggactccaattcatccccaactgccagatccataaggggacgctaaatccgagcttacacaacctcaccaaaggctactgcccaatttccacgtggctgcgagtcctaacagaactgttcatgtatattccttgcaagaggccaaccaagaactaggttagaaattatttaaactatgggaggaagtctaagtagcaagggccagaaaaaaaccatcaaataggaggaaacacgccatctcagcctgtctccagtagcaacgggaagaaatggggtcaaaggggtgctcctttaggaaatcagtgaattccctgaagcttacagagagctggtgcaggaaaccagtccttggggagctagatccctggtttctgggcacaactggcacctgtcagggttagaagtccagccaagtcatttctaccctgcagaataggacataaactaatcacatggggaaaaaatgggtggtgctgagctggctggagggaagcaagggcgtcagaaaggaagactggcccagcacccgaccaggcagagggagaaagagagatggtgactgatgcccctgtggagtgttgggggtttatgatttccagatccagggcctctaggatgctcaactactttaccaccaactgctaacagccactaacctttactggaatttttacttacattatcatttcttatctctacaactctgagataggtgttaatattaaacccatcttagaaatggagatgatcaagaacaaagtattgaagctgaagtcactcatctgggaaatggctgggccaacatttgaaccaaggtctgttgcacgcagggccaactctgaagcaagactactccctatgaagcatggaagcaaaagcagaaactggcttttttcttggctgcactgtgttcaatttgtttcctagctgtgaagccccaggcaaggtcaattagcatctctgtgcctcagtttcctcatccataaaataataatagtttctaagccttatatgagattactagggtttatccaagttaagacttgataaatgctagccattattgctgtgattattattatctgtggtaataagagcaaagcagttgctatcctcaccaagctcacagctcagctggggatataaaatcaaacatccagaaaaggacaaggaatcacatgagctgggctggaaggggcagtgttaaatgtggggtgcagaaaagataagccctgggggtgagtgagcagcgaccacacagcactgctcaggtggtaccacaaggccaggcaggcacccacatccccacatgcaagccagtgtttctcttccttccaggaacaggaagcagataatgactaaacagagaactacaaaagtcctaaacgaagggttttccaattagtcacaggttaggtcgggcaatgttcctgcaagacaggcacgtgggctggcttctgagaacataggaactggaaaaggaaggtgagtaaatgttgagctccaaggatctgtcccggctgaagtcccctggtgtgaagtccccgctactgctgttagagaaagggcaaagtaaaggagggagtaggaaagaaaataaaggtcacttcagaaaaggcaaacgaaggaaagattgaacagaagtaaccaggaaaaccctagacgtagggaagtcaatgttaaagaagagaaatgaatgtcactagcatgaaacccaaacaagaactctgaaaaccagtagcaaccagtgagacacacagaaaaaaatactattaataatagtcacatattgatgtataatgtgtacagttactatttcaagcatttttcagatattaactcatttcatccttacaataactctatggggtagcttctattatttccagccccatttaaagatgtaaaactacagaacagagaggttaagtaacctatgccaggtcacacaggtagcaagtatcaaaggtgactttaatccaggcagcctggctccagaactccacactctgctccattactgctgaaatgtgagggctcacagtttcaacattcagtaaaagtccatggaatgggattctccatagctcatctctattatagatactacagggttcacgtagtagagttagagaaggtagaaaacctacagataatcattatccctgtaacacagcaataaatctacaatgacagaatggcatttcctagtgagtcagttattaggaagagaaggtacatttaaaagttacgttctttccaagtcaatttatctttttttttaaccaagtgctaattgttaaaaagtaattctgctgccatttgtaagatacaaaattaaaatgctaccctgatctacatataacactgatgaaacagttggttacttctcagaaatcctaaacttcctttgcactcttaaaacaatagaaacactttgtatgaagggatcagatttgtcatcacccactttgtccaaaatgatctcaattgtgaatgaaaaatgttaagtgaaaaaaaaacacatacaaagcagtatttagagcttaaatggtcccagtttttataagaaaaaaaaagacatcaaaatgttatcaaagtggtaagattataagtcattttttttctttagtgttttgtgtcttagcattccccacatttccttttattttaattattcacagtaaaatcacaaaatgtttttcaaaaaagggaggaggtatgcacagaaaaaaaggaaccccctccccctccccctccccctctccctctcccctctttccacggtctccctctgataccgagccgaagctggactgtactgctgccatgtcggctcactgcaacctccctgcctgattctcctgcctcagcctgccgagtgcctgcgattgtaggcccgcgccgccacgcctgactggttttcgtattttttgggtggagacggggtttcgctgtgttggccaggctggtctccagctcctaaccgcgagtgatccgccagcctcggcctcccgaggtgccgggattgcagacggagtctccttcactcagtgctcaatggtgcccaggctggagtgcagtggcgtgatctcggctcgctacaacatccacctcccagcagcctgccttggcctcccaaagtggcgagattgcagcctctgcccggccgccaccccgtctgggaagtgaggagcgtctctgcctggccgcccatcgtctgggatgtgaggagcccctctgcctggctgcccagtctggaaagtgaggagcatctctgcccggccgccatcccatctaggaagtgaggagcgcctcttcccggccgccaccccatctaggaagtgaggagcgtctctccccggccgcccatcgtctgagatgtggggagcgcctctgccctgtcgcctcgtccgggatgtgaggagcgtctctgcccggccgccccgtctgagaagtgaggagaccctctgcctggcaaccgccctgtctgagaggtgaggagcccctctgcccggccagccgccccatccaggagagaggtgggggggtcagccccccgcctggccagccgccccgtccgggagggaggtgggggggtcagccccccgcctggccagccgccccgtctgggaggtgaggggcgcctctgcccggccgcccctactgggaagtgaggagcccctctgcccggccagccgccccgtccgggagggaggtgggggggggggtcagccccctgcctggccagccgccccgtccgggagggaggtgggggtcagccccccgcccggccagccgccccatccgggaggtgaggggagcctctgcccggccgcctctactgggaagtgaggagcccctctgcctggccagccgctccctccgggagggaggtgggggggtcagtccccggcccggccagccgccccgtccgggagggaggtgggggggtcagccccccacccggccagccaccccgtccgggaggtgaggggcgcctctgcccggccacccctactgggaagtgaggagcccctctgcccggccaccaccctgtctgggaggtgtacccaacagctcattgagaacgggccatgatgacaatggcagttttgtggaatagaaaggggggaaaggtggggaaaagatggagaaatcggatggttgccgtgtctgtgtagaaagaggtagacatgggagacttttcattttgttctgtacgaagaaaaattcttctaccttgggatcctgttgatctgtgaccttacccccaacccaaccctgtgctctctgcaacatgtgctgtgtccactcagggttaaatggattaagggcggtgcaagatgtgctttgttaaacagacgcttgaaggcagcatgctcgttaagagtcatcaccactccctaatctcaagtacccagggacacaaacaatgcggaaggccgcagggtcctctgcctaggaaaaccagagacctttgttcacttgtttatctgctgaccttccctccactattgtcctgtgaccctgccaaatccccctctgcgagaaacacccaagaatgatcaataaaaaaataaataaataaatataaaaaaaaaaaaaagaaagaaaaaaaggaacctgttaaaaaaaatacctcccaagtataattaacatttatgttttcttgctggaactctggggcatttttttctctttttctactttttgcagtttctaaaatgtcctgatcataatcgatagtttttttttttaactgtaagtaacagtcaatgaggagccatcattactataaggttgaaccatatgaaattgtcactgtagtgtcagagtaatattaatagtgtagacagcggtaaaccaggatactggaaatcccttagtaaagagactactaaacctacaatccatcatattgacattttagatgtttccattggttggaggcagagacagtgctatgaaatctttggtgaaaaccacaggaaacaagagtcaaagaaaaccatatagtagtataacttctactttattacactataaaacacaatgtaaacacataaatagtaaagaacagcctgataattttttttctttcccactaaatctttttttttttttgagatggagtctcactctgtggcccaggctggagtgcagtggtgtgatctctgctcactgcaacctctgccttccaggttcaagtgattctcctgtctcagcctcccaagtagctgggactacaggcacgtgccaccatgcccagctgattttttgtatttttttagtagagacagggtttcaccatgttggccaagatgatctctatctcctgacctcgtgatctgcccgccttgacctcccaaagtgctgggataataggcatgagccaccgcacccggccgccccactaaatcttttaaaaacacttttgagcctttatcttctaaatagtaaactatgcaatttcagagagattattccagccccaacgttttcatattatgagttggtttttcccaataggaaagacttgtctgttccatttttcctaaacccagttctccaacaccaaccgggtgtcccacaattcaattaaattctgataccacctagcatttagtgcagactccacaggttaaatactcaatcccacaagactgaccccacttcagatgccagccgcaaatggggtccccaggctaactgcacttctgcctagggactacaaattgggggctttccatgacccccctcaataagtttggcattttgctagaattatcagaggcgtttgaaccagaataactccatcttgaataatggctgggtaaaatgaggctgagacctactgagttgcattccaggaggttaggcattctaagtcacaggatgagataggagatcagcataagatacaagtcacaaagaccttgctgataaaagggtgtggtaaagaagccagtgaaagtccaccaaaatcaagactcaatgaaagtgacctctggttatccttactgctcattatatgctaactataatacattggcatgctaagaaacactcccaccagcaccatgacagtttacagatgccatggcaatgttgggaagttacctatatggtctaaaaaaagtaggaagcctcagttctgagaattgctcaccctcttcctggaaaactcacgaataatccaccccttgttcggcgtataatcaagaagtaaccataaaaatagccaaccagcagccccgagggctgctgtggaatagcctgtggaatagccattctttattcctttactttccaataaccttgatttcactttactctacggatttgcccggaagtcttccttgcacgaggtccaagaaccctcttctggggtcaagatcgggactcttttgggcaacaatgactcacagaattcagaaaatccctacacttatgattacagttttattatgaagcatacaactcagatacagccaaatggtagagattcatagggcaaggtatggttggggagcaggcacgaaaacagaacttccaagccccctccaggcacaccatcctcccaacacatccatatgtcaccaacccagaagctcctagcctccttgctgcagttttaaccaagtttttatcacacaggtttgactgataaaatcactggctgttgttgagtgaacccaatctccagcccctttcccttcccagagatcagggattgcagctaaaagttctaaccctgtaatcacatggttggttcctccggcaactagtccccatcccgtagctacctgggggcccaccaagagtccaaggatcacattagcacaaactcaggtatggtctaaaggagctcattatgagtaacaaaaaatgttcctatcactcaagaaatcccaagggttatttttaggagtcccaggaatcagggacaagatcaaatatatcatttgtattacaccacattgactcaaagtcaagagtctttactcactaatatatcaagatgcagcactgaaccagtgtagaaaagatcaaccttctcaatcacaggtttgtggcggcaacagatcaactaccatatggttcatgcaaaagaattctctttccctccttcaagtcttctccatccctatccctcccacccacccaggaactaagatccaccagatctacttagtttgtgtaactactgtttccataatatgtaggcattggatgtatactgaattactttgaagctggttagttttccttcccccaaatctatttcatcacatcataagaaattaagggactgagaaaactcaccagaagtgacagagatggagcccttagccaagcaggatttacaaatcatcccaatgctgatatgcatggtttatttagagattgccttaacactgacagtcctccagactgggaaggagaagtaaacaaggacaagacccacagtagggccaaaaaatgaaaatataccaacatacttccaaaatataaatgtttaatggttgagaattcaatagtctggaccatgtgtggtggctcatgcctgtaatcaagaattcaatagacaagctgatttgtataatttgaaggtatttactctaacttaagaaaaatacataattagcgagctttaaccattaatgaacactccttggctttcacaccaccaagccatcaagactatatactttttttttctttttttttttttttttttttgagacagggtttcactctgtagcccaggctggagtgcagtggcactatcacagctcactgcagccttgcacctctgggcttaagtgatcctcctgcctcaacctcctgagtagctgggatgaaaggcacatgccaccatgcccagctaatttttgtcctatttttgtagagacggggtcttgctatggttttcgggctggtcctgaactcctggcctcaagcgatcctcctgcctcagcatcccaaagtgctgagattacaggcgtgagccaccacactaggccaaaactatatacttagcacttacttcatgattctcatttctcagcactccttaaactttgaaaaattgtttctatctgcatatcatatggattgcattaaatctattctgctgcatagatcctatttgtgttacttacaaaggactgtattatgtttgatggctcaccctctgcctccctaccacctacacttctgcagataaggaaatgggaatggcaatctgaactgccctgctgacagcacagggccctgtctcctttcggctcagcctctggggctcttctatcacatggaaatgcatgggggcctcttgttgtcccctatcctccgcaactacacagtaaagtgcagtttcaggggctctgtcgcctaacctcagtctcccctctgcagcctcatctcacatgacttccactgaggagtctctgccacacccagtctgcattaacttctctattcccacctccatgcctttgcacacaggctgtttcctttgctcagcacaccattccatacactcccttttaaggtccactgaaaatgccaagtttcaggctatgaatgaagtcttttccatcgcccttatcagaaggaaagtctccctccctttgatcccacacagcactttgtctgtagttctctgattacaccaaacacattctctactatactatagtgatttgtattcatagcttatctcccccttctcaatcacaagtttgtggagaacaaaaaagaagtttgttattcattttacatacctacatagcacctgacgatatctcaaataagagaaacctcatttttaaattaactgcacactgtaaagaatgatctacaagttttacctgcaatgactattaaaaagggctgagttgacaatcacgactgtgaaatgagtttcaccttcaaaacccagcttcttggctctatcacatagctttaaacaatatccaatgcttccctttttcttttggtggttgttctgtgttttgcctttagaaggaggatggaaagaactgaggaagcagtaaaagcattcaggccgtacgagcatatagaaaaaacttgcaaagaaaaatgaagaaacgcctgctcattagccatctgccacttcaccaatgccaggaaattccgggcagctgttttttataaagtggataattcacataattgtgttggggacttccagctatgaagaactgttagaacatttgaaaattagtgttcccaagttgtactgtgatacaaaagcccagtgaattcttcaaacttccacctcttacaggaatctgagaaaaccagataatgtttacatctacgcatggggaaggaaggcttggcagattattggtatcgaaaggaattctttttagttagtttttaaccctacctgtcttgtgaatgtgctatgtacaggctctttgtaagtcttcaaccatgcagcaaaatccatctagccactcaaagattggtaatagcataattgtctaatgtgtgtcttttcaggaaattgaaattgatatgttgtatctccctcatgccaaaattttataaaaatcatttctaagcctaatgacatgtaaactgaattaccccctccaaatatttactctaaaagcaagtggacaatttctgtagaattcctaagataatcatctcctgctaaaaacaaaatctacattcaatttataagatgcctttgtattctctttaagaagatgaacctatagtgaaaaagctcaaaaacaaattaaatataaaactttccttctactagtggtgctgggcaccgaatacctgcaatttcacataatgcaaagcacatttgagaacaatgaacacacacctcacgttgacttcccctcctctgacttgagcaagaaattccccttctcttcatcttggttattccctgtaagtctcagtttccacatctccacagaacagagaataacatgcaacctgctccacacagtggttgcaagaattaaatttgatcaggcaatcaaatattttgtacacatttcatatgctcagctgcctcaagaagctctagttagacaaaacaaacatggtggaaacaattgcatgtaactgagggctaaataacatggaaaagatgcaacatgtatccatagacttgtggacagtgtattcacaggaggcaataaaggcagtgagaatacctaggaaatgtttcctggaaatgctatccttgatctcagcttgaaggatggtcagaggacaggatacatacagccccaagaagaggagaggggattccatctactcttatctctttcactcccctgctcacagttgatacttagccagcatcacctggaaacatgagagttgaaaagcaaatctccagacccatcccagtcctatggactcagcactctcaggtggggctcagagatctgttttaaccagccttccagctggacttctgaacactcaagtttgggaaccactgctgttgctttgcttgatcttacctcctctcttcggtgaccacaagttctttccacctgaccaactcctgcagtttttgcagctgtaaatttcactttcatttcctccagagagcatgcccaacctgcactggagtctagtttgtccatgcatgtcccaaccccagccctaggttaggtattttggccctgtgtcatactttccttgacaaggtactcagggcatgtcattttgcttgtttaattgccttcctgataacctactagctccataaaggcaggtactgagtctattttgttcacatcacttcattctcagagccttgcacactgtaaggtactttgttaatacctgttggataaataagtaaatcaaagaagccacgaaacaattggttttgaatagtataaagtactataaaatcaggaatatgatacatatacaattaacagatgcatttgaagtaccggttgtagaaacacagctgagtttagtttgtctttgagaagagtttcatgaagagatttgggtttcgaaaatctctgcactgaaaatgctaccaatgtcacaccatatcacctgataaggtagtattgattgtttgttattatcattcttggcagtattgcttgtttgtcattatcattcatttttcctccatgaccagatttttctgcctttggagcaatttggcccacagaggctggcagacaaaacagcctctcaccagtgcaagagaagggctgtggggaggcttacatctaagatttgtgggtgaatattggaaacagtaactcttcactttattataaagaaaaagctttggaccaagagtcctaacacctgaattctaactctggcttccttccttccctcatttaaatatttaaatatttactctattccgggccctgtgcttggatctgagcctacaatggcgaacaagacatacacgtagtccctccctcaccaaacctaaaggtctgctcatctgctatgggctacagccactcctgactcctacaggacaccgaacctttctgggctagtttccccatctgcaaagagagggtgttaattacaagatgaccatcaaagtcccttctgaatctaaaatatgactaagaataacacaattactcccatgagtcagttagccaaagttcttcctagtcctcctcatcctacatccaaggagctgagaaaccaggcccttgagcatgaggatcaagggcatatgtagatcaaggaaacctgccataggcagcaaggctggatccacttccatagacagtctaacagaatgggaagagtcccagaatgaggaaagacactcacttaagtcctggctgtgccagctcagtttctgcatctgctaaataaaagcttggaggacacagtcaaggtctcttccagccctaatactacaggactctgcttcctcctcctaagagtctcattcattgaaacactcatcaaagagccacgagaagatgaacaataagcactcagaccctggataatcacaaagcatgtcatcatcaaatctacatcaaatactaaagaaaaactgtcacaattttgtgactacacctatagatcagctatctaagaataaaccaattggtgaatcttccaaagttcttccagaagaaaatgtcatgctctaccctacacattaggccattcttgcactgctataaagaaatacctgaggctgggcacggtggctcacgcctgtaatcccaacactatgagagcccaaggcaggtggatcacctgaggtcaggagttccagaccagcctagccaacatggtgaaacccagtctctacttaaaaatacaaaaattagccgggcatggtggcaggtgcctgtaatcccagctactcaggaggctgaggcagaagaatcacttgaacccaggaggcagaggttgcagtgagccgagatcacaccattgcactccagcagcctgagcaacagaacaagaccttgtccccccaaaaaagaaatacctgagactgagtaatttattttttaaaaaaagaggtttaattggctcacagttctgcaggctgtataggaagcatagtggcatctgcttctggggaggcctcagaagcttccagtcatggcagaaggcaacagaggagcaggcacatcacatggcggaagcaggagcaagagagagttgggggggaggtaccacacacttttaaacaaacagatctcttgtgaactcactcactatcgtgagggcagcacttctcatgatgatgctaaatcattcatgagaaatctacccccatgatccaatcaccttccaccaggccccacctctaatactggggattaccattcaacatgaaatttgggcagggacaaatatacagactatatcaccttataaaggtaatgctttccttccttctttgcttagttttggtggctaatggctctgccccacaaatcccctgcctcccaagagaactctgccaagcccatcagaccctactccttcgggcactgcccaacatcccctcctcaaagccccctctgccctttacacaaccagcacccagggctcaggagcaacaggtgacaggaaacccctcaagtaatggcagaggcccaaaaaggaaaattctggagtggttaggaactttgtctcattctttagctgtgataggttagtatctggtttagcctaggcaataataataatacactttttcatcacttactgtgtgccaagcactcactagttttatcttacataactgacacaacaatgctatgaggcagctcagccatattctctctataataccgataaggaaagtaatttaaagattttttttctctctgtacaacaggcacttttattagtggctggaatgcagttatccacaagagtgcacaaacaaaatgggagaggaggatcaggtagggctggcagctggcaagggaaatgggagatacctggctggcgggttctctctgtttgagatcctgggacagtgctatcaagtaaagagaagaagccgggggccttggggtattgcaggtgggaatggaaaaccaggtcctctgagttcaacaggtttggcaaaaggatccccaaggtaagatgtccggcccctctacccatccatcctccagaaaatcccttgggtagattcagtttctcttacaaagagaactgtgttagtaactggcaaaagaaagcagaggagaaatttggcccaaactctccatctagccgacaagtttccattctaattggcacccattcataaagtcacttggaataaacaaaatcttagttttttgggggtacccttattttcttagatttcacactagagtaccaaagttgtacttctttttctgaagtgtcactcatttgaggacttattttccccattggaaattttgctactttgagcagttttatatttgcctcctaacagacacaaataaatgagtcacagaagcgaaaatgcaggaccataatcccttatctgaaaacctggaagtcagatgtgcttcaaagttcaaaccttgtgattttaggaaggtaatgcaatgcatttagcgcacaacctgtaacactcaaatcaaattcattaatattattcagcagaacatgcaaatagtcaagatagaataatatataccatagaaccacacattaggctgggtgtggtggtgcatccctataatcccagcactttgggaggccgaggtgggtggatcacatgaggtcaagagttccagatcagcctggccaatatggtgaaaccccatctctactaaaaatacaaaaattagctgggcgtggtgcatgcctgtaatcccagctactcgggaggctgaggcaggagaatctcttgaacccgggaggcggagcttgcagtgacccgagatcacaccactgcactccagcctgggagacagagagagactccatctcaaaaaaaaaattaaaaacctcacattagttcaagttaagttttacaacctacagagggtatcaaaagcctacaagaaaaacttgttttcagagctttttacatttcagaattatccataaaggattacacacttgcaaatggctcaaaaactagaagaaaacaaaatcaacctgatagttaccaaccatgtacaaattaaaacaatcaaggtaccaatttttgcctaacaaattagcgaatatgtttttcagagaaaataacaagaatatgaaattgagtctttttggctattgctgtgagaatgtaacctgggatgaccttcagatcaacactgatgtcatcaattgcctcaaaaatgtgaacatctttgaccctcaaagtgccttttcaggaacccattttctgtggaagtcctctgatatttaggcaaagtttcatgcacagaggcattcattgaaatgagttttaaaactcacttaaaaataatgagcaactgaaatctcccaaatagatacatagaagtaaaatacagtgaatccatatagtggaacagtaggcagcccttttttgggtgtatagggaaatagagaaacatttctgtgtaacataaactgaaaaagtcatgatacaaagttatattgcattatgaacctatccgagttaaaaatgcaattaaagaacctatgcgagttaagaacgcaattacaggctcatgcctgtaatcccagcactttgggaggccgaggcgggcggatcatgaggtcagaagatcgagaccatcctggctaacacggtgaaacactgtctctactaaaaatataaaaacaaaattagccaagcatggtggtgggcgcctgtagtcccagctacttgggaggctgaggcgggagaatggcatgaaccctggaggcggagcttgcagtgagctgagatcgcgccgctgcactccagcctgggtgacagagcaacactccatctcaaaaaaaaaaaaaaaaaaaaaatgcaattagagaagaccagaatgaaatatgctaacaatggctagtgccttggagtaatggaatcaagggtgattctcgctccttcctcccacaaactttagatctttggggaaattttccaaaaatacctagtgcactgtattttagctaaagggaaatgagaaaagatggcttggctacttaactcctatgcaacagtagcaaactctaatctgaggtgtcactctgggctttttaaaaatccctatcattgcaaagctatcaccacctccagaataaaaactgtttaatatatgtggtccacatttatttgacagtttaaatgacgtaatataaatcaagcctaatgcgcactctggagaaaaaatactatattttttaaagatacacaggataaaagatatatgccactttgccatttacccagaactttcagagacaagagctcagtaagacagagcagccagtaggacagagagacaggtgttggcacaatgcccattttacaggtgaggaaatggaggtggacagaaccatatgctgcaggcatcagggtctccttctgttttttttttttttttttttttttttttgagacggagtcttgctctgtcacccaggctggagtgcagtggcacgatctcagctcactgcaacctccgcttcccaggttcgagtgattctcctgcctcagcctccccagtagctgggactacaggcatgtgccaccacatccaactaatttttgtatttctagtagagacggggtttcaccatattggccaggctggtcttgaactcctgacctcgtgatctgcccgccttggcctcccaaagtgctgcgattacaggcgtgagccactgcacccggcttccttctgatttttgacttcaagtccaaggccctgacttaaggcttggtgctctttccaccatagcatcccatgaccttgttacttactgattctttacaaatatgttagaataaaaagaattttcttactcaaaaaaatagtttagtaataataagcatggacttcaaaatcaaacagatctgactcaatggactccatgacaaaatccagcttacacatgagtgactttttcaacttctctgaggctcaatttcctcatctacaaacacaggaataaaattatgtatataactgacaggaaattaattgtaagaatgaaatgatctaggtatttagactaccgcctgcacacaaaccaggtaataataaaaattgaattcctttttcctaaaagagtaaagtgtctacagtgtactaacaccaaattctgattttagtttttataaatcacaccagaattattaatatacccgctttcagcagcacaccaaatctttacaaccacttaagtgtccgaaattattaggaaccactcaacctaatagtttataccaatgacaatttaatttattctttttgtcagctttaaatcatttctctattgtttcaataagtcattaaacttcaacattagggccaaagaatcatttttaaagaaacaataaaatctgttgtttgttcacttggggctttggtctctcacattcaaattcaactcttcaaatttccaaatagattcatttcatttccatttttagagggggtaggggcagggaattgacagagacttctcacatttttcatttccttttaaaattaaatgtagatatggactcccaagctccaaggtgtgctttttcaaaactttccaaacactatatattatgtggatgtacagcttcgcagctacctggctaagagagaccccagaatttaataaagcttatctttagtttctaaaaaggagtcagaatgctggagggaagcctgcagcccaaggacaatgcatttttcatctcaccagccccaggacctcttccacccactccttactcgagggctatgcccactgtctgagagagaaactaataaacctgaaggttgagtaaccagagaacttaaggacattaataagccaagacgtggaaaatcatccctttgggtgcttgtggtatatagtttcgaatgctgctgctaagagacaagtttaatgagattcttctactaggaaggaagtgaaaaaggcattgccactacccaccgtgaagctatctgcccttcttttctctacttgacaacttctgataaccacatgcttacaattttatgacgttctaaactatcttagaatctcagcgagattgcagaggttgactcatattctatttttcctctgcagagcagtggggtacagtggaaagggaatgaactttggaatcaagcaggctgggttatcccagataaagatacatataaaggtacacacatacacagacacctcctagtggttctgcttctctgaatgctgactggcacagtacctatgtgatgttcagccagttgtttaacctctcttgcctcagttgccttactggaagtaagtatttcacagggttatgagcaatgagtttaaaaatgcctatgaaggctgggcgcggtggctcacacctgtaatccctgcactttgggaggtcgagaagggcggatcacttgaggtcaggagttacaaaccagcatagccaacatggggaagccccgattctactaaaaaatacaaaaatttgccaggcatggtggcgggcgcctataatcccagctactagggaggctgaggcaggagaattgcttgagcctgggaggtggaggttgtagtgagctgagatcgcaccactgcacctcagcctgggagtcagagcaagactctgtctcaaaaaacaataaaaataaaaataaataaacaaataaaaatgcggccgggcgcggtggctcacgcctgtaatcccagcactttgggaggccaaggtgggcggatcacgaggtcaggagatggagaccatcctggctaacacggtgaaaccccgtctctactaaaaatataaaaaattagccaggcatggtggcgggcgcctgtagtcccagctactctggaggctgaggcaggagaatggcgtgaacccgggaggcggagcttgcagtgagatcgcgccactgcactccagcctgggcgacagagcaagactccgtctcaaaaagaaaaaaataaataaaaataaaaatgcatacaaagtactcaacccaaagcctggcacacagcaggcactcaacagtatttcccattcctttccctctacttccctatgctcaaggtacaaacattaacaccatctttggttgcaaggggatcagatgttggctggtcagagcatcttctctttacacacgcctcaagatactggcaaatttgtgctctgtatcctttcctttttagacacctgtttcttcttccgcattaattttcatcaaaaaaaaaaaaaggctgtcatgcaattagatgagagctttcatcagtcacattctagtcctgagacctgggtgttgctcagaggtcaaaccaaacacacacccactctagggatggatttctcctgctgatgatggctaattacatgcatcatgtgctgaatttttaataattttactcccagattaaactcttccccagattctgttgcaactgactctaaccctctaatgaatgtctccaacctcacatccaagtggaacctgattatgcacctatgtgtcccagcaatcaaacgcaggatgaaaatcaaaatgaaccagcagggcatggtggctcatgcctgtaataccagcactttgggaggccgaggcaggaggatcacttgaggtcgggagttcgagaccagcctggccaatatggcaaaaccccatctctactaaaaatacaaaaattagccgggcatggtggcacatgcctgtaatcccagctgctcagaaggctgaggcaggagaatcacttgaaccagagagctggaggttgcagtgagccgaggttgtgccactgcactccagtctgggtgacaaaatgagcccctgtatcaaaataaggaaaagaaaaaaaaaattgtcccatccagtaaaacatgtcactagctgccatttccccaggtggatggctaacggaaatacgggcctgctaaaaagactcaggagacaatattatccatctccttcccttccaacctgctctggtttctatgaaaaagtgaaggccaaactgctaagtcagtgtaaaagttgtaagcgactgaaatgttctcaggaggaagagtttatggatgtttatggaggagacagtcactgttgaaaggcttccagttgcttattatttgggcctgaggaggaaccaccgctgaaatcaagcttggaagagcttgctgacgtcagattcccagctgtagtaaccccaaatggccaagtaagtatgttttttttttaactgcagctgttaggtggcaattaagaggggaagcggtggtaaggaatccctagtgtctgtaattataaaagcaaggatgtgacataggacttccataaaacttacacctcctcttaagattgatttcaattaaaaactgcttcatcgttggtgacactttagcatctctgttggtggcttcctgccctgaccacacaaggttcctttcgtgacgacaggaatcaacaaaaagaagaaaaaaatgtaagtttaccaacgcgccttccctttttccgagcctgatttatacaggatatatgggaagaaatgtggactccttgacctgttacaagaatccatcaaccacccaaataaatggaaacgtggaaagagattcaaagtcctccaggttttaggatattttaaggtatttaaaagggagaaggaggcgccgacagcgcacccggtgctctgtgtcacgatcttccgctcgcggcgcctttgaggacaagggcggcgggaaacgggtccgcggggttccgaggcgagcggccgtggaggaagcgcccccgaagaaggcctggtccctacgccccgcactgcccagcgctggggaacacagatcctcggaggaggccccagggagggaaggcgggagcggggcccgcgggaggggagggacgggagccgttgccacgcaccgcgccctgcccggaccgccgcgggacagccagttgttcagtgccgggatcccgcggctgtgccagaaagcaggacgccgcggggctgccgtcccgacccctcgcttccttccgcgctcccgggaccgggctcagcacccggcgccccggctacgaccggacactcacccggagccaccagcggcgaactcacggcgcctcccacgaagacagcagcggctaggacggcggaccccgggagtgcccgcggagccatcgccgcgtcgcttcgccctcctcccccagggcgccgcgtcccgcgctcgggaaggcagagccgctccggagccggcgggctgatcgagtg

SEQ ID NO: 850 - DNA, 9279 bp, Homo sapiens
cacacaaccttggacattagagcctgtccgtctgatctagagaaggaatgttgctggggaaggaaaactcagggcgaggtgagagaggacagaacctctaaccaggaagaggctgtccccgccaagctccggagaggcgcggaagcatgaccctcaggtatgggaccaggtctataggaaacccatgtggtgtgccctaatgggaggcaagccggggaggacccaaactggaaacctgattctgaaagaggaaaaccaccacaacatcctttgtaattgtgcagcttggaagaacagtatagatcctgtggttttcctggggaaggaggggagcctaaaagccgcaaatgatgtatatttccttcagaagcagggaaggggcagttttcgagtacggctgttaaatctcagcactcacttcattcggtgcaggctgctcctgtggtcttggctatagcagcagaaggcggggatggagggtgccccagggtcaatcttggtcagcctccgaggagctgggagtgcaaggtgtcactctggatgtgcctgcctgcttttcctcgccttcttgccctccttcgcctttcctccctcttttctttcctcctttctttcgccttcccctgtacacctcttgaattcaccatcataaagttgacctgagatgtttcaatgagtaatgttttatgattgcttcagttacattattacaatccagtctgccttccttgtttctcaaacagttctaagctcttttctccttttctttgacttgtttttttttttttttttactacctatcctcctgactagttgttgttgtttgttggttggtttgcttttaaagagtccaggataaacaaagtattgcaggcatgaaaagggtcaggatttcagagcgaattgtggagggggagggtcaggaggggaggggagaggaggggagaggagaggggagggtggaggagaggtattgagggaggggaggggagaggagaggtattgagggaggggaggggagaggagaggtattgagggaggggaggggagaggagaggtgttgagggagaggaggggagatcagaggtgttgagggagaggaggggagaggagaggtgttgagggaggggaggggagaggagaggtgttgagggaggggaggggagaggagaggtgttgagggaggggagggtagaggagaggtattgagggaggggaggggagaggagaggtgttgagggaggggagggtagaggagaggtattgagggaggggaggggagaggagaaatgttgagggaggggaggggagaggagaggtgttgaggaaggagaggggagaggagaggtgttgagggaggggaggggagaggagaggtgttgaggaaggagaggggtgaggagaggtgttgagggaggggaggaggtgcacgtgcttcttctcgcctgtcctatttatccagctcatctatgaattatcagcagaaaaggaaagtaaaggaggagtagaggctgggaataaaatcctgggctttagaaatggggtagtttaagagtattctgaaaggtacaatgttacacatgtgtacacagttccatagcaaaagcgatttttctgtctacgggactgttgttgtacttggggttttctatctttcaattggtgtcacagttgatagaaatataccatgtagcccttattccagaaacaagtcctacttgacattgttaatactcttgtttgtatgcataggttctggcaactagattatatctttcttggatactagacctccatctttttctttttggggggtgtgttttaatatgctgtatccaaatggggtggttaagacacccctggtctatgtttattatgaatgtttgctcatatgacccccagcaacactatatagtaggaatattattatccccatctacaggccaagtgactgaggcccaaagtcccacagtagcagggttttctgtctcctgagcccaccctcataacacctgggcgacacggctggcacaaactggaaatgtcttgattggttgcagacacacaacaggttcactgatagtgctctcgtttttaatccatagccattaaatcattcattcattccacatttattgactgcctgctctgtaccaggtgctgtcctaagtgctgagaattagacttgaagaagggtggagcacggtaaggaaagagggtggcaagagatgcacggctggtccgagggactcttctacattccatgagtcctcccaggaagagttggaaggacaaggggtttggtcctcaagcatgaagtgatttggggatgttactagttttctgtgctgctgcagcaaattactacgaacttagaggtttaaaaaaatggaagcagccgggcatggtggctcacgcctgtaatcccagcactttcagaggccaaggtggatggatcacctgaggtcaggagttcaagaccagcctggccagcatggtgaaacctcatctctactaaaaatataaaagttagctgggcgtgttggcaggcacctgtaatcccagctactggggaggctgaggcaggagaatcacttgaaccagggaggcagaggttgcagcgagccgagattgtgccattgcactccagcctgggcaacagagtgaggctctgtctcaaaaaaacaaacaaaacaaaacaaaacaatggaagtttattctctcccagttctagagaccagaagtctgaaattggtatcagtgggcttgatccaggggtgggtatcagggatcaaggtgtcaccggggccacactctttccagaggctccaggggtgaatctgttccttccctcttccagcttggggggctgccagtactcttggtttgtgacctccttgctccaatctctgcctttttggtcacattgcctcttcctcttctgtctataatcaaatgtccctccacctccttctcataagcatttatttaattgtatttagagtccacccagataaactaggcaaattgtaccatctgaaaatcctacacttaatcacatctgcaaatacctttaatttgggggctggggtggcatataaggtattatttataggttccagggattaggatgtggatatctttgggggccatttttcagcctaccatagggagttatttgtggattttatttttttaatgtaaatctagtcccttttaactaagcaaccaatctgtacttcttaaaaagcaccagtcatattcactgtggacaaaagcttatgaagcagcatccctggaaattcacctatgattgaaagaaggaaggagggacaacatgggagacagagacacagccagcaatgaatgatgtctctttctggtgcatgtgcttcatggagacagggagactggggatgcagattctgttttggcttgtctttttaaaggctgtaggcccgtcacagtggctcatgcctgtaatcccagacctttgagaggccaaggcaggcagatcacttgaggtcaggagtttgagaccagcatggccaacgtggcaaaaccctgtctctactaaaaatacaaagattagccaggcatggtggcacccgcctgtaaacccagctacttgggaggctgaggcaggagaatcgcttgaacctgggaggcagaggttgcagtgagccgagattgcgccactgcactccagcctgggcgacagagtgagactgtgtctcaaaaaaaaataataaataaaaataaaggctgtagatattagaaatgaataatatctaagagatgcttccatactcatttttaggatgttctgaggaaggaagaggccaacatggtcagttttatatgaagagaagattttgttccaaaggaaatgatggggaaaagcccagcttggggaggggtcagggaacagtgggcaagtgggaaatgagtccaccttctgccaggaagcccaagggggcatgtctttgagctgcaaaagaacaggtccacaaatcatagctgagattggcccagcggtaggaaaagcaacacagaatcaatttagtgtggttgaagcttgtgcgatgactcgggctatcacgctcctcagggcctgaatcatgggacacaatggatccgccagcttattccggcatcctttaactcttgaggagcaaatgccctggcaaggaatccgtcagaatctccttcccctcctgctgctgcgtgcagtgggccgtgccctggtgaggttcctgtgtcctctgtagaaggtaacagattagaaaagcagaagtcccttctctgtctagcatccttccaccttcttctcctcatctgcaaaatggggatgaaacacataaccccagggttgggagaaaggtctgacacagaggcaagtgtcagtgaacgtttgagaactctgaagcggtgatggaaatggggtattcctggtaaccagcaccctctctgacccacgtggtagttatccttttgccaaaatgtgtgactctcttaatacattttgagtctctagggaaaaaaaaaggcaaacttaattcctactaatatatcactcactgtgttctctaccttttacgctttcttttccaggtggtaacagaaaacaatccagatggggtgcaggtgctgtaaaataatacaaaggtaaagctggagaaatactacttctaaatggaggaatttgtgatgagcgtggggtcacttttaaagaccatgcgtgtattcagtgcatttatccagcttggggcatgatcaacattgccaacacattaagagtttggaattgttataatatcatttaaaagaacatgtgccctagatttttttaactttttttgctcacttctcaaagcatgttgggaacaccatcattttctgaggctgaatttggtctgggtttctgaggatgcctgaaatggcatcgctgaaaataaatcaccccaatcacatatgtgcttttaattttgtccacattgcatttcagaaaattgtgagtaacgtgaacataaacttctaactaagaaaaagggtaactgatgatcttgctttcttaacaaatatactgtctttttaatcatagttctattctagacctatatataaataagctgtattccactgtaatcatactgtgatgtttggctttattcaaaaactatgtattgtaagtatcattcctgtgactacagacttcatatttatcattttagtgactgcataatattccactgagaggatatactccttatggccctgttagtggacatttgttttatttgttttttattttaaaattctatgaaccactttgtattttacttcaccccttacccctccttcctccttttggctctcttcttaagagtatttcaggcagaaccttgtttatctttttcaagactgtctcgctctgtcatccaggctggagtgcaggggcgtgatctcagctcactgcagcctccgcctcccaggttcaagcgattctcctatctcagcctcccgagtagctgggattacaggtgcctaccacctcacccagctaatttttgtatttttagtaaagatggggtttcaccatgtcggtcaggctggtctcgaactcctgacctcaagtgatccacccgccttggccacccaaattgctgagattacaggcgtgagccaccaaacatttttataccaactatatctatttgatttagacatacttatctaggttgaaaagtaatcacagaaattaaattagcaggaatcgtagaaagaagcagggcctgtggtaaaaagcattaatgatggagcagacctgactggttttcattgtctttcctgaagctatctctttgatccagttcaagtgccctctcctggctatgtcaatgaagtcaacagctgcaagctagatgaagacgacactgataaattaaaaggcaaatggagcagtgaagtcttggtgcagaaaaatgaccctcagaggcagggctcaaagaagactgagagcagcagcaggacagctgatccatgggagccctgctggcctcaccaagggccgctcccacagggggacgctggaggggaacaccatgcctgcggtgtcaacggcatcggccctgctgccactccacagcccactgggaattccagccccacccaggatgacaggggctcctgggccagtactgcaaatactgttcccccaactcaacccttcctggaaggagggggcaccaggaaacaggactgtgtgctgctggcctcagaagggacccaagtcatgagaaatggagactccagagctccttctgaggcagaaagttttgccttggaagtacaagaccatgtcttccagataccagccccagattaccttcagcattggggcccagctggagacaacgttgatcataatgaaaaggactgtgttttcaagaaccatactgaggatgaatccctagagggaattcagcccccagtgggggagcatggtttgaatacgcccttctctgtgaggagaagctgggattcattgaatgaggatgtggaaacagaagttctaagcatctgctttaatgagaagggtcctgttcatgccatgcctgtggttgactcaggaaacaggcaggaggatacccatggctccgatggagatggggatggggagattgtggacgaggatgcagcggtggcggaggcccttgcagctttagaagctgctactgcaggagaagatttggatgagactgattaggggaggggatttgcacagggaggtaagctggtgtcatgctgagcatgcagatgcatttgctccctggatgcatagcaggtgattctgccagcatgcaccagtgcagccttaccagttgtttacatccagcatctgttctgattgtcagcatctgtcccatgctgcttgtcacatatctggagtttcactctgtgtagatgagctgtcattcaggacactaggagaaaaatctgagtgggtcattgtgcccatatccacagaaaatgcagaagttgaacagcttgcttgacaaccctcaaacatctttgagcacctggtacagatgtttatgagaatactctaagatctcaacccttgatcccaaaggcacacaatcacagagcattccttttgactgtaaactgtttaccttgcttttgagagccaaacattgtacccaacctggaaaaagtaactaccccaattaaagtgcctcatgtgtccccagagcatggcttaacttcagggacaatcacccagggaactaataactaaccagttgttcaacagcgggttaagctcagcagttttcacagtagagcagaagtccccaggaaacaaagggttagtcattagctgagatgttgattttaaaacaccttgaccttaacttttttacattattacttttaaatctcctttgggattggggaggctggccaaaataagtcttaaaactgcttatgtcatatttggattttaagttcatgacattcggaacagcaaagccatatatgcaatgtttttatgccattaaatgtctgattccaattaaaatataacaacgtatgtgtctttctagaagtcttaactcaaaggtggttctaattttctcagaatatcagtgaccctggatgttactttcaatgtaaagaactaatctagatggccgggcgtggtggctcatgcctgtaatcccagcactttgggaggccgaggcgggtggatcacaaggtcaggagttcaagatcagcctggccaacatagtgaaaccctgtctctactaaaaatacaaaaaattatccgggcacggtggcgggcgcctgtaatcccagctacttgggaggctgaggcaaggagaatcacttgaacctgggaggtggaggttgcagtgagctgagatcgtgccactgcactccagcctgggtgacagtgcaagactccatctcaaaaaaaaaaaaaaaaaaaagagctaagctaggcacagtggctcatgtctgtaatctgagcactttggaaggctgaggtgagaggattgccagggccaggaattcgagaccaacctgggcaatttagcgagaccccatctctatgaaaaaaaaaaaaaaaaaaagagctagactacaaaattatactcaaggaagggaccgagctggtttgcagagccatagctttggctttctctctgtcaaacttgatgccataactaaatgtcctgatcttacctcaaagatgaacaagccctctctggatttcagccttctaattcactgaaacaaggacaaccattctaacgtaactcaatggagaatttaaaggcattaaggatgctcaaaactatctagaaaaaaataaacatggaagatgctttagtttggtgttttgtaacacagaattgaaatctgactgaacttcatttgatttccagctttgccatgtgaccttggacaagttatgtatccctttacccatctgtaaagtgagaagaataattgtatgtgcttgtaaaggttaaatgagatgatgtaagtgtttagcacagtgcttggcacactaggcactcaaaaatgatgttttactagttgaaaacaattcctttaacaaacatttttacatccccacaactgaaaactctaaaactgggaagtatgtataatgtcattatttgactttggcaattatttagtataaaacatgatttctgagccttccagcacctttaaggacggcacccttacaaatgcttaatgagcctatgggtttgtttggtactgtaatgacaagccatcgcaagtgacctctatatacagggtcactcagagcccttaaaaagataaagtcttggcattgttaattgcattagaggtatgtctccttttgtatttagtacaccaaatacttaatatttcagaatgcttattccttcaatgatttcctaagtgtatcagttgagattatgttcagttgtatgggacgagtgttttatacaaatagaggcttatttacctcttatgtaaaagaagtctggagttagtgatccagggtggtagagaatgtatcactggcccgtgtatcaatgacccacatatcaatgacccacgtatcaatgacccgcatatgaatgacccatgctgcttcaatcattttggtttccttctcaagatcactttgtagtccataatggctgctgtggcttcagtcattacatttgcattccatgttggaaaaagaataaaggaataaaaacccca

SEQ ID NO: 851 - DNA, 42142 bp, Homo sapiens
tttcaagtggtcataattttaatggtaaaattaggacataaaaataattttcaaagaattattttcaaagaacactagacataaaatataacaattttcaaattttcaaagaatactagaagaaaaaaattatacagtcaatccaacaaaaagcttaatagaaaaaaaccctaaacaatagtataactacaaataaaatagggcttccgaattatgtctaaataatacaataattacaaatatgaatgggttaaattagcctattaaaagataaaaccactcagataacaaaaacagacataagaaacactaacataaaacacaaagaattaaaatgaagatatagcaagcaaataatagaaagcttgcaacccagctatagctataaacacaaaaaatgaagttatcttttgacctaataattccattcctaatacttagaaatatttgcacatgtgcacaataatacttaaaggatctcaacactgtttttttttttttttgagacagtcttgctccgtcacccatgctcgagtgcagtggcgtgatctcggcacactgcagcctctgcttcctgggttcaagtgattctcctgctgcagcctcccaagtagctgggattacaggtgcacgtcattatgcccgggtaatttctgtattttttagtagagatggtgtttcaccatgttggccaggctggtcttgaactcctgacctctggtgatctgtctgccttgcctcccaaagtgctaggattacgggcctgagccaccttgcctggcctgcaaaatttgtttttaatagaagacacaagaaatgatttaaatattttatcaacagaaaaccagttctatcaactatgggcccagtatgcagcttttaaaaatgacagttctatatacattgatatgagaccatttcaaacaggtattcaataaagtatagaatggtaacatatcaccaactgtgtaaagaaaaatatataaacatatgaaatgatacattctgtgcctatgcaaacatatgatacattaaaaacaaaagaacatatagtgcctgtctctgaggggaactgtgaagctatggaaaggtgttgaagaaaacctttttatagtatgtattcttgtaattgaataaaaaataaaattacaaaaatcaggcttggaagtatttaatagcagacaaaatatagttcaatatgaaaagcattatatgagacaaaggcaattttcaaaaattgataaaacattccaccaaaaatcatgactacgcatctaacagcttcaaaatatagaaaatactcaaatgcaaaatcaacaaatctgcaattacagaaaaagacttcaacatacttttagaaagtagtaactcaagtagacaataatagctaacacttaccgggcacttcttatgtgagtggcactgaaacatgtgctttcatgcattacctaaggctagagaaaatgttaataacttagacaagtcatacatgtatcataaatatctttgtacctgacaaacagaataaacatctttttaaacaccattagataattatttaaagaccacatattgggaacctacccctaaagaacaataacaaccacaataacaactatcaccccagtaaacatggctggcaagaatacaattaaatgaacattatcactgatttggcaacagctcttatgaagaataatttggcattatgtatcaagtgcccatactctttgacaaagtaactgtctttctgataatctatcttaagtaatacaaaaatggggggaggggaataaaaatacaaaatattagaaacactatcgtcaaaatgaaagggcatggctgagtatggtacaaccgttcaacagaatattgtcattaaaaacatttatggaggctatattatatagtcaataacagaaaatgcttgaaaggttagaagtacatcatcaaattatgttttatatagctgtaaaataaacccaaatcatctttaatgaacacatactattatggtaaaaaaaagtctacaatttctaactttcaccttaggcagctttttattttgcatcctttttttcaactttgtcttctattagctgtgcaagaaatacatgtctgctaaagttacacgatcttcgcacaacagcaacctacacattagtctacaaaggggaacaaacccaaattcctcagaagtctgagtccactgttgccttctttctggccatctggcagttacaatatagcacagaatgactatgcaagttaaatattcatcttagacatggacatttgctttgggactcctaaagtggagtcaaatttgatctctacagaaactctacaatgtagcagagcactgtgcgtacttattgactcccagacaagccgaaaccccgaatttgtcatttctatcagtttttatataaattgttcttacctacttattgatgcttacaatttggcaattataaggggcaaaattggagcaagtgttttgggtaaataactccttacaatatattaaaaatacttacaaacaattcttagaatcaaacacttacgtaaatacttttttaaaaaaataggtccaaaagactcagcccagatcggctttgaagttatatcaagatttaagtctacttcatgccaatgagctactcctcaacaggggctggttttgccatttgaggaatgacagccactatgttgtgtacacaagagagctggatggcatcgacagaatctttatcgtggttctgaattttggagaatcaacactgttaaatctacataatatgatttcgggccttcccgctaaaatgagaataaggttaagtaccaattctgccgacaaaggcagtaaagttgatacaagtggcatttttctggacaagggagagggactcatctttgaacacaacacgaagaatctccttcatcgccaaacagctttcagagatagatgctttgtttccaatcgagcatgctattccagtgtactgaacatactgtatacctcgtgttaggcacctttatgaagagatgaagacactggcatttcagtgggattgtaagcatttgtaatagcttcatgtacagcatgctgcttggtgaacaatcattaattcttcgatatttctgtagcttgaatgtaactgctttaagaaaggttctcaaatgttttgaaaaaaataaaatgtttaaaagtaaattatggcttataggagcttataactttattcagatagcatcaatcagggatgaccagaacacattaggaccccagattattcaaaaactttaacgaattttaaggggaagaattttatcttttcccttaaaatgcagtcatagaaattagaggatgactcactgccacagtgtctaaaagcatttgctagcaaagaggcaggacactaatttgtaaactgctcaactgttctgactggaagggaggcctggagctctgctatcaccaatccttcccttccctctactccacatccttctaaggagcatgatttgaaaattactttcctaggttaatgggcatgtgcatcaatggagagaatagtataagcaagtgagatgtagactaagcaaaatttagatggagaagcacattttaaaaaattaataacttaaaagtctcaagttattaattttttttttgctaactcaattggaagtaagactatgaaatatttcagtgtgtttccaattcccagttgaatgcagtgtttcagaatttcaggtatttcttaagatcctcgaaaacactggtgctgtcaagtccaagttcctcgtacaggaatttaatttgggctgtaatctaaaagaaacacattaaaaaaattaaatagaaggcctttgtagtaaaatgccactgtttaagcttctctttatctatccatctttacctaaccgtgaagtcagcaatttatggcaagaatactttcattcgagagagaggcagaaggcttccaacaattaagattaaattattttctttaacagagctcacgtatcaagtacaagagagagacatttctcttgattgacacagtgtccctccctcccctcctgggtctcacccatagataggacatttgtgaagtggctttgtcataaacctgctgcaaccactgaaaatgtgaaaacaacatgtatctagttcgggaatctgtccactgagagggccttgataacatacctttttgtgagaatcctcaattacatgattgcctccaggctgaatatctagaataatattaggggtctgatagcctggaagagttaacatgtagaacaattagaagattgtatgggatcttctttggaagatcgagacccattcctcccctcttctttgagtactcagttcaaataatagtaaaggaataaaaagcaaaaaccaccatcatcaacaaaaagatgggaggggacaagcaacagaagacaaacttctgacacagcgaaagcaggaagaggccgtatggaaaagactatatggtgccacacggacaaggttgaaacccaggagatcatcaacctgccctgtggaatctgagagtcttatgccctggaaacaccaactacagcaatggatgggggtgacaaatggagatgaatacagggagactgatatggcatgtagtttcaaggcaaaagggagggattcttatctcataaagctgaaacagctagctagaggaaattcatgcagctaaacagtttgggcactgatggcccaaaacaaaaatctcagaatctgtcttttagagattcccaagaataacggctcaataaatattgttaaatgaattaataattgtatggcagtgcatctccaagttatatctgattcttaaatttcctgtttcctttgtgtcctgcctatctattttaatactgtcctttgaaaaagaggtgaggcagtgtatgtatagacatgtagttacgtacactttaactggggagtcaacatagcaaaataattgtttgccctaaatcctgggcagatgatttggctacagcctgaaatatattcctctgagcagtgtgctgtgggtagtagtctgtttggccatgttccctgcttctagggggtctcctaccttcacctgtgtccttagcatgctccgcgatggcttccttgagtttctcagtataacttacaattcctttcagaggtacccgttcatcgttttcatatgccgttatgtgaattgaaggataatgctgaaagaaaatacatgcacgaagagtttacattatttcttatggtcccttgccactatagagactatgaaaaataattacctccaatttttccctgtaagtgctctatgctttttctcacttgctatcttgagagcgcctcagtattacagtagtagactacttgttatctggaatagccttttcttgactaaaggaccttagctaatttagtaattaaggcatgataagtctattcccctgaggtattaaacatggagcatgagcagagatggtgctgaagatatttgggcatcataagtagaaacatctctaaagctcctatttttgcttcagcttggataagttttttttttattatcttctgtgtaaattcaggataatctaacacaattgtctttcactacctgaggtttaatattttgatagggacagtaacgttttatgtagttcttgtgtttttcatcagatgaaggattcccccattcttctaattcttctaatgtcagaggaagtgtagtgtccatcatggtgttgagaacatccaagaaaggtgcctaaaaaaaaggcaaagaaacttatacttcaagtaagaggttggtaagtgagtttcagaaaaacattctattttatgaatatacatactaatatgagagaaaataactcaagccatgtagattcctaggagctagaatactcagtccttaaccagggcctgtaatttataacctacttttaaagtcttcagattccttaaatgacatataacaagaaatggtttatcttctaatttcacaatatttatttttagcttagtaccttttattcatttatattttttcttatataaaagcaataaatgctactgtctcataccaattaggacagttagttattatattaaaacaacaacaacaacaacaagtattggcagtaatgtggagaaaccggaatcctgatacactggtggttggaatgtaaaatgggggagctgctttggaaaacagtatggtggttcatcaaagagttaagcttaagattaccatatgatccagcaattccactcctggcatataatccccaaaactgaaagcagggtcttaaagagatctgcatacctatgttcacagcagcatattcacaacagccaaaaggtggaagcaactcaagtgtccattaaccaaagaacgaataagcaaaatgtggtatacacatgcaatattacatggaatattattcagccttaaaaatgaataaaattctgatccacgctacaatatggatgaacctcaaggatataatctaagtgaaataagccagtcacaaaaaattttgtatgactccacctatgtgaggtgtttgagtagtcaaattcacagagacagaggctgtgggaagaagcaaatggagagctgtttaatcggtacagggtttcagttttgttaagatgaaaaacgagttctggagattgactgcataagcctatgagtgcacttaccactactgaactattcacttaaaaatggttgagatggtaaattttatggtattttaccataattaaaaatttttaaatgaaaaaaatacacaaggaataaagtctttttgaccagttggacattttatattaaaagcaaaaaacgctaagtaaagaaactctgcaaaatacccaaggtgaaagaagagaaaacaacccattggcttataattagtgttacaaaatttaataaaacgaaggctgggtcgcacatggtggctcatgcctgtaatcccagcacattgggaggctgaggtgggcaaatcacttgagcccaggagtttgaaactagcctgggtagcatggtaaaaccacatctctacaaaacaacaacaaaccacaaaaattagcagggcatggtggcacatgcctgtagtcccagatactcaggaggctgaggtgggaggatcacctgagccccagaggtcgaggctgtagtgagctgtgttcgtgtgccattgcattccagcctgggtgaaagagcaaaactctgactcaaaaaacaaaacaaaacaaaacaaaaaaacaaaaaccccacaaaaacaacaaaacaaaaatgaaggctgtatttttcacttagctttattttcttctgttaacatactttttagctttccctcatattaacattaaccaagtatagtgagtcatctgtaattctttttggctgcctaccatatgaacttttttgcatttgaaaaacctccaaccttatcagctagagcctgcctctcactgtggagatactaagtgctagacttctctttcccatttttccctgcagcttgggagtagctgtgtgacccatgtgtgacttgggtctatcaaccagacacatgtgctttacactctgcatggaaagttagtgattcaaagaagcagtgatcacagataatttattctggcaaaagtgccacagctatatccagctctagaagttgcactggcagtgtgaggtgatttgtgcttggcagtggcggcagtaatagtttcattgggccaattctatgcctttggctctgaagcctctaacactggtctgaagacacctacattttcctaatgccctttaatcccttttctgcttaaattagggttgatttttggtgcttataagaagaatttgacttatacatgtataaaaggttgtctcctagtcttcactataataagcaacctagcataaatatccttctcatcatttccttttaaatttctaaaagtcaaaatctagttgctttgtctttaaactgtaaataattctgccattatctttgtgcataggctattctccacatttttctgtttttaaaaaatagacttacaggtgactactatttaacacttatttacaagcccacagtataaactccccaacctcaaaataaaaaatcctgaaaataatttactctctcccatctcagtcattatttttcagagtaacctagaagtaggagaatgatagcagtgaaaccaactgctacaatgtaacttcgtaatttctgacactgggaaaagataatcattttcagaacagggtaagatatttcaattaaaatacggaaaaactatgcccaaacgaccattaagaatggactatctaaaaataaagagcctataaatctaggactgaaatgttgatgggcagtagcctgtcaaggtgaccaggagccaaaggactcagtgcattccagagtcacagcgtgctttgcctggctttctcaactgggactcatatatgcttcagtgctttttcaccaattctaaatgtccttacaaatacaaatgagcaatggaaatagccattaatatctttcagtggaaagccttaaagataataaagaacactgtatcagagaagaataacggttaatagttggattaaaataactttagaagttctcctcaagctataattctgagtttaaaacttaaaagctttgttatactcctatgctatggtaaaactgtaacagaaatgtttttctttccttttttttttttttttttgacaatgtctcactctgttgcccaggctggagcacagtggtccactgcagcctcaacctcttaagagatcctcttaccaacaagcctgggtaggtttttttttttttttaatttcttgcagagacagggtctcgccatgttgcccaggctggtctcgagctcctggtaagcaatctgcccacctcagtttcccgaagtgctgggattacaggcatgagccgctgtgccagcccaaaaacatttttcttagagtagcctatggcttcacacctcccccattctataaacagtagagacagagcgtactcacctccaaagtcaccgctctcaccagctctggattagaattacacaatgctcctgcaagcacccctccagcactgaaagcagtcagggttgttagacttggctgagaaaagccttggccatgaagcgtcttaatgcaagcctctaaatcagcaaggccattgagttttttagttaggcggccatcagcgtgccactggaggcctaactcaccaccacctctgaaattgaagggcaaaaaagttttagtggaaaaaaaaagttaatactgtaggctggggtcagcgaactacacctggaggcctgttttttgtgtggccctggagctaagactggtttttgctttttaaaggttgagtgaaaacaaggaatgtgcaacagaaactgtacgcggcctgcaaagcttaaaatgtgactatgtagctctttagagaaaaaggtttgccaactcctgatatagacaatccagaattgattcaacgaatatattttgagtgcctgcccatttatcagggattaagtacagaccttaaaagtagaaacaaacgaaaatcccctaccgtggagaagacagtaattttgtggggtaagaaaacaacgacttacccagcaatgtggtgtcattgctacaatacaagtgtatttaaggtattacaggagcagaggaaagaacatccatctgccaggtgaggggtatatacacgagtcaggaacacaaatgcttttaaggagatgatgcctaaactgagttgtgaaggaaaaatttgagtttccagagggcaaagaaaaggcattaagacacagatacgacacagcatgtataagggcaaggaggtgacagagcatgtcatttaaaagacatgactttgggggctggacacagtgcctcaagcctgtcatctcagcattttggtaggctgaggtgagcaggtcacttgaggtcaggagtttgagaccagactggccaacatggtgaaacccccgtctctcctaaaaatagaaaaaattagccaggtgtggtggtgcgtgcctataagcccaactactcgggaggctgaggcaagagaattacttgaacctgggaggcggaggttgcagtgagcggagattgcgccactgcactctagcctgggagacagagtgagactccatctcaaaaaaatacaaaacaaaataaaaaaaataaaaggacatgattttggaaggctgaggcgggcggactgcttgagctcaggagttcgagaccagcctgggcaacattggaaaaccctgtctctactaaaatacaaaaaaatcgggctggtacggtggctcatgcctgtaatcccagcactttgggaggctgaggcgggcggatcacttgaggtcaggagttcgagaccagcctggccaacatggtgaaaccccatcgctacaaaaatttcaaaaattagtcaggagttatggcaggcacctgtaatcccagctactcaggaggctgaggcaggagaatcgcttgaaccctggccaagatcatgccactgcacactccagcctgggcgacagagcaagattctatctcaaaaaaaaaaaaaaaaaaattcagacagtgtggtggtgtgcgcctgtagtcccagctactcaggagcctgaagcatgagaatcacttgaacctgggaggcagaggttgcagtgagccgagattgtgccactgcactccagcctgggcgacaaagcaaaactgtctcaaacaaaaaaaaaaaaaaaaaaaaaaaaagggtctgatgctaaatgccgctacagagatccatcagaccattaggagtattatactggggaatctggactgtgttctagagatggggaggtggagaagaattttaagcagaaatacaaaataatatttgtgtcttgaaaacagctgaaataaaatggaagttaaatggaaaacagttcagattcagaggctacttaaacctgaattcaggagaactgaaaggaaataataatattactaaataagtacagagtctggtacctctatgcaaaaatcctaaaaacctatccttttgctttttggatcaactaatctgttaaagaatcaagtttcaccagtgctggtttaggaatacaaaaattgaataataagaatgaaaaaaataagcttttgttccctgatatatattgttattcttgacatctctcacaatggtctagcacttacatgccaggtaaaatatactgactcaccgaacatggcagtatgctaatatccatccatcatccaccaggacccgcctctcaggcctgaaattcattttcaaatccattccataagctccatatacatgtaccaagagaggtttcttctgcaagtcctcagagtcagttttgtggaaaacagtcattggcactaattttccatcctagaaatgaagaattactatgtatgtaaagaagagtcttttataataactgttttatcccaatttaaaatacattgaggtgcactgtccccacttgtgtgctacctactgatgttgagcacaaatttgtttaagaaaaagaattatggtctctaaaaataaatcatggcttttggtttcagctaccttgctgtcctacagtattaaccagaaaagagcagcaagactggcctgaaaacattttattaaatgcagcttttcatgacaataatgtaattttaaagagttcttcactacctactataattttaaattttcagatgaaaccaaaatacttaccaaggttagaagtcctagtatagcactcttcctatgcctaagagctagatattggcatttttcacttttgagtatctacaaatatgctgactaaagtcttaccagctcaattttctatatcctctgtagtcggaattctcaaccattaagacctgaaatcttactgatgttactgataactaccacaatcctcttcaaaggcccatttaactttattaaaaaaaatttaaagtggtcttaaaatttttcggtaaaattctttgtagggttaaagtaagttaaattatttgtaaggttactaagttacttgtaggttatgtaaccatcccccaatgtagctcaaactcatcagttccagttgattgaaactaggcagtctctgaacagacaaaagaactaattctgatctacctttcacacaaaaaagataaagaaattggttttcaccctgcttaaactaatgaaatagcaccgtttacataaagaaaataaataatacatccaagtcactcttcatattttcattctcattttgaaaacttcactttggggcaataactggagacagcaaaatgtaatcaaataaggaggaaattctcctctcattcttctttaaaatacccaagttgttatgacattgttaactttcacttttagtaagattcacttttataaaacttgatgtagattaatttctataaaacactcttggtcttttcacttcccaactcttccccaacttcaattatacaatcagaaaaagttgcttgttgaaaagttttgaaaggaagaggtaaaacagtagctactcctgtgatgggctggatctgggtttgccagcagtactaaaatgcctgtggaaaggtatagcgcttccattcagcagctgcttcccttctcccctcttggctctccaagaacatggtgcttaactgttctttccatctcgggtccaataattgcaacattttgatagactagtctaattccatgtttgtaaaaccaaataaaacctatctaaaagataatacactaagtgggtaacaatgattatttctaagaggtgcagcaagcaaatggtactgagaagtagtcatttaagatttgttctgtatttttgcatctgttcaacaagcatgtattgcttttgtaatataaaaatattaatatttacttaaagattgtcagagaaaaataaatgaattaaagaaaaaaattcctaagaataaaaggcttgtgttgtaattcattgtgtcagcacatgtgaaattatctgatatatgatatgctaaagtctgaggtttccttaaattcaaggctatagtttacatattaatttgttccctacttgcataaatttgtatattctgtatattgagtatacctggaatatggatatttgttatttccttttctgtgtctcatctctctctactcctcaccctgccaatcttccctcttttacttgattttggccataatggcctcctttatatttgttctttttctgagacaggatcttactctgtcacacaggctggaatgcaatggcgcaatcacaactcactgcagcctcaacctcctgggctcaagcaatcctcccacatcaggttcccaagaagcagggactacaagcatatgccaccatgcctggctaatatttttggtttttgtagagatgaggtctcactatattgcccaggttggtttctaacttctgggctcaagtgatcctcccagcttggcctcccaaagtgttgggattacaagtttgagccactgtgcctagccctacacttcttctgtaggctggagagcagtggtgaggtcttggctcactgcaacctctgcctcctgggttcaaaggattctcctgcctcagcctcctgagtagctgacattacaggcacctgccaccacacccggctaattttttgtatttttagtagagatggggtttcaccatattggccaggctggtctcgacctcgtgatctgcccgcctcagcctcccaaagtgctgggattataggtgtgagccactgtgcccggccagccctacacttcttgaattgtataatttctccccaaattcagggcctctatacaaaatggaatcccctatctcctttctagtttactcttaatcatcctagtggtcttacctgagacataacttccttggagaaaacttccctgatctctctagactaggtaaaatccctttgctctatgctcccactgtactcagtatgtcctcctttgcagcagtcagtacattattaatgactttttaaacatgtcatctttcctgctagatgtatgctccatgagggcagggactgtatcagtctagtttactctagtcaactaccaccttcactatttttgccataactacataccaactctattaattttttcttaaaatcaactttaaaaaatcagacataaacaacatgtaaaataaaaagtttgacatgctataaattttcttttttttttttttttttgagacggagtcttgctctgtagcccaggctggagtgcagtggcacgatctaggctcactgcatgctccgcctcctgggttcacgccattctcctgcctcagcctcccaagtagctgggactacaggcgcccgccaccatgcccagctaattttgtgtatttttagtagagatggggtttcaccgtgttagccaggatggtctcgatctcctgacctcgtgatccacccgcctcggcctcccaaagtgctgggattacaggcgtgagccaccgtgcccggccgacatgctataaattttctaatccatgttaaaacaaacatgaatattaaggttaaaaaaaattcacctatccctaaagtcacttgggtattactgtggtctaagaaatctacattaggaaaccgtgctaatgtaactccaacaactgcatggcatctggcaaacggtatgctttcagtaaatgggagctgaaagtgaagattataagacctaccttgcttttggcttctagacgtaaaacgcgactagtctttgtgattgggtcttcatgcccagtttcctcaaacagtttgccttctgcaaacttgtatgtgtaatattttgggggacgtattggagagcaaagttgaaaggggcagttctttgggtcagaatttgtatccattatgaatccacaggcccaaggagggagctaaagaaatacaacagctatttttattctttatttaggccaccaagtatcattaattaaatttctaagtcttctccaaacaagatgatgtggatatctcgtttactttttgttaccacgtcatgcctcattcaaggattactttatcacaacaacatacatttcaaataaaaaacaaaactgtacattaatgaccaataaaataagacaaactataggaaaatgatttatcatgattctagctttacatgaaattgcctttaacataaaagtttattttggggtataatcttggataataaaatagtaaaatggaagaataagagcaaatcaaatagtaattccagaacccaccgacactgccaagatctctgttctcaaagaacgtgaaattcctcacatgcgtgtgtttttcataatttacccactagtccttaccctgctgcctggacagccacagtgatgacagttattatttcagggctataaacgggctcagcagcattaaggcatttgcaatttgtttctaacttttagctcctaggctaaccattgtgcagaacaaaacctcttctggcacatctactctgagagactcacagctattatactcaaggttcttaactttaagaaaaaaggaaaggaatcaaaatttattctctcagagcagcagggtccagcttcaagccttgcactaacatccctcttacaccttttaaagaactctggtaagcaggttgacagagcgttagaaatggtaccgagaggcagaacattaaaagaaaattgcctttcttttcctgagtaattgtagaaagagcaaattccttagaaaatcagaggcacagaaacatcactggtgggcactattgaaaaagggcagccggggatttgtgcgtaaaggggataccattccacctgcagcaactacagccagagtttacgttctctgagcaaatctcttattaataaaaaaaaaaaatctattttcatgaaacactagtaaggacacacatctgcaatctctaaaagctcctaatgtatgcttctcacattgagggttgttttaaaggataacttgtctatttaaatttaagccataactggagagtaaaatgtaaacaaaaattgagaaatctggtagcatagttataagcaagcaaactgagacttgagaggggaaaaaaaggaagcactgctacaaacctcataaccaggcctcagagcgagggtacaaggttccttagcccatggaagctcaagtttttctgccctttgatgagacttcaggacagtctctatgtgacccacgcagtaagctgtcttagctttagaccaagtggttccaataaatcaaaaagtatttttggtgtttttctaaaactaatgggaccaacattaatgttttaatcataataaaaactgtttcaaggctatggacttttagaagttcatccagctaatgcagatataagtattaactaactcaaggatatcttaagccacatttcctattcagataagcctgcagtgtatctgtgtatattaatggacagcaccagagagtaagtaggccaggagatagggagacattccttagatacctgagagaaacaggttcagttttagcactctaccagcaaactatagttatttcatcaaaagaataagacatacatgccgaaagaaaattggcctgaatatgcagactcctcctctaaataaaactgatgttagcatacagcaaaaaacgtcccaactggcctaaattaaatatcataacttctttttgtgacaaaaaaaaatacttccagaaaatactgatggcatggtgaccaaggatacgaggcaaatatgtgaagggttttacatttctgttgctaagatagaatttatttatttatttagagacggagtcttgctcttgcacccaggctggaatgcagtggcgtgatctcggctcactgcagcctccagctctcggcttcaagtgactctcctgcctcagcctccagaatagctcggactataggcacctgccaccacgcctggctagtttttgtatttttagtattctttgtattttatattttttgtatttttagtagagacagggttttgccatgttggccagggtggtcttgaactcctgacctcaggtgatccgcctgccttggtctcccaaagtgctgggattacaggctgagattgaatttaaaaagatcttttaatcaagtgcccaccaggcagagatactgcataaagaaatattttataatgcactcacgctatggttaaagattttgtctttcgtgtatggatggcactgtctatgtatattaattaatattattcaggctcataaaaagggtctgatctataaaattctctttattatataccaggtactaaccagaaagatcaagaagtatttaattccacttgatgatgactagaacattataaaagtcgtaataggtactatcatttgggaagggtcagaaaatgaagagatagaagatacagaataaattaaagacataatgtttgttccagtggaatttaaaaccatggaaactggggcatatctttaaaataagaatacttacaaaaaatataaaaggtcatatttacttagaagtcaaatcatatagcagagtaaactccacatgacatttctaactttcctgacatagaattttgttctaacaagtgcattgctagaaattacatattctctcccattcttattcatacagactgaaataataatagatgctccaccagtttcccaactgaagatgtctaaatttggcaccagttaacatgtaaatggttagccataggcagaagattgaaaactggaccccttccttacaccatatatacaaatcaactcaagatgaattaaagacttaaatgtaaaacctaagactataaaaacccttgaagaaaacctaggaaatataattctacagaaaggcaaagattttatgacaaagatgccaaaagcaattgcaacaaaaacaaaaatcagcaactggaaactaaagagttcctgcacagcaaaataaactatcaacagagtaaatagacaacctacagaatgggagaaaatatttacaaactatgcatctgacaaagatctagtatccagaatttataaggaacttatattaacaagcaaaacaaacaaaaacagaaaaaaaccccaacaccataaaaaagtgggcaaaggacatgaacagatatttttaaaagaagacatacatgcagccaacaagcatatgaaaaaaatgctcaacatcactaaccattagaggaatgcaaatctaaaccacaacgagataccatctcacatcagttagaatgactgtagttaaaaagtcaaaatataacagatgctggtgaggctgtagaaaaaagggaaagcttatacactgctagtggaaatgtaagttcagccactgtggaaagcagtttgggaatttctcaaagaatgtaaaacagaactactatttgactcagcaatcccattattggatatataaccaaaggaatacaaatcgctctaccataaagacacatgcacacattatgttcatcacaatagcaaagacatggaatcaacctaaatgtccatcaatgatagactggatacagaaaatgtggtacatatataccatagaatactacacagccataaaaaagagataatgttctttgcagcaacatggatgaagctggaggccattatcctaagcaagccaacagaggaacagaaaatcaaacaccccatgttctcacttataagtgggagctaaacattgtgtccacatggacacaaggaagagaataacagacactggggcctacctgagggttgaaggagggtgaggattgaaaaactacctattgggtactatacttattacctgggtgacaaaataatacgtatatcaaacccctgtggcagacaatttatctattaaaccaacctgcacatgtacccctgaaagtaaaagttaaaaaaaaagaaatgctatctaaaataataatattaaaatttttaaaattagcaagtgaaaagaaatactttgcactccagcagatgaagacaataaggacatccctccaagtcagtcaccattttggttttaggacacttacatagtgttctaagagactggacattacatttgatcttttgattttagggagtagctggagatttcagttatttcaggcccttgttatttcttatttataccaataaaacaatctcaaaactagcttcctgccccttacttctttttggtttagtgtatcctaatatggctgccactcctcaaaccattcccctgctcaaaaacttcaaatgttacctttcataattaataaattcctcatattgacactcacaaaaagtcaaatcatgacttcatcccccagaaatgtatagcgctttaataaaacagaataattaacagtttcctgaacattttctgaatgtcagagcatacagcttcatttgatggctttctcatcttggaataccatcccctctccacctgtcaaaatcctatctctcttctctggtttatttcacattcaaccaactttaccaaaagctttcctgggccttcttctctagtttgagccccacagcacattttatgtttttgatactacttattcaaatccatgatacacttaacctttatgtactagtttaatcttgtgattaactatatcttccttaaggctaggatattctgctttaacagctttcgattctataatgcccgatacagtattgtgcacatgaaagttcaataaaaagccactgaattgactgaaattgcatttttacaggagttttaagaatattggagttagggaggtataaatggtctatgctgtttgctcatcaactggctcagtaactcttttcatatcaaacaaaatggaagccatcctcttcccttcagtgcctactacctcaactcacatgttaatgctgctttaaaactaggcaataaggttgtcattcaccaattttaggaagttcacttgtgaaggcaggttatctttcctggtagccacaagcagtatcaactagtcagcttgccaagcagtcttgccactattagccttctgtgctgctgtggagaccactgctactcctacactgaaagaaaccaaagtttgttccctgcatcccctgcggataagaaaactggcagacagaagatgatgcagacaaaagcatgtagtggctaaaaacacagtggataccactactgtccctgttggggatgtgggatgggggaacagcagtcagtgtttaggcactagctaccaactttggcctgagtttttactatatctcaagttgcagagatatgtgaggtagagagatatacagaaagagaaatattagcactcaactctacttgtgaagtccatgccataagacactatcttaagtaaaactgcataaaaagcaagatcctctaagtaattctaagataaccctcctaaacccaagagtgactttgctaaattccatttaagttacattcctttcaagaaaaagaacactgctgccactattcaaaatgtgatgttctgttaagctaaactgcataaatattttgattaacagtattaacttctgaaaattaaacatacctttagagaccgaactgaatcatcagccagaccaatcacattaacataaaggagattgctgtgcttcagaaatagaacacagtgatccttaaacatgtccaagtctatcacttttgtatttctcttcattgtaaaaaataaatcccaattcataattgcaggggtatcagccgctgttctcattagctacgtggaacaaagttagaagacatataggtaagaaaacacgaaggctgcagcatccagagatgcaatcactgagaactagaccatactagtcctcactgttttatgaagagctgaaggaactaacgctgcatcagggataaagtgtgaccatcaaccatatgaatgagtcctgactagcctgctgggtggtgagacagtatatccagtgcttagccaaccactggacatttgagtgagggcactgacagctagctgactacagatacatcagtgagcttagctgatatcagcagaagaactgcctagctgagatcaatccaaattgccaactcataaaatcacgagtttgtaagtttgctcttttaagctactaagtttgattttgttaacataaactcaggacagaatatgttttatttactaactttttaggcacaattaaaatatgtagaggcattagctctaagggaaaagaaatgggattggttatacataggaaggtggcatcaatttataaaacaatgagctcttggagcaagaaatgttgttgatcgaagtgtgacacttcttaacagcccaaataggaacaacgagcatccaggattaccttaaattctgtaggttctccaacattagtgagaatgtataattcatcatctctgtgttcaacatagtaaaggaccccatgtattcgcttctggataagtactggtgggtcccaagggctcaggccatctatcaaccacacttcagaagtagtcttgttcataatatttatggtgaggaaacgactgtcttttgtaagataaaggaaaacaaagtagctagagagagagagagagacatgagatcacagtttatttcagatgcatgctaccttgttaaggacagtatctcagaggtggtcagtatacatgttgatttataatgcagataggaaattaaaataattccttagtgaatatcacttgtaactttaacaattagctattatttttctcattttctcctaaagggcattcaaaataatttacttctaacattttatcataaatgtttttcaaaaatacagaaaagttgaaaaaaccatcttgattccatcattgctaacattttgctacatttactttattacatatctatgcacctattaatccatctttatttggatgcatttcaaggtaaactacaaacgtcatttctcaatcacatgagtagataacatagctttttgctgagaagaggaaataaactttctataggagacacaaatagggaataaaagggacacggagttatttttattttcttctttctctgcatgcattttggatttttttttcctttctcccagtttttacaacaaaatagaataggaagaaaacccctcacaatcttactaacgtaacacatttaaaacattaacatagctattttactttttaaatttttccttctaagttatatttatatttcatgtgtgtctttaaatagatgtaattatagatacaatttttgattctgtatttcttacttcatatatcaattttctccctacatgagttgaaagtctttgtgattattatttttaaaggctacctaatattataacaggtttaatggctacctaatatatcataattcttaaaaatttagattttaatgtttcattataataaacaatataacaagaaacatattcatgaagatattttccccttccatgatcttcacaattattttcccaagacaaatttttagaaatggaaatactaatttaataagtgtatttttatgacttgatgaatataatcaaataatatcctagaagcactatactaacataatgagtggctttaaatgttatatttatatttttccttattataaaagtaatttatactgaaactactgaaaaacgtaaagaatcccaatgcccccaaataacaactgcttatagtttggtaaaatttcttctgtattggatcacattaccatgtttatttgtcaatcgttatttcttttgtgaaatgtgtgtctattttaaactttgaatgtagcttaaattattagtatgtaaatagctctttaaaaattaagaatattggctgggcacagtggctcacaactgtaatcccagcactctgggaggccaaagctggcagatcacctgagatcaggagttcaagaccaccctggccaacatggtgaaaccccgtctccacaaaaaatacaaaaattagccaggcatggtggcaggtgcctgtaatcccagctacttgggaggctgaggtagaagaatcacttgaacctgggacgcagaggttgcagtgagctgagattgcgccactgcactccagtctgggtgacagagtgagactctgtttcaaaaaaaaaaaaaaaaaattaagaacattaacttgtctttttgttgaaaacactttcctccattttgttacctagattttaactatttacaatagtttttgtggtttttgacttgagtttaatattttacgtaatcgagactgctactaccctttgtaatttcttatattgattttatgtttcaaaaatattccaaccaagctgactaaaaagcttatattttcatcttattaaaaaattatttttctcaatgggttctttaaatctcttaggaatgtatgctgacatatacaatgatgaaaattattttttcccaaatagtatttcccattgcattataaaataacaccgattcatttttcattagtttgtgatgccttttatcatataaattttcacatagactaggatctatgttttagagttattctaagctctattatttgtctatcaatttgtattatttttactgttattgctttatatgctttaatatataattgtagggcaagtcccctaccctactttgctctttattttcaacactttcttcgctgtttttatatatttttgtttgcttagtttggtgatgacaaattaaaaataaactacttgaccaaatagttgttagatatgtggttacaggaagtgagaacacaagtggctctagggtaaaatgtgtctaagagaatatacgaaatataaagaactagacattaatctttttttccaattatttctatcgacaattatttttaaatttaaaatgtattataaaaataataatgcttattacaaaaagaaaaaaagaaaagtaaaaaaaaaaccattgttagtactttgggtgtatttcctttcaatcttttaaaaatgcatcttttttccttgatacccaattgaaaccatagcatatatttaattttttcacctagcacaataatacatttttgagttagttttaatttataatttagtagcaacacatactttaaattcttctatatattactaagaatttaatggttaaaaggtactcaacaatcatcaggaacaaggggttttagtttgaaagagagatacctatctaagtatataccatttatttaagcaatagatactgactaaatagcactatacaaacctggcaccctgcttatcaattaagatgcaaaggtgaaacagactcagtctgttcacaatctagcagttctaggtcatctttatgaatttacatgaatgaactatgttgtaattcacaaaatcaatttcagtttttaataaaatattagtgatatatctgtatttactctgattttgaatattaccagactccaattttgaatacaaacaactaataaaagaatgatcgttttagccttattattcctggttccaaccaaaataaacgttttaagtcaaccaaagtcagtactttaaataactggaggaaggttctggagagaaagatttaattatattattctagtaccttgggtctttttctgtgtaaaagcgttcattacgtttgttatcaccaaaagtggctcgatatacgtcatgacagcgaaggttcctctggaaggtgtagaataaaacatcttcatcttcctcgtcctttacccattctgaaagaaaataatgagataattatacataatcacctacactccattaaaaaaaaaaaaaaagcacagcacattctaattttgaatgccagtgagaacatgtgcaagtttatccctggaaatctaaatatttgactgtatctaatctgtgctgtatataagccagagagctttcctgagaataaaccactactacaccattccaaggtttcaagtagttatcagtctcagggtactcaggtttctaaataagagctaaatgctcaatatttaggaaagacattggtaaagtcacatttgcttttaggaggtgaattccgtctcaatctacaacttgaaactgtaagtctgaaggaatattgcatctttctctcatgtgtaaaccttctctgtctgctttcaagccacaggatatctccaactaccaaacacaatttaatgctgattcttgatcccaccagaagctgtcaacagaagtttgcacacaattacaccatgactgccacctggctgacagtgattgtaagtcatcattgtataatatgcaccatgattttaaaggttataaaatgtacaaaatatatgtcttagaattcaatagttagggtataatttcaattcactgcaacaacatttagttaaacaatggagaaaatgatggctgaaaatgaaaagggaggacaaaatgtaacatatgtaccactcaatgataaatttaaagttagttctattactaaaaatgtcacagcttccattgataaacaggttagttcaacacataccaagttctttggtagtgactttatgctgtaacagctctataagataacatgaaattaaaaaaatacattcaagcttaaagttgaataaaatattaagatgcaacttacgtgtaaaaatttattctagataataatttggcaaataattctgataaatcaaaacatattgtatgacatggactctaattataacacttttaaaaacatgagtattttaaaattacccatctagatatataattaaataagggaaggtctcctgaataagaggtacataggaagatgtatagtccatagggatacatgaatcaggcattcaccttctccctccctcacatgcgacaaaaaaatgtttcaaaagtgttaccgttgcctttcaacacagaggactattttggttggtggcttaccaaaactggacacattcgggaaagaagcttccattacgggctgatcgctgagctttataattacacaggtagatgcttcagaatcttcagttcttatcttggcagccacatatttttcatctggagcaactctgatacaatcaatgaagggctggtctaacttaagttcctccaaattgaataaaacttcataattatcattgtctgctgtataaagaaaaatacgaaagtgataacttcaaaggatgtactttaaaaaattaaaactgtattttaatgttttaaattagaattcccattctgtaagaggccatatcctagcttctttcaacaatgatggcagcttaacttgcacatcaactgacaataagttatttaatattaccttatactattcaatactattctgtgcatcaacctatgagacattatttgatattgttatagtctagtttagtatttacagaccatacagaacctagaaagtaagtgaatataaatgacaatcaacaatatatgccaagtgcctagcatagtacccaagacacagcagatgctcaaaaaatgctggatgccgtctccattctccctgccaaagcttctgagtctaactatatcttacacaaacccagatattaaaaactagtcattaaaaaaaaattcagaaataatctttaaaaaaatcttttctctatctttgagaaattaataaatttcctataaaaaatatgaaatctgaaaattagagcacgtaaaaagaaaaattgtggtgtaccttcttcatctttggaacgaaccaagcaacaaccttcttggtaataaacaaaaccaccatgtttaacctgacaaaagaaacatgcagtttacttaataataatttaattaaccttttcatagtctgactattcaagatgaagatgaaatgaagactcttataaaaaacagacctgttgaagtatatgaatgaacacatatgaaatataaaattgaccatttttacaatgtagttgataagatatggttttcgtatgttcataaccactagaggggtttttaatacataaatacaagaggcaataaagaaaaggtataacaaaatctgtcagttctcacaactgtacaaaccacttctgctacattttagaaacatctgatacctgtacagtgggagtcaattaacagaaatcaagtggcatctttaagacaatccaaaatgatgcagatgaggaaactgtggctcagactagcctgaaaacccagtctataactttctgagactccttcctttaaaatatgctgtcaccaacaactatacacagtcttgacttaacacaaactatttcacctgctgtagggtgacaaatacaatttgaaattgagagaattaatattacccaaatataaatagtgttcttgtctaatgcctacatattaaatgtaattgattggttgatatgatttcagtggcttacgtttattatctgttagttggtggcgtaatttgaatctggagatccttattcttaacctactatttccactctactatgtatgtgattttcacctattgcggttcaattttccaatcttattgaaaaattcaattcattttttcttttttttttgagacagagtcttgctctgtcacccaggctggagtgcagtggtgcaatcttggctcagggcaacctctgcatcctgagttcaagtgattctcctgcctcggcctcctgagtggctgggactacaggcgcctgccaccatgcctaatttttgtatttttagtagagatggggtttcaccatgttggctaggctggtcttgaactcttgacctcaggtgatctgcccaccttgacctcccaaagtgctgggattacaggcgtgagccactgcacgcacagccctcaattcatttcgactgactatttatgactgtgataaccataaaatggttaaacagatacttggctttcatggtattatactacttaaagtgaattccttttattaaaaaatttagacaaaacaatcaagtaattttcaaataataacaaagtatgaactactttcatttgaacttctccttagaatgattaaaaaatttttaaatcagtgctgggcatggtggctcacacctataatctcagcactttgggaggctgaggtgggagggttgcttgagcccaggagttcaagatcagccagggcaacacagtgagaccctgtctcttgaaattttttttttttaaatcggaactgattgtttgcaaaaaccagaattaatatattacagttgaaaattcatcttactttcgatctttacatttattaaaagatgtaaaggatcacattctgtgatcacaatctctgaaatctttgctttttaagtttttcagcatattttaaaggccaaaagcagtataatcttgatgtggactatgtctctaaatcaccaagtatctcatttgcatcttgattggtaatatcaaaaatttttttttaaagacatgagatatcttacttccacattgatgatttcatattcttcttgtggctgtgtttctaattttgttctcactttttcaaatgcatccatgttttctggaaggggtttttcgttttcttgtttaacaggctgaagatcctggaaaaagttttgttatgatcaaaatatttcaaactagggaaaaaaaacttttgctttttaaagataagtaggtctataccgtagacttaacgttgtacaaaaaagaaataagattaaatagtaggtatttcacagattgtaaatgttctttcctaggctcatcaataaaatgatctttttcgttaaaaaaagtaaacaaagtaagatagacatttgatggttatactattattttagatgaataagtccttaagaagcaggaatactaagaagctcagaagaatgttcagaaatactatggggaaaatttatacacaattaaggagaaaataaaattccatgaacttttacatatttaataggaaaatcaggtagagaaaaaaatctttcgcgtttaggaagtactgaagtacttcctaaaagaagggaaatatcaaagaagtggaagacattatcactactaataaatgttcactattattttattcacagccagagtgataagaaatatttccctacttcattaactataattttttactttttaaattttttaaatttaaatgggtctgagaaccaagggatataattttcttttcttgtgggaataactaagccccaaaacagaactgtttatcacatcaaaaagtaaactggcgaggcgcagtggctcatgcctgtaaccccagcattttgggaggccaaggagaatggatcacttgagcccaggagctcaagaccagcctgggcaacatagcgagaccccgtctctataaaaaaatacaaaaaaatttagccaggtgtggtggcacacacctgtagtcccagctacttgggaagctgaggtgggagggatcacctgagcccaggaggttgaggctgcagtgaagcatgatcatgccattgcactccagcatgcagagtgagaccctgtctcaacaacaacaaaaaaaagggaattaatgcctaatgaaacagagcttctttttcagtttctttgaggaaaaataacatgttcactttatgaaaggaagaaccaggaaaaataatagaaaataatgaacatgagtggagatatagatgaaagctaaataagcattcactgtgtcttatcaagagtgactaataagctgacagctttatttgagttctggtaagcaaattaatatcatataaatcattacaatttggataaagcaaaacctgttatcaaatttaaaaactgtttaataattcaacactccagtggtttgccttgtttaagcaaaaggattctggccaagatattttacttcagctctctgccaaagatgacaattgtacagtgatttgtaccagaggggggacttaagtctttggtaaggatcgccaacagctggaaagtatttattgcataaaatatgtccatgatactttaccaacattgtagagaatgtaagctataaatacagtttatattacaaagagtttacaatctaaaattaaacacaagaatataacggaaaaatcaccaaaacaaattaaatggaaaataatcattttcacaaaggttttccttttagatttttttgggacacattattatttgaattagattaaaattagcaataatggttgttatgatagtctcaatcatttagcctctacttactatcatataattttctgaattttttttaagagacagggtctcactatgttgcccaggctggactcaaactcctgggctcaagcaatcttcctgcctcagcctcccaagtagatgggactatagataggtgtgtgcctcctcattccatacagttaattttttgagtaattatttgaagatcaaatactggaggcttatatatttatttttcattcatttttaaagcatttctacaaaatctacagttgatctttaaagtggtgagacatgatatctgtatcaataatcccctcatatcaccatcataagtcagaagatgactaaaaatctattctgaaactgtaaaatagcaataggagctgcctttgcatttctagattcaggattgtctgttctgtaatttccattaaaacttttgaagtagagtcaggattatctctctactaccctgtagcttctagcacattctaggtcatggagctgggttctgtcacttttaaatactcattcttactgagagtcatagccaacacagagccaaaagcaacagagcgggctccaaaactcatcttcttaactttacattccttcctgattaacattttttctgtcatatatccaaataaactgagcttatctgaaccaaaataactctgaaagcaataggatttttgactcccttaacgaaattcaagcagaactcaacagctttctaagtaactcttctaaaggaattactcccatggaaactgaggttttatataatattcattaagtactccaggttacttttggtttttgttgcgtcccagggatacctgctcagtgttttaagctttcatttcaatttcagctagcaatatcattagcgtacacagctaaagccatccattttagccaggtatcttagtccagttgtttcaaaggcatatactacccaatggagctgaggtaaggatggctttaccttcagattttgagaaggttactggtacagtatcactccattagtggtaaaaagaagcactccttcccactccccaagtgacccaccactaaatcattttaacaatgaaagctgttataaaatagaaggagaatgatatgtgttaactttatcatggcaaagatgctgaactctaaagatagaaaaaatggtgaagtagaaagacaccggacagcccttcagtcaagactaattagccattagtaaatggctaattctaaggctagagcagggagaaaatacatggtaggtttgggaaatcttatgccagaaaataaggaagtgctcaaagtttaatggagacatgtcaaaagaatacaagtgtcaactgaaggggtttctacaggccacattttggacaactggagcctcaaaaagaataataaataataaataatacattgaaaaaacataaatccacagcaattgaaaaacagaatgcaatatgaagcatttcaatttaggaaaacagaaaaagagtaagtcttaaggaagtagaagaaaggtaagaaaattaatttttgaaattaaattgataacaaagaaactaaagagaatcaaattaaaagttggttcttttagaaacctattaaaaaacaaacatcacaaaactgatagaaaaaagaatacgaggccgggcgcggtggctcacgcctgtaatctcggcacttcgggaggccaaggcgggtggatcacgaggtcaagaaaaaagaatacgaggagagaaaaaggcataattacagatacaacagagatttttaaaaattacaataagctttatgtgaatctatttgaaaataaatgaaatgggtaattttccaggaagaaaaattaccaaaattgacccaagaaatagaaaagctatataagtcactaactcttaaagaaattaaattgctaactaaatgtccccttcttgaaagaaacaccaagcccagatgctttcaaatgtagctttcttggatcttcaagaaacagctaatcttttcatacgtcaactatttaaaaaaatagtaaaagaggtaaaactactcattttattaggctaatataaccttgacatcaaaattagacaatgatgatatgagacaattaaaaaaatcaatcttattctaaaataaaacttgataaaatcaaatttttaattttaaaaagcacaaaataagaacagtaatagtaataccaattaaacttaatgtgaccaagaaggattttttcctaagaatgaaaggatggtccaacatcagaaaaaaatctatcaatgtaatctaacacaaataaaggagataaatcttagagccatttttgataaatgcagggaaaaaataaaaaataatcacactttaaaaaaatgataaaaccttaaattaggaatagagaggaacttccttaatagtttctgtcagttatcttacacagaaatatactaaatctgtaatcaaaatacctgaaattaattcatattagcatatacatggtatttagcaaccatgaaacaccaatgagatttccaaaattttaataatgttcatgtaaaacaactaattgtatttgctgttaactcattttattttttaaaagcaactgttaaatgaaggaaacttgttcctttcatcttctgcctccaattcttctccttaccccttctctagagcccagacttttgctcttcttatgccactgactgctcctgtcaaggtcactcaatggctaccacattgcaaagtgcaaaagttaatgttcagtattcatattacttgacctgtcaggatcatgatacaattgatcacttcctcctcctaaaaacacttttctttacttggcttccaggacacctcattctccttgttttcctcttacttcactggcccttccttctcagtatctttagctagttccttctcaactccctggctttttttttgtttgagatgggatttcggctccctgcaacctctgcctcctgggttcaagcgattctcctgcctccgcctcctgagtagctgggattacaggcacttgctcaccacgctggctaatttttttttttttttttgtatttttagtagagatggggtttcaccatattggctaggctggtctgaaactcctgacctcaggtgaaccacccgcctcagcctcccgaagtgctgggattacaggcgtgagccactgggcctggcatctccctggctttttaacactggcagagctcaattcctgcactaagtacttctcttctttgcagtctgcactaattcccttggtgatctcatccagtcatgaccttaaataccatttatatgctaaggactcccaaatttacagctgtagcctgaacaatcctgaccaagatgaacttgtatatccaactgactacccaacatttttacttagatgtctaatatgccaaaaaatgtccgaatctgaactttaaatctccccatatatccctcgccctattaaaaaaaaaaaaaacaaaaccctgttctccaggcaatctttccaatttacataaatgacaaatctgtcctcccagctactcaggcttaaaaacattacagttggatttgtctttttctcttgccacaaacaactggtctgctaaatcctctcaattctactttcaacatatatttagaatctgaccacttctcacacttggactggactacttggctagtatcatcatcatttctcccttggattactgcaaaagcccaaaagctttctctgcttctgcgcttgcctcctggtctattttcaacaaaggagcttgtgtgagtctgaagtcagattatgttactccactcaaaaccctccagtggtttcccatcttgctcaagaggaaaagcaaaaattcttacaatggtctacaaagtcctaaagaatcttgtcccattacattgctgacctaatctactgctacacgccaagcccacttattccagttaatccatacttgatgtttcttgaacatatcaagcttgctcccatatcagtttcttagaacttgggccctatgcccaaatacctccttaaagctattgctcaaatgtcatcttctaagttaggcctttcctaaccattttactaaaataacacccctccctatccccacactgcctattcacatcttccccgtcttttttttcttttcttcttcgccataactatcgcttttgacccactttgtatttcattcatgtaattctttttatttttttgagagatgaggacttgcttgtgtccacctcagctggagtgcagtggcatgatctcggctcattgcaacctctgcctcctgggctcaagcaattgatccttgatctcagctctcaagtagctgagactacaggcgccaccatgcccagctaatttttgcattgtttgtagagacagggttttgccatgttgcccaggctgttcttgaacttctgggctcaagcaatgagcccacctcagcctcccaaagtatattacaggcatgacccattgcacctagccttgttcatgtaattctttattctttctcttttcctttctcaagtaggatggtaagcttcacaaaggcagggatttttgtttattttgttcagtgttatatctccagtgcctagaatggtgcatagcaggtgttcaacaaatatttgctgagttgaataaaattcagacagcataaaacataaaatgaaaaaaacatatttaacaaaagatatcacaaagtgaaaaaaataataatagaacaaatatggagaagatatctacagcacatataaaagacaaaggacacgtaaagaaatcttatgaatcagtaagaaaaggacagacaattaaaagaaggtcaaaagacaagaataggcattcaagaagaaaaactataggatcaataagtgtaagaaaagatgctcactggccatgagtggcagctcatgcctgtaatcccagcactttgggaagctgagacaggaggattgcttgagcccaagagcttcagaccagcctgggcaacatagcaagactctgtctctatttaaaaaagttttggattttggagcatttcagattttgtattagggatggtctacctgtactacaagatattaaaaaagaaaggtactgtgaatgaggctaacttaggtctacttctgactctactagttttcttacttaactttaggctctgtggctttagtttcttcatttgtttagaaagaatacacacgcttcctgattttaagacttattacaggccaggcgcagtggctcatgcctgtaatcccagcactttgggaggccaagttgggcagatcaccctgaggtcaggagtttgagaccagcctggccaacatggtgaaaccctgtctctactaaaaataaaaaaaaaattagctgggcatggtggcaggcacctgtaatcccagctactcggggggccttggcaggagaattgtttgaatctgggaggcagaggttgcagtgagctgagatggcaccactgcactccaacctgggcgacagagcgagactccatctcaaaaaataaataaataaataaataaaacttattacaaagctatagtaattaaatgtgtagtactggcataacgacagacatatacaaaaatgagatgaaagtgagagtcaagaataaaccattgaatttatggtcagttgattttcagaaaggacaccaagacaattcaatggaaaaagaacactcttttcaacaaatgttgctcagacaatggatatccacaagcaaaataataaagttgtaccccaatcccttgcactataaacaaaatgaactcaaaatgggtcatagggctgggcatggtgggtcacacatgtaatgccagcactctgggaggctgaggcaggaggattacttgagcttaggagtttgagacaagcccgcacaacaaagtgagaccctgtctccacacacacaaaaaatcaaaaaattagctgggcatagttgtgggcccagctacttgcaaggtaaggcaggaagacagcacgagcccaggaggttgaggctgcagtaagccatgtttgtgcctctgcactccagcctgagcaacagagtgaggccctctctcaacaacaacaacaacaaaaaaagtatcaaagacctaaagaaagagctcagatgggatgatttctggggtatgttttctagcaataaaatttatggttatatgaaaagaaaaaatgcattaatttaactattaattcattctataaacacgttgcttatctacaatgtggcagtcgttatgctatgtgctggcaagatgtgtattataaaattcttgtctttaaggacctcccaatataatggggagacaggaaaagtttaaaatgatgtagtaatagcagagaggtaaatatagtgatttgactcctatggcttcaactactatctacatgtaacaactctccccaaattccagactcatatatccaactgctactgaaatctccactttactagtgagttatatttatcctttcctcctctcttttttttttttgagatggagcctcgctcccatcacaccaggctggagtgcagtggcacgatctcagatcactgcaatctccacctcccgggttcaagtgattctccttcctcagcgtcccgagtagctgggattacaggcatgcgccaccaggcccggctaaaatttttggattttcagtagcaatggggttctgccatgttggtcaggctggtcttgaacttctgacctcaggcaatccacccgcctcagcctcccaaagtgctaggattataggcgtgaggcgccacgcccggccttcttcacccttaagatctgaatatcagtaagattacatacatgactgtgaaataagtccatctgaaacataaagataaaccaggtacgttttagaattttgagattttggaatgttaactgggtaccttatctcagtttacaggggaacaacactctaatcaaatgcagtaacattttagagctaaacatctactaattgggataaagatcataatagctttgtgtcagtttaggtcaggttttgcccattctcaacagcctccaatcagttaaaaaaaatcatttgttttctaacaggcttttggattttagaatccaaagagatgaggaattatcactcaagctctctagtcttccattaagatgtctcaaataaaatgtaatcagggccagctgcggtggctcatgcctgtaatcccagcactttgagagggcaaggcaggtggattgcttgaggctgggcttccagaccagcctagccaacatggcgaaaccctgtctctacttaaaatataaaaaaattagctgggtgtggtggcacatgcctgtaattccagttactcaggaggctaaggcacgagaatcacttgagcctgggaggtggaggttgcagtgagcagagactgtgccactgcactacagactgggtgacagagtgagacactgtctcaaaaaaaagcaatcaccctgtaaagactctcatcttcactcatctgagttactgacaaggcttcctacttccaatttattctctattctgtcagagtgattcttctaaaatgcaaatctgattgcgcctacatttttcaataacattctattgcttaaaaggatgtagctcaaactttttgcaagatatacaaaactacatattatatatatatatatatatatatatatacacacacacacacatatgaatatgagactattgcaggagctgctaacctgtattgtagaaataggcaaatgacatgtttaaccaaaggatttagtcttctctctttaattatacaatttcattttgtatcttgttcaaattatcactattaaagattttgggaattattttttaggcagagcagagcaggatgatgtggaagataaagaaatgtgatatctggatggatggatgctagtctttgaatatcactggctggcttgtaagtataatagagtaagttcatcttgccatctggctaatgtaaaatggaaagcagaggtacttgccaataagaactgcagaactgaatgaattcaataaggtttagatcggcaacacttgatcatcaaacatttccaatttctaaattcaggtccagtgtcagtcaagttgtgagttccagaattacctgatgtgaacttcaaaaaacagatctggggccgggcatggtggctcactcctgtaatcccagcactttgggaggccgaggcaggtggatcacctgaagtcaggagttcgagaccagcctgaccaacgtggtgaaaccctgtctctactaaaaaatacaaaaaaatttagctgggcatggtggtggacgcctgtaatcccagctacttggcagctgaggcaggagaattgcctgaatctgggaggtggaggttgcagtgagccaagatcatgccattgcactccggcctgggcaacaaagcaagactccgtctcaaacaaacaaacaaacaaacaaacaacagatgtgtaggcctcaaccatagagattttcattacgcagatgtggggtgagatccaggaatccgcatttctaaaaagctctccaggatttctgatatacagttagactgcagaagttgatactgaagagtccccaaacttttaggcagtaatttgttgctaaggtaacaagaggtatagaatcatgaaattttagcacctctaagactttctacagaatgacaagttgaaactccctatttttttttttttgagacagggtatccttctgtcacccaggctgaagatctcactgtgcctcaacctcactgcagcctcgacctcccaggctgaatcaatcatcccacatcagccttccaagcagctgggattacaggcgtgcgccaccatacccagctaatttttagtctttttggtagagttggggttttgccatgttgccaaggctggtctcgaattcctgagctcggacaatctgctcgccttggcctcccaatgttctgggattactggcgtgagccagtatgcctgatcagaactccctatttttttcagtcaggaaaattaggagtcctgattagttcagtcacaccaatcgtggctggatcttttgccttctaacattcccactacacatgctacttttctgttccttagttaacttatataggtaatagctctttaagcagacattttaatttacctaaaagcagtaactactttttctactttattacaccctataaaagtggacagagttggaaatcagtggatgcttgctgaaagaaggaaatgtgcattcttctctacaggtgttttcacagctgccggggcatctttataaagcttccccaggtctcagtgataaagaccatggcttttacattacatcatttctcatagagggaatggttgatacatgacatgtgacagcaggattactttatcaggtaaaggaattactaaatgaactattaatacttggagttattgagtcaggttaaagtttccaggtagtgggaatctataaaagagaacggaaaagttgcttcaggaacaaatggagggaagaaatagtcaaccttctgtttagaatgtgagctaatatcacagctgttactctgatggtaattcctgtctactatttataaactaagtgttaagacaaagtacgacatgacaaaatgttctaaacacaatgcaaaataaaataacctaaaggtccaaaatttagttcaataggtgaaattaaaaattttatctttctgaagtaggaaagatgtacaaaaaacacaaaaatgaaataaaaagaagttataaagaatttctaaatgagtaaagaaagtactaaactaaggcaagacactacaaaaaggaaaagaatttcaaagactaaaacataaacagtaaaagtctaggaagactagggggctaacatataaaatgttaaaagcaaaagagacacacacaacacctaaataggtatcagctaagatagcggcaaaaattgaacaaaaactagaaaaactgagaaaaattagattgaaaagatagtttctaaaatgagaagaatctgcccaagtgtccatcaattacaggaatggataaacaaaatgtggtttatacatacaaaggaatattattcaactataaaaagaaatgaagttatgatacatgcatacaacacagatgaactttgaaagccactgaattgcatactttaaaatggatcaagtggaaaactttgttatacatatattttacccgaagaaaggaggaagccaaaacagactaaaagaaaaatcagtatgcgacaaaaccagaaattaaaataaaaaaaatattaaaatcataaatttgtgaaactattgcaagaataccacccccaaatatcattaaggaacctaaggaacataagaagtaaaaggtaggagagggatgtcaaagcagcagcagcacaaatagatcatttaatcctacttactgtaggatgaccatataatttaccattctaaccaggacacttttgagaggaaaggggacactattaataattacacagggacaacaggtgtaggctggagctgtgccaggcaaaagtggttatgtggttactctctatataagggcaatcaggtccttaaggttgagttcacgcccacagcttggggtctggcagaagtacaatactctgacagtgtcttcctgaatgactcaagtggtcaaaaacgcaagattatttttcatttttttacagagaaataaaatacaattcatggcctttactgaagtttactgatttgtgattcataaaacaattagcgtatcattagattttattaagagctataatttagtgttctaggaaatttagaaggccgaattatactttgaaatgcactggcaggcatactaaggaagtcctgaggtgaatcattttttataaacctacatttttatatattacattagagccctataaatatatgtatacactttttttttttttttttttttcagacagagtctccctgtcacccaggctggagtgctgtggtgcgatctcagctcaccgcaacctctgcctcctgggttcaagagattctctgcctcagcctcccaagtagctgggattacaggtgggtgccatgacgcctagctaacttttgtatttttagtagagacagggttttaccatgttggccaggctggtctcgaactcctgacctcaggtgatctgcctgcctcgatgtatatactcttttatacttacttttgactagagacaattgagacttgaaaattagaaaaatcaagttagaattactgagaaaattagtagctctgatattctacccattctttatttttaaattaaaattaatcttaatgacctacaaataggttaacttaaacagtccataccttacatgagaagctccgacttgggatgtttcttgctaactctgatatcttgggtttattctgaagacacttggttaggtgatattttttcaattttattctattgtaacaatgatcagcgaagttatagtgattcaaatgctgtttctgcatgcattttccaaggtgaggaatactatacttcaaagcttggagaaataatttggtcttctgctgcatgatatcaaagtccctggtttatgctccttttggg

SEQ ID NO: 852 - DNA, 44255 bp, Homo sapiens
tttcaagtggtcataattttaatggtaaaattaggacataaaaataattttcaaagaattattttcaaagaacactagacataaaatataacaattttcaaattttcaaagaatactagaagaaaaaaattatacagtcaatccaacaaaaagcttaatagaaaaaaaccctaaacaatagtataactacaaataaaatagggcttccgaattatgtctaaataatacaataattacaaatatgaatgggttaaattagcctattaaaagataaaaccactcagataacaaaaacagacataagaaacactaacataaaacacaaagaattaaaatgaagatatagcaagcaaataatagaaagcttgcaacccagctatagctataaacacaaaaaatgaagttatcttttgacctaataattccattcctaatacttagaaatatttgcacatgtgcacaataatacttaaaggatctcaacactgtttttttttttttttgagacagtcttgctccgtcacccatgctcgagtgcagtggcgtgatctcggcacactgcagcctctgcttcctgggttcaagtgattctcctgctgcagcctcccaagtagctgggattacaggtgcacgtcattatgcccgggtaatttctgtattttttagtagagatggtgtttcaccatgttggccaggctggtcttgaactcctgacctctggtgatctgtctgccttgcctcccaaagtgctaggattacgggcctgagccaccttgcctggcctgcaaaatttgtttttaatagaagacacaagaaatgatttaaatattttatcaacagaaaaccagttctatcaactatgggcccagtatgcagcttttaaaaatgacagttctatatacattgatatgagaccatttcaaacaggtattcaataaagtatagaatggtaacatatcaccaactgtgtaaagaaaaatatataaacatatgaaatgatacattctgtgcctatgcaaacatatgatacattaaaaacaaaagaacatatagtgcctgtctctgaggggaactgtgaagctatggaaaggtgttgaagaaaacctttttatagtatgtattcttgtaattgaataaaaaataaaattacaaaaatcaggcttggaagtatttaatagcagacaaaatatagttcaatatgaaaagcattatatgagacaaaggcaattttcaaaaattgataaaacattccaccaaaaatcatgactacgcatctaacagcttcaaaatatagaaaatactcaaatgcaaaatcaacaaatctgcaattacagaaaaagacttcaacatacttttagaaagtagtaactcaagtagacaataatagctaacacttaccgggcacttcttatgtgagtggcactgaaacatgtgctttcatgcattacctaaggctagagaaaatgttaataacttagacaagtcatacatgtatcataaatatctttgtacctgacaaacagaataaacatctttttaaacaccattagataattatttaaagaccacatattgggaacctacccctaaagaacaataacaaccacaataacaactatcaccccagtaaacatggctggcaagaatacaattaaatgaacattatcactgatttggcaacagctcttatgaagaataatttggcattatgtatcaagtgcccatactctttgacaaagtaactgtctttctgataatctatcttaagtaatacaaaaatggggggaggggaataaaaatacaaaatattagaaacactatcgtcaaaatgaaagggcatggctgagtatggtacaaccgttcaacagaatattgtcattaaaaacatttatggaggctatattatatagtcaataacagaaaatgcttgaaaggttagaagtacatcatcaaattatgttttatatagctgtaaaataaacccaaatcatctttaatgaacacatactattatggtaaaaaaaagtctacaatttctaactttcaccttaggcagctttttattttgcatcctttttttcaactttgtcttctattagctgtgcaagaaatacatgtctgctaaagttacacgatcttcgcacaacagcaacctacacattagtctacaaaggggaacaaacccaaattcctcagaagtctgagtccactgttgccttctttctggccatctggcagttacaatatagcacagaatgactatgcaagttaaatattcatcttagacatggacatttgctttgggactcctaaagtggagtcaaatttgatctctacagaaactctacaatgtagcagagcactgtgcgtacttattgactcccagacaagccgaaaccccgaatttgtcatttctatcagtttttatataaattgttcttacctacttattgatgcttacaatttggcaattataaggggcaaaattggagcaagtgttttgggtaaataactccttacaatatattaaaaatacttacaaacaattcttagaatcaaacacttacgtaaatacttttttaaaaaaataggtccaaaagactcagcccagatcggctttgaagttatatcaagatttaagtctacttcatgccaatgagctactcctcaacaggggctggttttgccatttgaggaatgacagccactatgttgtgtacacaagagagctggatggcatcgacagaatctttatcgtggttctgaattttggagaatcaacactgttaaatctacataatatgatttcgggccttcccgctaaaatgagaataaggttaagtaccaattctgccgacaaaggcagtaaagttgatacaagtggcatttttctggacaagggagagggactcatctttgaacacaacacgaagaatctccttcatcgccaaacagctttcagagatagatgctttgtttccaatcgagcatgctattccagtgtactgaacatactgtatacctcgtgttaggcacctttatgaagagatgaagacactggcatttcagtgggattgtaagcatttgtaatagcttcatgtacagcatgctgcttggtgaacaatcattaattcttcgatatttctgtagcttgaatgtaactgctttaagaaaggttctcaaatgttttgaaaaaaataaaatgtttaaaagtaaattatggcttataggagcttataactttattcagatagcatcaatcagggatgaccagaacacattaggaccccagattattcaaaaactttaacgaattttaaggggaagaattttatcttttcccttaaaatgcagtcatagaaattagaggatgactcactgccacagtgtctaaaagcatttgctagcaaagaggcaggacactaatttgtaaactgctcaactgttctgactggaagggaggcctggagctctgctatcaccaatccttcccttccctctactccacatccttctaaggagcatgatttgaaaattactttcctaggttaatgggcatgtgcatcaatggagagaatagtataagcaagtgagatgtagactaagcaaaatttagatggagaagcacattttaaaaaattaataacttaaaagtctcaagttattaattttttttttgctaactcaattggaagtaagactatgaaatatttcagtgtgtttccaattcccagttgaatgcagtgtttcagaatttcaggtatttcttaagatcctcgaaaacactggtgctgtcaagtccaagttcctcgtacaggaatttaatttgggctgtaatctaaaagaaacacattaaaaaaattaaatagaaggcctttgtagtaaaatgccactgtttaagcttctctttatctatccatctttacctaaccgtgaagtcagcaatttatggcaagaatactttcattcgagagagaggcagaaggcttccaacaattaagattaaattattttctttaacagagctcacgtatcaagtacaagagagagacatttctcttgattgacacagtgtccctccctcccctcctgggtctcacccatagataggacatttgtgaagtggctttgtcataaacctgctgcaaccactgaaaatgtgaaaacaacatgtatctagttcgggaatctgtccactgagagggccttgataacatacctttttgtgagaatcctcaattacatgattgcctccaggctgaatatctagaataatattaggggtctgatagcctggaagagttaacatgtagaacaattagaagattgtatgggatcttctttggaagatcgagacccattcctcccctcttctttgagtactcagttcaaataatagtaaaggaataaaaagcaaaaaccaccatcatcaacaaaaagatgggaggggacaagcaacagaagacaaacttctgacacagcgaaagcaggaagaggccgtatggaaaagactatatggtgccacacggacaaggttgaaacccaggagatcatcaacctgccctgtggaatctgagagtcttatgccctggaaacaccaactacagcaatggatgggggtgacaaatggagatgaatacagggagactgatatggcatgtagtttcaaggcaaaagggagggattcttatctcataaagctgaaacagctagctagaggaaattcatgcagctaaacagtttgggcactgatggcccaaaacaaaaatctcagaatctgtcttttagagattcccaagaataacggctcaataaatattgttaaatgaattaataattgtatggcagtgcatctccaagttatatctgattcttaaatttcctgtttcctttgtgtcctgcctatctattttaatactgtcctttgaaaaagaggtgaggcagtgtatgtatagacatgtagttacgtacactttaactggggagtcaacatagcaaaataattgtttgccctaaatcctgggcagatgatttggctacagcctgaaatatattcctctgagcagtgtgctgtgggtagtagtctgtttggccatgttccctgcttctagggggtctcctaccttcacctgtgtccttagcatgctccgcgatggcttccttgagtttctcagtataacttacaattcctttcagaggtacccgttcatcgttttcatatgccgttatgtgaattgaaggataatgctgaaagaaaatacatgcacgaagagtttacattatttcttatggtcccttgccactatagagactatgaaaaataattacctccaatttttccctgtaagtgctctatgctttttctcacttgctatcttgagagcgcctcagtattacagtagtagactacttgttatctggaatagccttttcttgactaaaggaccttagctaatttagtaattaaggcatgataagtctattcccctgaggtattaaacatggagcatgagcagagatggtgctgaagatatttgggcatcataagtagaaacatctctaaagctcctatttttgcttcagcttggataagttttttttttattatcttctgtgtaaattcaggataatctaacacaattgtctttcactacctgaggtttaatattttgatagggacagtaacgttttatgtagttcttgtgtttttcatcagatgaaggattcccccattcttctaattcttctaatgtcagaggaagtgtagtgtccatcatggtgttgagaacatccaagaaaggtgcctaaaaaaaaggcaaagaaacttatacttcaagtaagaggttggtaagtgagtttcagaaaaacattctattttatgaatatacatactaatatgagagaaaataactcaagccatgtagattcctaggagctagaatactcagtccttaaccagggcctgtaatttataacctacttttaaagtcttcagattccttaaatgacatataacaagaaatggtttatcttctaatttcacaatatttatttttagcttagtaccttttattcatttatattttttcttatataaaagcaataaatgctactgtctcataccaattaggacagttagttattatattaaaacaacaacaacaacaacaagtattggcagtaatgtggagaaaccggaatcctgatacactggtggttggaatgtaaaatgggggagctgctttggaaaacagtatggtggttcatcaaagagttaagcttaagattaccatatgatccagcaattccactcctggcatataatccccaaaactgaaagcagggtcttaaagagatctgcatacctatgttcacagcagcatattcacaacagccaaaaggtggaagcaactcaagtgtccattaaccaaagaacgaataagcaaaatgtggtatacacatgcaatattacatggaatattattcagccttaaaaatgaataaaattctgatccacgctacaatatggatgaacctcaaggatataatctaagtgaaataagccagtcacaaaaaattttgtatgactccacctatgtgaggtgtttgagtagtcaaattcacagagacagaggctgtgggaagaagcaaatggagagctgtttaatcggtacagggtttcagttttgttaagatgaaaaacgagttctggagattgactgcataagcctatgagtgcacttaccactactgaactattcacttaaaaatggttgagatggtaaattttatggtattttaccataattaaaaatttttaaatgaaaaaaatacacaaggaataaagtctttttgaccagttggacattttatattaaaagcaaaaaacgctaagtaaagaaactctgcaaaatacccaaggtgaaagaagagaaaacaacccattggcttataattagtgttacaaaatttaataaaacgaaggctgggtcgcacatggtggctcatgcctgtaatcccagcacattgggaggctgaggtgggcaaatcacttgagcccaggagtttgaaactagcctgggtagcatggtaaaaccacatctctacaaaacaacaacaaaccacaaaaattagcagggcatggtggcacatgcctgtagtcccagatactcaggaggctgaggtgggaggatcacctgagccccagaggtcgaggctgtagtgagctgtgttcgtgtgccattgcattccagcctgggtgaaagagcaaaactctgactcaaaaaacaaaacaaaacaaaacaaaaaaacaaaaaccccacaaaaacaacaaaacaaaaatgaaggctgtatttttcacttagctttattttcttctgttaacatactttttagctttccctcatattaacattaaccaagtatagtgagtcatctgtaattctttttggctgcctaccatatgaacttttttgcatttgaaaaacctccaaccttatcagctagagcctgcctctcactgtggagatactaagtgctagacttctctttcccatttttccctgcagcttgggagtagctgtgtgacccatgtgtgacttgggtctatcaaccagacacatgtgctttacactctgcatggaaagttagtgattcaaagaagcagtgatcacagataatttattctggcaaaagtgccacagctatatccagctctagaagttgcactggcagtgtgaggtgatttgtgcttggcagtggcggcagtaatagtttcattgggccaattctatgcctttggctctgaagcctctaacactggtctgaagacacctacattttcctaatgccctttaatcccttttctgcttaaattagggttgatttttggtgcttataagaagaatttgacttatacatgtataaaaggttgtctcctagtcttcactataataagcaacctagcataaatatccttctcatcatttccttttaaatttctaaaagtcaaaatctagttgctttgtctttaaactgtaaataattctgccattatctttgtgcataggctattctccacatttttctgtttttaaaaaatagacttacaggtgactactatttaacacttatttacaagcccacagtataaactccccaacctcaaaataaaaaatcctgaaaataatttactctctcccatctcagtcattatttttcagagtaacctagaagtaggagaatgatagcagtgaaaccaactgctacaatgtaacttcgtaatttctgacactgggaaaagataatcattttcagaacagggtaagatatttcaattaaaatacggaaaaactatgcccaaacgaccattaagaatggactatctaaaaataaagagcctataaatctaggactgaaatgttgatgggcagtagcctgtcaaggtgaccaggagccaaaggactcagtgcattccagagtcacagcgtgctttgcctggctttctcaactgggactcatatatgcttcagtgctttttcaccaattctaaatgtccttacaaatacaaatgagcaatggaaatagccattaatatctttcagtggaaagccttaaagataataaagaacactgtatcagagaagaataacggttaatagttggattaaaataactttagaagttctcctcaagctataattctgagtttaaaacttaaaagctttgttatactcctatgctatggtaaaactgtaacagaaatgtttttctttccttttttttttttttttttgacaatgtctcactctgttgcccaggctggagcacagtggtccactgcagcctcaacctcttaagagatcctcttaccaacaagcctgggtaggtttttttttttttttaatttcttgcagagacagggtctcgccatgttgcccaggctggtctcgagctcctggtaagcaatctgcccacctcagtttcccgaagtgctgggattacaggcatgagccgctgtgccagcccaaaaacatttttcttagagtagcctatggcttcacacctcccccattctataaacagtagagacagagcgtactcacctccaaagtcaccgctctcaccagctctggattagaattacacaatgctcctgcaagcacccctccagcactgaaagcagtcagggttgttagacttggctgagaaaagccttggccatgaagcgtcttaatgcaagcctctaaatcagcaaggccattgagttttttagttaggcggccatcagcgtgccactggaggcctaactcaccaccacctctgaaattgaagggcaaaaaagttttagtggaaaaaaaaagttaatactgtaggctggggtcagcgaactacacctggaggcctgttttttgtgtggccctggagctaagactggtttttgctttttaaaggttgagtgaaaacaaggaatgtgcaacagaaactgtacgcggcctgcaaagcttaaaatgtgactatgtagctctttagagaaaaaggtttgccaactcctgatatagacaatccagaattgattcaacgaatatattttgagtgcctgcccatttatcagggattaagtacagaccttaaaagtagaaacaaacgaaaatcccctaccgtggagaagacagtaattttgtggggtaagaaaacaacgacttacccagcaatgtggtgtcattgctacaatacaagtgtatttaaggtattacaggagcagaggaaagaacatccatctgccaggtgaggggtatatacacgagtcaggaacacaaatgcttttaaggagatgatgcctaaactgagttgtgaaggaaaaatttgagtttccagagggcaaagaaaaggcattaagacacagatacgacacagcatgtataagggcaaggaggtgacagagcatgtcatttaaaagacatgactttgggggctggacacagtgcctcaagcctgtcatctcagcattttggtaggctgaggtgagcaggtcacttgaggtcaggagtttgagaccagactggccaacatggtgaaacccccgtctctcctaaaaatagaaaaaattagccaggtgtggtggtgcgtgcctataagcccaactactcgggaggctgaggcaagagaattacttgaacctgggaggcggaggttgcagtgagcggagattgcgccactgcactctagcctgggagacagagtgagactccatctcaaaaaaatacaaaacaaaataaaaaaaataaaaggacatgattttggaaggctgaggcgggcggactgcttgagctcaggagttcgagaccagcctgggcaacattggaaaaccctgtctctactaaaatacaaaaaaatcgggctggtacggtggctcatgcctgtaatcccagcactttgggaggctgaggcgggcggatcacttgaggtcaggagttcgagaccagcctggccaacatggtgaaaccccatcgctacaaaaatttcaaaaattagtcaggagttatggcaggcacctgtaatcccagctactcaggaggctgaggcaggagaatcgcttgaaccctggccaagatcatgccactgcacactccagcctgggcgacagagcaagattctatctcaaaaaaaaaaaaaaaaaaattcagacagtgtggtggtgtgcgcctgtagtcccagctactcaggagcctgaagcatgagaatcacttgaacctgggaggcagaggttgcagtgagccgagattgtgccactgcactccagcctgggcgacaaagcaaaactgtctcaaacaaaaaaaaaaaaaaaaaaaaaaaaagggtctgatgctaaatgccgctacagagatccatcagaccattaggagtattatactggggaatctggactgtgttctagagatggggaggtggagaagaattttaagcagaaatacaaaataatatttgtgtcttgaaaacagctgaaataaaatggaagttaaatggaaaacagttcagattcagaggctacttaaacctgaattcaggagaactgaaaggaaataataatattactaaataagtacagagtctggtacctctatgcaaaaatcctaaaaacctatccttttgctttttggatcaactaatctgttaaagaatcaagtttcaccagtgctggtttaggaatacaaaaattgaataataagaatgaaaaaaataagcttttgttccctgatatatattgttattcttgacatctctcacaatggtctagcacttacatgccaggtaaaatatactgactcaccgaacatggcagtatgctaatatccatccatcatccaccaggacccgcctctcaggcctgaaattcattttcaaatccattccataagctccatatacatgtaccaagagaggtttcttctgcaagtcctcagagtcagttttgtggaaaacagtcattggcactaattttccatcctagaaatgaagaattactatgtatgtaaagaagagtcttttataataactgttttatcccaatttaaaatacattgaggtgcactgtccccacttgtgtgctacctactgatgttgagcacaaatttgtttaagaaaaagaattatggtctctaaaaataaatcatggcttttggtttcagctaccttgctgtcctacagtattaaccagaaaagagcagcaagactggcctgaaaacattttattaaatgcagcttttcatgacaataatgtaattttaaagagttcttcactacctactataattttaaattttcagatgaaaccaaaatacttaccaaggttagaagtcctagtatagcactcttcctatgcctaagagctagatattggcatttttcacttttgagtatctacaaatatgctgactaaagtcttaccagctcaattttctatatcctctgtagtcggaattctcaaccattaagacctgaaatcttactgatgttactgataactaccacaatcctcttcaaaggcccatttaactttattaaaaaaaatttaaagtggtcttaaaatttttcggtaaaattctttgtagggttaaagtaagttaaattatttgtaaggttactaagttacttgtaggttatgtaaccatcccccaatgtagctcaaactcatcagttccagttgattgaaactaggcagtctctgaacagacaaaagaactaattctgatctacctttcacacaaaaaagataaagaaattggttttcaccctgcttaaactaatgaaatagcaccgtttacataaagaaaataaataatacatccaagtcactcttcatattttcattctcattttgaaaacttcactttggggcaataactggagacagcaaaatgtaatcaaataaggaggaaattctcctctcattcttctttaaaatacccaagttgttatgacattgttaactttcacttttagtaagattcacttttataaaacttgatgtagattaatttctataaaacactcttggtcttttcacttcccaactcttccccaacttcaattatacaatcagaaaaagttgcttgttgaaaagttttgaaaggaagaggtaaaacagtagctactcctgtgatgggctggatctgggtttgccagcagtactaaaatgcctgtggaaaggtatagcgcttccattcagcagctgcttcccttctcccctcttggctctccaagaacatggtgcttaactgttctttccatctcgggtccaataattgcaacattttgatagactagtctaattccatgtttgtaaaaccaaataaaacctatctaaaagataatacactaagtgggtaacaatgattatttctaagaggtgcagcaagcaaatggtactgagaagtagtcatttaagatttgttctgtatttttgcatctgttcaacaagcatgtattgcttttgtaatataaaaatattaatatttacttaaagattgtcagagaaaaataaatgaattaaagaaaaaaattcctaagaataaaaggcttgtgttgtaattcattgtgtcagcacatgtgaaattatctgatatatgatatgctaaagtctgaggtttccttaaattcaaggctatagtttacatattaatttgttccctacttgcataaatttgtatattctgtatattgagtatacctggaatatggatatttgttatttccttttctgtgtctcatctctctctactcctcaccctgccaatcttccctcttttacttgattttggccataatggcctcctttatatttgttctttttctgagacaggatcttactctgtcacacaggctggaatgcaatggcgcaatcacaactcactgcagcctcaacctcctgggctcaagcaatcctcccacatcaggttcccaagaagcagggactacaagcatatgccaccatgcctggctaatatttttggtttttgtagagatgaggtctcactatattgcccaggttggtttctaacttctgggctcaagtgatcctcccagcttggcctcccaaagtgttgggattacaagtttgagccactgtgcctagccctacacttcttctgtaggctggagagcagtggtgaggtcttggctcactgcaacctctgcctcctgggttcaaaggattctcctgcctcagcctcctgagtagctgacattacaggcacctgccaccacacccggctaattttttgtatttttagtagagatggggtttcaccatattggccaggctggtctcgacctcgtgatctgcccgcctcagcctcccaaagtgctgggattataggtgtgagccactgtgcccggccagccctacacttcttgaattgtataatttctccccaaattcagggcctctatacaaaatggaatcccctatctcctttctagtttactcttaatcatcctagtggtcttacctgagacataacttccttggagaaaacttccctgatctctctagactaggtaaaatccctttgctctatgctcccactgtactcagtatgtcctcctttgcagcagtcagtacattattaatgactttttaaacatgtcatctttcctgctagatgtatgctccatgagggcagggactgtatcagtctagtttactctagtcaactaccaccttcactatttttgccataactacataccaactctattaattttttcttaaaatcaactttaaaaaatcagacataaacaacatgtaaaataaaaagtttgacatgctataaattttcttttttttttttttttttgagacggagtcttgctctgtagcccaggctggagtgcagtggcacgatctaggctcactgcatgctccgcctcctgggttcacgccattctcctgcctcagcctcccaagtagctgggactacaggcgcccgccaccatgcccagctaattttgtgtatttttagtagagatggggtttcaccgtgttagccaggatggtctcgatctcctgacctcgtgatccacccgcctcggcctcccaaagtgctgggattacaggcgtgagccaccgtgcccggccgacatgctataaattttctaatccatgttaaaacaaacatgaatattaaggttaaaaaaaattcacctatccctaaagtcacttgggtattactgtggtctaagaaatctacattaggaaaccgtgctaatgtaactccaacaactgcatggcatctggcaaacggtatgctttcagtaaatgggagctgaaagtgaagattataagacctaccttgcttttggcttctagacgtaaaacgcgactagtctttgtgattgggtcttcatgcccagtttcctcaaacagtttgccttctgcaaacttgtatgtgtaatattttgggggacgtattggagagcaaagttgaaaggggcagttctttgggtcagaatttgtatccattatgaatccacaggcccaaggagggagctaaagaaatacaacagctatttttattctttatttaggccaccaagtatcattaattaaatttctaagtcttctccaaacaagatgatgtggatatctcgtttactttttgttaccacgtcatgcctcattcaaggattactttatcacaacaacatacatttcaaataaaaaacaaaactgtacattaatgaccaataaaataagacaaactataggaaaatgatttatcatgattctagctttacatgaaattgcctttaacataaaagtttattttggggtataatcttggataataaaatagtaaaatggaagaataagagcaaatcaaatagtaattccagaacccaccgacactgccaagatctctgttctcaaagaacgtgaaattcctcacatgcgtgtgtttttcataatttacccactagtccttaccctgctgcctggacagccacagtgatgacagttattatttcagggctataaacgggctcagcagcattaaggcatttgcaatttgtttctaacttttagctcctaggctaaccattgtgcagaacaaaacctcttctggcacatctactctgagagactcacagctattatactcaaggttcttaactttaagaaaaaaggaaaggaatcaaaatttattctctcagagcagcagggtccagcttcaagccttgcactaacatccctcttacaccttttaaagaactctggtaagcaggttgacagagcgttagaaatggtaccgagaggcagaacattaaaagaaaattgcctttcttttcctgagtaattgtagaaagagcaaattccttagaaaatcagaggcacagaaacatcactggtgggcactattgaaaaagggcagccggggatttgtgcgtaaaggggataccattccacctgcagcaactacagccagagtttacgttctctgagcaaatctcttattaataaaaaaaaaaaatctattttcatgaaacactagtaaggacacacatctgcaatctctaaaagctcctaatgtatgcttctcacattgagggttgttttaaaggataacttgtctatttaaatttaagccataactggagagtaaaatgtaaacaaaaattgagaaatctggtagcatagttataagcaagcaaactgagacttgagaggggaaaaaaaggaagcactgctacaaacctcataaccaggcctcagagcgagggtacaaggttccttagcccatggaagctcaagtttttctgccctttgatgagacttcaggacagtctctatgtgacccacgcagtaagctgtcttagctttagaccaagtggttccaataaatcaaaaagtatttttggtgtttttctaaaactaatgggaccaacattaatgttttaatcataataaaaactgtttcaaggctatggacttttagaagttcatccagctaatgcagatataagtattaactaactcaaggatatcttaagccacatttcctattcagataagcctgcagtgtatctgtgtatattaatggacagcaccagagagtaagtaggccaggagatagggagacattccttagatacctgagagaaacaggttcagttttagcactctaccagcaaactatagttatttcatcaaaagaataagacatacatgccgaaagaaaattggcctgaatatgcagactcctcctctaaataaaactgatgttagcatacagcaaaaaacgtcccaactggcctaaattaaatatcataacttctttttgtgacaaaaaaaaatacttccagaaaatactgatggcatggtgaccaaggatacgaggcaaatatgtgaagggttttacatttctgttgctaagatagaatttatttatttatttagagacggagtcttgctcttgcacccaggctggaatgcagtggcgtgatctcggctcactgcagcctccagctctcggcttcaagtgactctcctgcctcagcctccagaatagctcggactataggcacctgccaccacgcctggctagtttttgtatttttagtattctttgtattttatattttttgtatttttagtagagacagggttttgccatgttggccagggtggtcttgaactcctgacctcaggtgatccgcctgccttggtctcccaaagtgctgggattacaggctgagattgaatttaaaaagatcttttaatcaagtgcccaccaggcagagatactgcataaagaaatattttataatgcactcacgctatggttaaagattttgtctttcgtgtatggatggcactgtctatgtatattaattaatattattcaggctcataaaaagggtctgatctataaaattctctttattatataccaggtactaaccagaaagatcaagaagtatttaattccacttgatgatgactagaacattataaaagtcgtaataggtactatcatttgggaagggtcagaaaatgaagagatagaagatacagaataaattaaagacataatgtttgttccagtggaatttaaaaccatggaaactggggcatatctttaaaataagaatacttacaaaaaatataaaaggtcatatttacttagaagtcaaatcatatagcagagtaaactccacatgacatttctaactttcctgacatagaattttgttctaacaagtgcattgctagaaattacatattctctcccattcttattcatacagactgaaataataatagatgctccaccagtttcccaactgaagatgtctaaatttggcaccagttaacatgtaaatggttagccataggcagaagattgaaaactggaccccttccttacaccatatatacaaatcaactcaagatgaattaaagacttaaatgtaaaacctaagactataaaaacccttgaagaaaacctaggaaatataattctacagaaaggcaaagattttatgacaaagatgccaaaagcaattgcaacaaaaacaaaaatcagcaactggaaactaaagagttcctgcacagcaaaataaactatcaacagagtaaatagacaacctacagaatgggagaaaatatttacaaactatgcatctgacaaagatctagtatccagaatttataaggaacttatattaacaagcaaaacaaacaaaaacagaaaaaaaccccaacaccataaaaaagtgggcaaaggacatgaacagatatttttaaaagaagacatacatgcagccaacaagcatatgaaaaaaatgctcaacatcactaaccattagaggaatgcaaatctaaaccacaacgagataccatctcacatcagttagaatgactgtagttaaaaagtcaaaatataacagatgctggtgaggctgtagaaaaaagggaaagcttatacactgctagtggaaatgtaagttcagccactgtggaaagcagtttgggaatttctcaaagaatgtaaaacagaactactatttgactcagcaatcccattattggatatataaccaaaggaatacaaatcgctctaccataaagacacatgcacacattatgttcatcacaatagcaaagacatggaatcaacctaaatgtccatcaatgatagactggatacagaaaatgtggtacatatataccatagaatactacacagccataaaaaagagataatgttctttgcagcaacatggatgaagctggaggccattatcctaagcaagccaacagaggaacagaaaatcaaacaccccatgttctcacttataagtgggagctaaacattgtgtccacatggacacaaggaagagaataacagacactggggcctacctgagggttgaaggagggtgaggattgaaaaactacctattgggtactatacttattacctgggtgacaaaataatacgtatatcaaacccctgtggcagacaatttatctattaaaccaacctgcacatgtacccctgaaagtaaaagttaaaaaaaaagaaatgctatctaaaataataatattaaaatttttaaaattagcaagtgaaaagaaatactttgcactccagcagatgaagacaataaggacatccctccaagtcagtcaccattttggttttaggacacttacatagtgttctaagagactggacattacatttgatcttttgattttagggagtagctggagatttcagttatttcaggcccttgttatttcttatttataccaataaaacaatctcaaaactagcttcctgccccttacttctttttggtttagtgtatcctaatatggctgccactcctcaaaccattcccctgctcaaaaacttcaaatgttacctttcataattaataaattcctcatattgacactcacaaaaagtcaaatcatgacttcatcccccagaaatgtatagcgctttaataaaacagaataattaacagtttcctgaacattttctgaatgtcagagcatacagcttcatttgatggctttctcatcttggaataccatcccctctccacctgtcaaaatcctatctctcttctctggtttatttcacattcaaccaactttaccaaaagctttcctgggccttcttctctagtttgagccccacagcacattttatgtttttgatactacttattcaaatccatgatacacttaacctttatgtactagtttaatcttgtgattaactatatcttccttaaggctaggatattctgctttaacagctttcgattctataatgcccgatacagtattgtgcacatgaaagttcaataaaaagccactgaattgactgaaattgcatttttacaggagttttaagaatattggagttagggaggtataaatggtctatgctgtttgctcatcaactggctcagtaactcttttcatatcaaacaaaatggaagccatcctcttcccttcagtgcctactacctcaactcacatgttaatgctgctttaaaactaggcaataaggttgtcattcaccaattttaggaagttcacttgtgaaggcaggttatctttcctggtagccacaagcagtatcaactagtcagcttgccaagcagtcttgccactattagccttctgtgctgctgtggagaccactgctactcctacactgaaagaaaccaaagtttgttccctgcatcccctgcggataagaaaactggcagacagaagatgatgcagacaaaagcatgtagtggctaaaaacacagtggataccactactgtccctgttggggatgtgggatgggggaacagcagtcagtgtttaggcactagctaccaactttggcctgagtttttactatatctcaagttgcagagatatgtgaggtagagagatatacagaaagagaaatattagcactcaactctacttgtgaagtccatgccataagacactatcttaagtaaaactgcataaaaagcaagatcctctaagtaattctaagataaccctcctaaacccaagagtgactttgctaaattccatttaagttacattcctttcaagaaaaagaacactgctgccactattcaaaatgtgatgttctgttaagctaaactgcataaatattttgattaacagtattaacttctgaaaattaaacatacctttagagaccgaactgaatcatcagccagaccaatcacattaacataaaggagattgctgtgcttcagaaatagaacacagtgatccttaaacatgtccaagtctatcacttttgtatttctcttcattgtaaaaaataaatcccaattcataattgcaggggtatcagccgctgttctcattagctacgtggaacaaagttagaagacatataggtaagaaaacacgaaggctgcagcatccagagatgcaatcactgagaactagaccatactagtcctcactgttttatgaagagctgaaggaactaacgctgcatcagggataaagtgtgaccatcaaccatatgaatgagtcctgactagcctgctgggtggtgagacagtatatccagtgcttagccaaccactggacatttgagtgagggcactgacagctagctgactacagatacatcagtgagcttagctgatatcagcagaagaactgcctagctgagatcaatccaaattgccaactcataaaatcacgagtttgtaagtttgctcttttaagctactaagtttgattttgttaacataaactcaggacagaatatgttttatttactaactttttaggcacaattaaaatatgtagaggcattagctctaagggaaaagaaatgggattggttatacataggaaggtggcatcaatttataaaacaatgagctcttggagcaagaaatgttgttgatcgaagtgtgacacttcttaacagcccaaataggaacaacgagcatccaggattaccttaaattctgtaggttctccaacattagtgagaatgtataattcatcatctctgtgttcaacatagtaaaggaccccatgtattcgcttctggataagtactggtgggtcccaagggctcaggccatctatcaaccacacttcagaagtagtcttgttcataatatttatggtgaggaaacgactgtcttttgtaagataaaggaaaacaaagtagctagagagagagagagagacatgagatcacagtttatttcagatgcatgctaccttgttaaggacagtatctcagaggtggtcagtatacatgttgatttataatgcagataggaaattaaaataattccttagtgaatatcacttgtaactttaacaattagctattatttttctcattttctcctaaagggcattcaaaataatttacttctaacattttatcataaatgtttttcaaaaatacagaaaagttgaaaaaaccatcttgattccatcattgctaacattttgctacatttactttattacatatctatgcacctattaatccatctttatttggatgcatttcaaggtaaactacaaacgtcatttctcaatcacatgagtagataacatagctttttgctgagaagaggaaataaactttctataggagacacaaatagggaataaaagggacacggagttatttttattttcttctttctctgcatgcattttggatttttttttcctttctcccagtttttacaacaaaatagaataggaagaaaacccctcacaatcttactaacgtaacacatttaaaacattaacatagctattttactttttaaatttttccttctaagttatatttatatttcatgtgtgtctttaaatagatgtaattatagatacaatttttgattctgtatttcttacttcatatatcaattttctccctacatgagttgaaagtctttgtgattattatttttaaaggctacctaatattataacaggtttaatggctacctaatatatcataattcttaaaaatttagattttaatgtttcattataataaacaatataacaagaaacatattcatgaagatattttccccttccatgatcttcacaattattttcccaagacaaatttttagaaatggaaatactaatttaataagtgtatttttatgacttgatgaatataatcaaataatatcctagaagcactatactaacataatgagtggctttaaatgttatatttatatttttccttattataaaagtaatttatactgaaactactgaaaaacgtaaagaatcccaatgcccccaaataacaactgcttatagtttggtaaaatttcttctgtattggatcacattaccatgtttatttgtcaatcgttatttcttttgtgaaatgtgtgtctattttaaactttgaatgtagcttaaattattagtatgtaaatagctctttaaaaattaagaatattggctgggcacagtggctcacaactgtaatcccagcactctgggaggccaaagctggcagatcacctgagatcaggagttcaagaccaccctggccaacatggtgaaaccccgtctccacaaaaaatacaaaaattagccaggcatggtggcaggtgcctgtaatcccagctacttgggaggctgaggtagaagaatcacttgaacctgggacgcagaggttgcagtgagctgagattgcgccactgcactccagtctgggtgacagagtgagactctgtttcaaaaaaaaaaaaaaaaaattaagaacattaacttgtctttttgttgaaaacactttcctccattttgttacctagattttaactatttacaatagtttttgtggtttttgacttgagtttaatattttacgtaatcgagactgctactaccctttgtaatttcttatattgattttatgtttcaaaaatattccaaccaagctgactaaaaagcttatattttcatcttattaaaaaattatttttctcaatgggttctttaaatctcttaggaatgtatgctgacatatacaatgatgaaaattattttttcccaaatagtatttcccattgcattataaaataacaccgattcatttttcattagtttgtgatgccttttatcatataaattttcacatagactaggatctatgttttagagttattctaagctctattatttgtctatcaatttgtattatttttactgttattgctttatatgctttaatatataattgtagggcaagtcccctaccctactttgctctttattttcaacactttcttcgctgtttttatatatttttgtttgcttagtttggtgatgacaaattaaaaataaactacttgaccaaatagttgttagatatgtggttacaggaagtgagaacacaagtggctctagggtaaaatgtgtctaagagaatatacgaaatataaagaactagacattaatctttttttccaattatttctatcgacaattatttttaaatttaaaatgtattataaaaataataatgcttattacaaaaagaaaaaaagaaaagtaaaaaaaaaaccattgttagtactttgggtgtatttcctttcaatcttttaaaaatgcatcttttttccttgatacccaattgaaaccatagcatatatttaattttttcacctagcacaataatacatttttgagttagttttaatttataatttagtagcaacacatactttaaattcttctatatattactaagaatttaatggttaaaaggtactcaacaatcatcaggaacaaggggttttagtttgaaagagagatacctatctaagtatataccatttatttaagcaatagatactgactaaatagcactatacaaacctggcaccctgcttatcaattaagatgcaaaggtgaaacagactcagtctgttcacaatctagcagttctaggtcatctttatgaatttacatgaatgaactatgttgtaattcacaaaatcaatttcagtttttaataaaatattagtgatatatctgtatttactctgattttgaatattaccagactccaattttgaatacaaacaactaataaaagaatgatcgttttagccttattattcctggttccaaccaaaataaacgttttaagtcaaccaaagtcagtactttaaataactggaggaaggttctggagagaaagatttaattatattattctagtaccttgggtctttttctgtgtaaaagcgttcattacgtttgttatcaccaaaagtggctcgatatacgtcatgacagcgaaggttcctctggaaggtgtagaataaaacatcttcatcttcctcgtcctttacccattctgaaagaaaataatgagataattatacataatcacctacactccattaaaaaaaaaaaaaaagcacagcacattctaattttgaatgccagtgagaacatgtgcaagtttatccctggaaatctaaatatttgactgtatctaatctgtgctgtatataagccagagagctttcctgagaataaaccactactacaccattccaaggtttcaagtagttatcagtctcagggtactcaggtttctaaataagagctaaatgctcaatatttaggaaagacattggtaaagtcacatttgcttttaggaggtgaattccgtctcaatctacaacttgaaactgtaagtctgaaggaatattgcatctttctctcatgtgtaaaccttctctgtctgctttcaagccacaggatatctccaactaccaaacacaatttaatgctgattcttgatcccaccagaagctgtcaacagaagtttgcacacaattacaccatgactgccacctggctgacagtgattgtaagtcatcattgtataatatgcaccatgattttaaaggttataaaatgtacaaaatatatgtcttagaattcaatagttagggtataatttcaattcactgcaacaacatttagttaaacaatggagaaaatgatggctgaaaatgaaaagggaggacaaaatgtaacatatgtaccactcaatgataaatttaaagttagttctattactaaaaatgtcacagcttccattgataaacaggttagttcaacacataccaagttctttggtagtgactttatgctgtaacagctctataagataacatgaaattaaaaaaatacattcaagcttaaagttgaataaaatattaagatgcaacttacgtgtaaaaatttattctagataataatttggcaaataattctgataaatcaaaacatattgtatgacatggactctaattataacacttttaaaaacatgagtattttaaaattacccatctagatatataattaaataagggaaggtctcctgaataagaggtacataggaagatgtatagtccatagggatacatgaatcaggcattcaccttctccctccctcacatgcgacaaaaaaatgtttcaaaagtgttaccgttgcctttcaacacagaggactattttggttggtggcttaccaaaactggacacattcgggaaagaagcttccattacgggctgatcgctgagctttataattacacaggtagatgcttcagaatcttcagttcttatcttggcagccacatatttttcatctggagcaactctgatacaatcaatgaagggctggtctaacttaagttcctccaaattgaataaaacttcataattatcattgtctgctgtataaagaaaaatacgaaagtgataacttcaaaggatgtactttaaaaaattaaaactgtattttaatgttttaaattagaattcccattctgtaagaggccatatcctagcttctttcaacaatgatggcagcttaacttgcacatcaactgacaataagttatttaatattaccttatactattcaatactattctgtgcatcaacctatgagacattatttgatattgttatagtctagtttagtatttacagaccatacagaacctagaaagtaagtgaatataaatgacaatcaacaatatatgccaagtgcctagcatagtacccaagacacagcagatgctcaaaaaatgctggatgccgtctccattctccctgccaaagcttctgagtctaactatatcttacacaaacccagatattaaaaactagtcattaaaaaaaaattcagaaataatctttaaaaaaatcttttctctatctttgagaaattaataaatttcctataaaaaatatgaaatctgaaaattagagcacgtaaaaagaaaaattgtggtgtaccttcttcatctttggaacgaaccaagcaacaaccttcttggtaataaacaaaaccaccatgtttaacctgacaaaagaaacatgcagtttacttaataataatttaattaaccttttcatagtctgactattcaagatgaagatgaaatgaagactcttataaaaaacagacctgttgaagtatatgaatgaacacatatgaaatataaaattgaccatttttacaatgtagttgataagatatggttttcgtatgttcataaccactagaggggtttttaatacataaatacaagaggcaataaagaaaaggtataacaaaatctgtcagttctcacaactgtacaaaccacttctgctacattttagaaacatctgatacctgtacagtgggagtcaattaacagaaatcaagtggcatctttaagacaatccaaaatgatgcagatgaggaaactgtggctcagactagcctgaaaacccagtctataactttctgagactccttcctttaaaatatgctgtcaccaacaactatacacagtcttgacttaacacaaactatttcacctgctgtagggtgacaaatacaatttgaaattgagagaattaatattacccaaatataaatagtgttcttgtctaatgcctacatattaaatgtaattgattggttgatatgatttcagtggcttacgtttattatctgttagttggtggcgtaatttgaatctggagatccttattcttaacctactatttccactctactatgtatgtgattttcacctattgcggttcaattttccaatcttattgaaaaattcaattcattttttcttttttttttgagacagagtcttgctctgtcacccaggctggagtgcagtggtgcaatcttggctcagggcaacctctgcatcctgagttcaagtgattctcctgcctcggcctcctgagtggctgggactacaggcgcctgccaccatgcctaatttttgtatttttagtagagatggggtttcaccatgttggctaggctggtcttgaactcttgacctcaggtgatctgcccaccttgacctcccaaagtgctgggattacaggcgtgagccactgcacgcacagccctcaattcatttcgactgactatttatgactgtgataaccataaaatggttaaacagatacttggctttcatggtattatactacttaaagtgaattccttttattaaaaaatttagacaaaacaatcaagtaattttcaaataataacaaagtatgaactactttcatttgaacttctccttagaatgattaaaaaatttttaaatcagtgctgggcatggtggctcacacctataatctcagcactttgggaggctgaggtgggagggttgcttgagcccaggagttcaagatcagccagggcaacacagtgagaccctgtctcttgaaattttttttttttaaatcggaactgattgtttgcaaaaaccagaattaatatattacagttgaaaattcatcttactttcgatctttacatttattaaaagatgtaaaggatcacattctgtgatcacaatctctgaaatctttgctttttaagtttttcagcatattttaaaggccaaaagcagtataatcttgatgtggactatgtctctaaatcaccaagtatctcatttgcatcttgattggtaatatcaaaaatttttttttaaagacatgagatatcttacttccacattgatgatttcatattcttcttgtggctgtgtttctaattttgttctcactttttcaaatgcatccatgttttctggaaggggtttttcgttttcttgtttaacaggctgaagatcctggaaaaagttttgttatgatcaaaatatttcaaactagggaaaaaaaacttttgctttttaaagataagtaggtctataccgtagacttaacgttgtacaaaaaagaaataagattaaatagtaggtatttcacagattgtaaatgttctttcctaggctcatcaataaaatgatctttttcgttaaaaaaagtaaacaaagtaagatagacatttgatggttatactattattttagatgaataagtccttaagaagcaggaatactaagaagctcagaagaatgttcagaaatactatggggaaaatttatacacaattaaggagaaaataaaattccatgaacttttacatatttaataggaaaatcaggtagagaaaaaaatctttcgcgtttaggaagtactgaagtacttcctaaaagaagggaaatatcaaagaagtggaagacattatcactactaataaatgttcactattattttattcacagccagagtgataagaaatatttccctacttcattaactataattttttactttttaaattttttaaatttaaatgggtctgagaaccaagggatataattttcttttcttgtgggaataactaagccccaaaacagaactgtttatcacatcaaaaagtaaactggcgaggcgcagtggctcatgcctgtaaccccagcattttgggaggccaaggagaatggatcacttgagcccaggagctcaagaccagcctgggcaacatagcgagaccccgtctctataaaaaaatacaaaaaaatttagccaggtgtggtggcacacacctgtagtcccagctacttgggaagctgaggtgggagggatcacctgagcccaggaggttgaggctgcagtgaagcatgatcatgccattgcactccagcatgcagagtgagaccctgtctcaacaacaacaaaaaaaagggaattaatgcctaatgaaacagagcttctttttcagtttctttgaggaaaaataacatgttcactttatgaaaggaagaaccaggaaaaataatagaaaataatgaacatgagtggagatatagatgaaagctaaataagcattcactgtgtcttatcaagagtgactaataagctgacagctttatttgagttctggtaagcaaattaatatcatataaatcattacaatttggataaagcaaaacctgttatcaaatttaaaaactgtttaataattcaacactccagtggtttgccttgtttaagcaaaaggattctggccaagatattttacttcagctctctgccaaagatgacaattgtacagtgatttgtaccagaggggggacttaagtctttggtaaggatcgccaacagctggaaagtatttattgcataaaatatgtccatgatactttaccaacattgtagagaatgtaagctataaatacagtttatattacaaagagtttacaatctaaaattaaacacaagaatataacggaaaaatcaccaaaacaaattaaatggaaaataatcattttcacaaaggttttccttttagatttttttgggacacattattatttgaattagattaaaattagcaataatggttgttatgatagtctcaatcatttagcctctacttactatcatataattttctgaattttttttaagagacagggtctcactatgttgcccaggctggactcaaactcctgggctcaagcaatcttcctgcctcagcctcccaagtagatgggactatagataggtgtgtgcctcctcattccatacagttaattttttgagtaattatttgaagatcaaatactggaggcttatatatttatttttcattcatttttaaagcatttctacaaaatctacagttgatctttaaagtggtgagacatgatatctgtatcaataatcccctcatatcaccatcataagtcagaagatgactaaaaatctattctgaaactgtaaaatagcaataggagctgcctttgcatttctagattcaggattgtctgttctgtaatttccattaaaacttttgaagtagagtcaggattatctctctactaccctgtagcttctagcacattctaggtcatggagctgggttctgtcacttttaaatactcattcttactgagagtcatagccaacacagagccaaaagcaacagagcgggctccaaaactcatcttcttaactttacattccttcctgattaacattttttctgtcatatatccaaataaactgagcttatctgaaccaaaataactctgaaagcaataggatttttgactcccttaacgaaattcaagcagaactcaacagctttctaagtaactcttctaaaggaattactcccatggaaactgaggttttatataatattcattaagtactccaggttacttttggtttttgttgcgtcccagggatacctgctcagtgttttaagctttcatttcaatttcagctagcaatatcattagcgtacacagctaaagccatccattttagccaggtatcttagtccagttgtttcaaaggcatatactacccaatggagctgaggtaaggatggctttaccttcagattttgagaaggttactggtacagtatcactccattagtggtaaaaagaagcactccttcccactccccaagtgacccaccactaaatcattttaacaatgaaagctgttataaaatagaaggagaatgatatgtgttaactttatcatggcaaagatgctgaactctaaagatagaaaaaatggtgaagtagaaagacaccggacagcccttcagtcaagactaattagccattagtaaatggctaattctaaggctagagcagggagaaaatacatggtaggtttgggaaatcttatgccagaaaataaggaagtgctcaaagtttaatggagacatgtcaaaagaatacaagtgtcaactgaaggggtttctacaggccacattttggacaactggagcctcaaaaagaataataaataataaataatacattgaaaaaacataaatccacagcaattgaaaaacagaatgcaatatgaagcatttcaatttaggaaaacagaaaaagagtaagtcttaaggaagtagaagaaaggtaagaaaattaatttttgaaattaaattgataacaaagaaactaaagagaatcaaattaaaagttggttcttttagaaacctattaaaaaacaaacatcacaaaactgatagaaaaaagaatacgaggccgggcgcggtggctcacgcctgtaatctcggcacttcgggaggccaaggcgggtggatcacgaggtcaagaaaaaagaatacgaggagagaaaaaggcataattacagatacaacagagatttttaaaaattacaataagctttatgtgaatctatttgaaaataaatgaaatgggtaattttccaggaagaaaaattaccaaaattgacccaagaaatagaaaagctatataagtcactaactcttaaagaaattaaattgctaactaaatgtccccttcttgaaagaaacaccaagcccagatgctttcaaatgtagctttcttggatcttcaagaaacagctaatcttttcatacgtcaactatttaaaaaaatagtaaaagaggtaaaactactcattttattaggctaatataaccttgacatcaaaattagacaatgatgatatgagacaattaaaaaaatcaatcttattctaaaataaaacttgataaaatcaaatttttaattttaaaaagcacaaaataagaacagtaatagtaataccaattaaacttaatgtgaccaagaaggattttttcctaagaatgaaaggatggtccaacatcagaaaaaaatctatcaatgtaatctaacacaaataaaggagataaatcttagagccatttttgataaatgcagggaaaaaataaaaaataatcacactttaaaaaaatgataaaaccttaaattaggaatagagaggaacttccttaatagtttctgtcagttatcttacacagaaatatactaaatctgtaatcaaaatacctgaaattaattcatattagcatatacatggtatttagcaaccatgaaacaccaatgagatttccaaaattttaataatgttcatgtaaaacaactaattgtatttgctgttaactcattttattttttaaaagcaactgttaaatgaaggaaacttgttcctttcatcttctgcctccaattcttctccttaccccttctctagagcccagacttttgctcttcttatgccactgactgctcctgtcaaggtcactcaatggctaccacattgcaaagtgcaaaagttaatgttcagtattcatattacttgacctgtcaggatcatgatacaattgatcacttcctcctcctaaaaacacttttctttacttggcttccaggacacctcattctccttgttttcctcttacttcactggcccttccttctcagtatctttagctagttccttctcaactccctggctttttttttgtttgagatgggatttcggctccctgcaacctctgcctcctgggttcaagcgattctcctgcctccgcctcctgagtagctgggattacaggcacttgctcaccacgctggctaatttttttttttttttttgtatttttagtagagatggggtttcaccatattggctaggctggtctgaaactcctgacctcaggtgaaccacccgcctcagcctcccgaagtgctgggattacaggcgtgagccactgggcctggcatctccctggctttttaacactggcagagctcaattcctgcactaagtacttctcttctttgcagtctgcactaattcccttggtgatctcatccagtcatgaccttaaataccatttatatgctaaggactcccaaatttacagctgtagcctgaacaatcctgaccaagatgaacttgtatatccaactgactacccaacatttttacttagatgtctaatatgccaaaaaatgtccgaatctgaactttaaatctccccatatatccctcgccctattaaaaaaaaaaaaaacaaaaccctgttctccaggcaatctttccaatttacataaatgacaaatctgtcctcccagctactcaggcttaaaaacattacagttggatttgtctttttctcttgccacaaacaactggtctgctaaatcctctcaattctactttcaacatatatttagaatctgaccacttctcacacttggactggactacttggctagtatcatcatcatttctcccttggattactgcaaaagcccaaaagctttctctgcttctgcgcttgcctcctggtctattttcaacaaaggagcttgtgtgagtctgaagtcagattatgttactccactcaaaaccctccagtggtttcccatcttgctcaagaggaaaagcaaaaattcttacaatggtctacaaagtcctaaagaatcttgtcccattacattgctgacctaatctactgctacacgccaagcccacttattccagttaatccatacttgatgtttcttgaacatatcaagcttgctcccatatcagtttcttagaacttgggccctatgcccaaatacctccttaaagctattgctcaaatgtcatcttctaagttaggcctttcctaaccattttactaaaataacacccctccctatccccacactgcctattcacatcttccccgtcttttttttcttttcttcttcgccataactatcgcttttgacccactttgtatttcattcatgtaattctttttatttttttgagagatgaggacttgcttgtgtccacctcagctggagtgcagtggcatgatctcggctcattgcaacctctgcctcctgggctcaagcaattgatccttgatctcagctctcaagtagctgagactacaggcgccaccatgcccagctaatttttgcattgtttgtagagacagggttttgccatgttgcccaggctgttcttgaacttctgggctcaagcaatgagcccacctcagcctcccaaagtatattacaggcatgacccattgcacctagccttgttcatgtaattctttattctttctcttttcctttctcaagtaggatggtaagcttcacaaaggcagggatttttgtttattttgttcagtgttatatctccagtgcctagaatggtgcatagcaggtgttcaacaaatatttgctgagttgaataaaattcagacagcataaaacataaaatgaaaaaaacatatttaacaaaagatatcacaaagtgaaaaaaataataatagaacaaatatggagaagatatctacagcacatataaaagacaaaggacacgtaaagaaatcttatgaatcagtaagaaaaggacagacaattaaaagaaggtcaaaagacaagaataggcattcaagaagaaaaactataggatcaataagtgtaagaaaagatgctcactggccatgagtggcagctcatgcctgtaatcccagcactttgggaagctgagacaggaggattgcttgagcccaagagcttcagaccagcctgggcaacatagcaagactctgtctctatttaaaaaagttttggattttggagcatttcagattttgtattagggatggtctacctgtactacaagatattaaaaaagaaaggtactgtgaatgaggctaacttaggtctacttctgactctactagttttcttacttaactttaggctctgtggctttagtttcttcatttgtttagaaagaatacacacgcttcctgattttaagacttattacaggccaggcgcagtggctcatgcctgtaatcccagcactttgggaggccaagttgggcagatcaccctgaggtcaggagtttgagaccagcctggccaacatggtgaaaccctgtctctactaaaaataaaaaaaaaattagctgggcatggtggcaggcacctgtaatcccagctactcggggggccttggcaggagaattgtttgaatctgggaggcagaggttgcagtgagctgagatggcaccactgcactccaacctgggcgacagagcgagactccatctcaaaaaataaataaataaataaataaaacttattacaaagctatagtaattaaatgtgtagtactggcataacgacagacatatacaaaaatgagatgaaagtgagagtcaagaataaaccattgaatttatggtcagttgattttcagaaaggacaccaagacaattcaatggaaaaagaacactcttttcaacaaatgttgctcagacaatggatatccacaagcaaaataataaagttgtaccccaatcccttgcactataaacaaaatgaactcaaaatgggtcatagggctgggcatggtgggtcacacatgtaatgccagcactctgggaggctgaggcaggaggattacttgagcttaggagtttgagacaagcccgcacaacaaagtgagaccctgtctccacacacacaaaaaatcaaaaaattagctgggcatagttgtgggcccagctacttgcaaggtaaggcaggaagacagcacgagcccaggaggttgaggctgcagtaagccatgtttgtgcctctgcactccagcctgagcaacagagtgaggccctctctcaacaacaacaacaacaaaaaaagtatcaaagacctaaagaaagagctcagatgggatgatttctggggtatgttttctagcaataaaatttatggttatatgaaaagaaaaaatgcattaatttaactattaattcattctataaacacgttgcttatctacaatgtggcagtcgttatgctatgtgctggcaagatgtgtattataaaattcttgtctttaaggacctcccaatataatggggagacaggaaaagtttaaaatgatgtagtaatagcagagaggtaaatatagtgatttgactcctatggcttcaactactatctacatgtaacaactctccccaaattccagactcatatatccaactgctactgaaatctccactttactagtgagttatatttatcctttcctcctctcttttttttttttgagatggagcctcgctcccatcacaccaggctggagtgcagtggcacgatctcagatcactgcaatctccacctcccgggttcaagtgattctccttcctcagcgtcccgagtagctgggattacaggcatgcgccaccaggcccggctaaaatttttggattttcagtagcaatggggttctgccatgttggtcaggctggtcttgaacttctgacctcaggcaatccacccgcctcagcctcccaaagtgctaggattataggcgtgaggcgccacgcccggccttcttcacccttaagatctgaatatcagtaagattacatacatgactgtgaaataagtccatctgaaacataaagataaaccaggtacgttttagaattttgagattttggaatgttaactgggtaccttatctcagtttacaggggaacaacactctaatcaaatgcagtaacattttagagctaaacatctactaattgggataaagatcataatagctttgtgtcagtttaggtcaggttttgcccattctcaacagcctccaatcagttaaaaaaaatcatttgttttctaacaggcttttggattttagaatccaaagagatgaggaattatcactcaagctctctagtcttccattaagatgtctcaaataaaatgtaatcagggccagctgcggtggctcatgcctgtaatcccagcactttgagagggcaaggcaggtggattgcttgaggctgggcttccagaccagcctagccaacatggcgaaaccctgtctctacttaaaatataaaaaaattagctgggtgtggtggcacatgcctgtaattccagttactcaggaggctaaggcacgagaatcacttgagcctgggaggtggaggttgcagtgagcagagactgtgccactgcactacagactgggtgacagagtgagacactgtctcaaaaaaaagcaatcaccctgtaaagactctcatcttcactcatctgagttactgacaaggcttcctacttccaatttattctctattctgtcagagtgattcttctaaaatgcaaatctgattgcgcctacatttttcaataacattctattgcttaaaaggatgtagctcaaactttttgcaagatatacaaaactacatattatatatatatatatatatatatatatacacacacacacacatatgaatatgagactattgcaggagctgctaacctgtattgtagaaataggcaaatgacatgtttaaccaaaggatttagtcttctctctttaattatacaatttcattttgtatcttgttcaaattatcactattaaagattttgggaattattttttaggcagagcagagcaggatgatgtggaagataaagaaatgtgatatctggatggatggatgctagtctttgaatatcactggctggcttgtaagtataatagagtaagttcatcttgccatctggctaatgtaaaatggaaagcagaggtacttgccaataagaactgcagaactgaatgaattcaataaggtttagatcggcaacacttgatcatcaaacatttccaatttctaaattcaggtccagtgtcagtcaagttgtgagttccagaattacctgatgtgaacttcaaaaaacagatctggggccgggcatggtggctcactcctgtaatcccagcactttgggaggccgaggcaggtggatcacctgaagtcaggagttcgagaccagcctgaccaacgtggtgaaaccctgtctctactaaaaaatacaaaaaaatttagctgggcatggtggtggacgcctgtaatcccagctacttggcagctgaggcaggagaattgcctgaatctgggaggtggaggttgcagtgagccaagatcatgccattgcactccggcctgggcaacaaagcaagactccgtctcaaacaaacaaacaaacaaacaaacaacagatgtgtaggcctcaaccatagagattttcattacgcagatgtggggtgagatccaggaatccgcatttctaaaaagctctccaggatttctgatatacagttagactgcagaagttgatactgaagagtccccaaacttttaggcagtaatttgttgctaaggtaacaagaggtatagaatcatgaaattttagcacctctaagactttctacagaatgacaagttgaaactccctatttttttttttttgagacagggtatccttctgtcacccaggctgaagatctcactgtgcctcaacctcactgcagcctcgacctcccaggctgaatcaatcatcccacatcagccttccaagcagctgggattacaggcgtgcgccaccatacccagctaatttttagtctttttggtagagttggggttttgccatgttgccaaggctggtctcgaattcctgagctcggacaatctgctcgccttggcctcccaatgttctgggattactggcgtgagccagtatgcctgatcagaactccctatttttttcagtcaggaaaattaggagtcctgattagttcagtcacaccaatcgtggctggatcttttgccttctaacattcccactacacatgctacttttctgttccttagttaacttatataggtaatagctctttaagcagacattttaatttacctaaaagcagtaactactttttctactttattacaccctataaaagtggacagagttggaaatcagtggatgcttgctgaaagaaggaaatgtgcattcttctctacaggtgttttcacagctgccggggcatctttataaagcttccccaggtctcagtgataaagaccatggcttttacattacatcatttctcatagagggaatggttgatacatgacatgtgacagcaggattactttatcaggtaaaggaattactaaatgaactattaatacttggagttattgagtcaggttaaagtttccaggtagtgggaatctataaaagagaacggaaaagttgcttcaggaacaaatggagggaagaaatagtcaaccttctgtttagaatgtgagctaatatcacagctgttactctgatggtaattcctgtctactatttataaactaagtgttaagacaaagtacgacatgacaaaatgttctaaacacaatgcaaaataaaataacctaaaggtccaaaatttagttcaataggtgaaattaaaaattttatctttctgaagtaggaaagatgtacaaaaaacacaaaaatgaaataaaaagaagttataaagaatttctaaatgagtaaagaaagtactaaactaaggcaagacactacaaaaaggaaaagaatttcaaagactaaaacataaacagtaaaagtctaggaagactagggggctaacatataaaatgttaaaagcaaaagagacacacacaacacctaaataggtatcagctaagatagcggcaaaaattgaacaaaaactagaaaaactgagaaaaattagattgaaaagatagtttctaaaatgagaagaatctgcccaagtgtccatcaattacaggaatggataaacaaaatgtggtttatacatacaaaggaatattattcaactataaaaagaaatgaagttatgatacatgcatacaacacagatgaactttgaaagccactgaattgcatactttaaaatggatcaagtggaaaactttgttatacatatattttacccgaagaaaggaggaagccaaaacagactaaaagaaaaatcagtatgcgacaaaaccagaaattaaaataaaaaaaatattaaaatcataaatttgtgaaactattgcaagaataccacccccaaatatcattaaggaacctaaggaacataagaagtaaaaggtaggagagggatgtcaaagcagcagcagcacaaatagatcatttaatcctacttactgtaggatgaccatataatttaccattctaaccaggacacttttgagaggaaaggggacactattaataattacacagggacaacaggtgtaggctggagctgtgccaggcaaaagtggttatgtggttactctctatataagggcaatcaggtccttaaggttgagttcacgcccacagcttggggtctggcagaagtacaatactctgacagtgtcttcctgaatgactcaagtggtcaaaaacgcaagattatttttcatttttttacagagaaataaaatacaattcatggcctttactgaagtttactgatttgtgattcataaaacaattagcgtatcattagattttattaagagctataatttagtgttctaggaaatttagaaggccgaattatactttgaaatgcactggcaggcatactaaggaagtcctgaggtgaatcattttttataaacctacatttttatatattacattagagccctataaatatatgtatacactttttttttttttttttttttcagacagagtctccctgtcacccaggctggagtgctgtggtgcgatctcagctcaccgcaacctctgcctcctgggttcaagagattctctgcctcagcctcccaagtagctgggattacaggtgggtgccatgacgcctagctaacttttgtatttttagtagagacagggttttaccatgttggccaggctggtctcgaactcctgacctcaggtgatctgcctgcctcgatgtatatactcttttatacttacttttgactagagacaattgagacttgaaaattagaaaaatcaagttagaattactgagaaaattagtagctctgatattctacccattctttatttttaaattaaaattaatcttaatgacctacaaataggttaacttaaacagtccataccttacatgagaagctccgacttgggatgtttcttgctaactctgatatcttgggtttattctgaagacacttggttaggtgatattttttcaattttattctattgtaacaatgatcagcgaagttatagtgattcaaatgctgtttctgcatgcattttccaaggtgaggaatactatacttcaaagcttggagaaataatttggtcttctgctgcatgatatcaaagtccctggtttatgctccttttggggctgccagcacacgaatgattttataggtatgattacagagtagtgggttctcagagtaactaagatcagcagttctcatccctccttttcagggccatgccccacttaggttatgaataacttcagacagctgataacttaggctaactaaatctaaaaacctgtgtaagttaaagtttcattcaaatcataattcttggcagatgtgacttaaatgtctcatttgtaaagttaatcctatcaggctcaaactatgcagcactgactctggcacacataggggttaaactaaaacaaaaaacaaaacaagaaacaaaatataaatttgcaaataagtacacagacttaatggggtatctcaggaactcagggctgtaaaaggtaaaaagccctttggtcttacataattatgaacgtatctttggtatatatgtggaagataaactggaaaagcctaattatttaataaaggtgggggagggaagattaattattgttgagtgttaactaactgccaggtgcttttatcttgtttgtctaatttaaattttatatggacttaataaagtagatattaccatgcacattttacaggttgccaaactgtggctgtgggaggttctaagcaactgttccaggtcacttgtacagtaagctgtatagcaaaaaatccaatttggttcggttccaaatactggacatactcaacttcggatttttaatgttaaaaaggtatttagcgctttaattaaaaacaacaaaaaacccctgcaagatgcacaaataaaatgtaaggccatctctggtttgtcaggaggtagcttttattaaccttgattgctaataagtagttaagagtcagagagacctgggttgaggtcttagctcctacacttaactgtgtctccgggcctcagtttcttcatctgcaaaaatgaaatgacaccatttaccttctagggttgttgttgtaaagacaaaatgagacagcttaacattaagaccatacagtgcctggcacatagtgaccactcaataaatggcagttgctattatttacgacaggaataatctaggtatgttgcacaccgctgaatgtcattatggaagtcttccacaaaatgccccctggtatcaaaggtagaatgctgcgtcaaatttaccatagatcagatgcgctacgacgcccccgccccccttaatccctttccatgtcgcagcaaaataatgggcgattgggggtaggggagcaacactagtttactagccgacactagtaaaaaaaggggaaaaaagacccgaataacaaggacctgcaaaggtcctacatcaccacgttcccacagcctttatccatccatctttcatccccaagaagacagtatgcaaggctaggatgggggtggggtagataaatgggtgttctcaggagaacctattcgtttaccccgtgcaactctccaccccagggatgaggcgatctgaatgcaacagggagagggaccaggtgacacgcacgcagtgccgggacattagtcaaaaagcgaggacctggggactgaggggtgggtggctgggcggggggagaaaggggagaaggaaagagaccagcacaccccccatacatacgcaaattgagagaatcagtccggctctggacacaaaccagtgaaggcaggccggagaacctgaagctctcagaggggagcaggtgtcaccgcaggcaagtccagccgaagtctgcgttccgcagcccacagaacgacaacttacccagagccgcctagagctggtttgcagcacgccaatctacgtaacctcaatctagcacgagcaacaggcagatttcgccatctttgttgtggtcaaggagtcttcttgggttcctgggttctttagtctcgaaatatataagacttttcgttcttcgctagtcttctgagctcgagatgaagcacagaaggctaaaacaatgagggacagcgttccagtagccctgccacagctctctcatcctctggtccgccctcactcaagatggctaccagcaagaatggtgcaatggcgtgacagctcggccctggttgccaaggagatgcgagtaccggaaat

SEQ ID NO: 853 - DNA, 42142 bp, Homo sapiens; identical to SEQ ID NO: 851

SEQ ID NO: 854 - DNA, 44255 bp, Homo sapiens; identical to SEQ ID NO: 852

SEQ ID NO: 855 - DNA, 43954 bp, Homo sapiens
tttcaagtggtcataattttaatggtaaaattaggacataaaaataattttcaaagaattattttcaaagaacactagacataaaatataacaattttcaaattttcaaagaatactagaagaaaaaaattatacagtcaatccaacaaaaagcttaatagaaaaaaaccctaaacaatagtataactacaaataaaatagggcttccgaattatgtctaaataatacaataattacaaatatgaatgggttaaattagcctattaaaagataaaaccactcagataacaaaaacagacataagaaacactaacataaaacacaaagaattaaaatgaagatatagcaagcaaataatagaaagcttgcaacccagctatagctataaacacaaaaaatgaagttatcttttgacctaataattccattcctaatacttagaaatatttgcacatgtgcacaataatacttaaaggatctcaacactgtttttttttttttttgagacagtcttgctccgtcacccatgctcgagtgcagtggcgtgatctcggcacactgcagcctctgcttcctgggttcaagtgattctcctgctgcagcctcccaagtagctgggattacaggtgcacgtcattatgcccgggtaatttctgtattttttagtagagatggtgtttcaccatgttggccaggctggtcttgaactcctgacctctggtgatctgtctgccttgcctcccaaagtgctaggattacgggcctgagccaccttgcctggcctgcaaaatttgtttttaatagaagacacaagaaatgatttaaatattttatcaacagaaaaccagttctatcaactatgggcccagtatgcagcttttaaaaatgacagttctatatacattgatatgagaccatttcaaacaggtattcaataaagtatagaatggtaacatatcaccaactgtgtaaagaaaaatatataaacatatgaaatgatacattctgtgcctatgcaaacatatgatacattaaaaacaaaagaacatatagtgcctgtctctgaggggaactgtgaagctatggaaaggtgttgaagaaaacctttttatagtatgtattcttgtaattgaataaaaaataaaattacaaaaatcaggcttggaagtatttaatagcagacaaaatatagttcaatatgaaaagcattatatgagacaaaggcaattttcaaaaattgataaaacattccaccaaaaatcatgactacgcatctaacagcttcaaaatatagaaaatactcaaatgcaaaatcaacaaatctgcaattacagaaaaagacttcaacatacttttagaaagtagtaactcaagtagacaataatagctaacacttaccgggcacttcttatgtgagtggcactgaaacatgtgctttcatgcattacctaaggctagagaaaatgttaataacttagacaagtcatacatgtatcataaatatctttgtacctgacaaacagaataaacatctttttaaacaccattagataattatttaaagaccacatattgggaacctacccctaaagaacaataacaaccacaataacaactatcaccccagtaaacatggctggcaagaatacaattaaatgaacattatcactgatttggcaacagctcttatgaagaataatttggcattatgtatcaagtgcccatactctttgacaaagtaactgtctttctgataatctatcttaagtaatacaaaaatggggggaggggaataaaaatacaaaatattagaaacactatcgtcaaaatgaaagggcatggctgagtatggtacaaccgttcaacagaatattgtcattaaaaacatttatggaggctatattatatagtcaataacagaaaatgcttgaaaggttagaagtacatcatcaaattatgttttatatagctgtaaaataaacccaaatcatctttaatgaacacatactattatggtaaaaaaaagtctacaatttctaactttcaccttaggcagctttttattttgcatcctttttttcaactttgtcttctattagctgtgcaagaaatacatgtctgctaaagttacacgatcttcgcacaacagcaacctacacattagtctacaaaggggaacaaacccaaattcctcagaagtctgagtccactgttgccttctttctggccatctggcagttacaatatagcacagaatgactatgcaagttaaatattcatcttagacatggacatttgctttgggactcctaaagtggagtcaaatttgatctctacagaaactctacaatgtagcagagcactgtgcgtacttattgactcccagacaagccgaaaccccgaatttgtcatttctatcagtttttatataaattgttcttacctacttattgatgcttacaatttggcaattataaggggcaaaattggagcaagtgttttgggtaaataactccttacaatatattaaaaatacttacaaacaattcttagaatcaaacacttacgtaaatacttttttaaaaaaataggtccaaaagactcagcccagatcggctttgaagttatatcaagatttaagtctacttcatgccaatgagctactcctcaacaggggctggttttgccatttgaggaatgacagccactatgttgtgtacacaagagagctggatggcatcgacagaatctttatcgtggttctgaattttggagaatcaacactgttaaatctacataatatgatttcgggccttcccgctaaaatgagaataaggttaagtaccaattctgccgacaaaggcagtaaagttgatacaagtggcatttttctggacaagggagagggactcatctttgaacacaacacgaagaatctccttcatcgccaaacagctttcagagatagatgctttgtttccaatcgagcatgctattccagtgtactgaacatactgtatacctcgtgttaggcacctttatgaagagatgaagacactggcatttcagtgggattgtaagcatttgtaatagcttcatgtacagcatgctgcttggtgaacaatcattaattcttcgatatttctgtagcttgaatgtaactgctttaagaaaggttctcaaatgttttgaaaaaaataaaatgtttaaaagtaaattatggcttataggagcttataactttattcagatagcatcaatcagggatgaccagaacacattaggaccccagattattcaaaaactttaacgaattttaaggggaagaattttatcttttcccttaaaatgcagtcatagaaattagaggatgactcactgccacagtgtctaaaagcatttgctagcaaagaggcaggacactaatttgtaaactgctcaactgttctgactggaagggaggcctggagctctgctatcaccaatccttcccttccctctactccacatccttctaaggagcatgatttgaaaattactttcctaggttaatgggcatgtgcatcaatggagagaatagtataagcaagtgagatgtagactaagcaaaatttagatggagaagcacattttaaaaaattaataacttaaaagtctcaagttattaattttttttttgctaactcaattggaagtaagactatgaaatatttcagtgtgtttccaattcccagttgaatgcagtgtttcagaatttcaggtatttcttaagatcctcgaaaacactggtgctgtcaagtccaagttcctcgtacaggaatttaatttgggctgtaatctaaaagaaacacattaaaaaaattaaatagaaggcctttgtagtaaaatgccactgtttaagcttctctttatctatccatctttacctaaccgtgaagtcagcaatttatggcaagaatactttcattcgagagagaggcagaaggcttccaacaattaagattaaattattttctttaacagagctcacgtatcaagtacaagagagagacatttctcttgattgacacagtgtccctccctcccctcctgggtctcacccatagataggacatttgtgaagtggctttgtcataaacctgctgcaaccactgaaaatgtgaaaacaacatgtatctagttcgggaatctgtccactgagagggccttgataacatacctttttgtgagaatcctcaattacatgattgcctccaggctgaatatctagaataatattaggggtctgatagcctggaagagttaacatgtagaacaattagaagattgtatgggatcttctttggaagatcgagacccattcctcccctcttctttgagtactcagttcaaataatagtaaaggaataaaaagcaaaaaccaccatcatcaacaaaaagatgggaggggacaagcaacagaagacaaacttctgacacagcgaaagcaggaagaggccgtatggaaaagactatatggtgccacacggacaaggttgaaacccaggagatcatcaacctgccctgtggaatctgagagtcttatgccctggaaacaccaactacagcaatggatgggggtgacaaatggagatgaatacagggagactgatatggcatgtagtttcaaggcaaaagggagggattcttatctcataaagctgaaacagctagctagaggaaattcatgcagctaaacagtttgggcactgatggcccaaaacaaaaatctcagaatctgtcttttagagattcccaagaataacggctcaataaatattgttaaatgaattaataattgtatggcagtgcatctccaagttatatctgattcttaaatttcctgtttcctttgtgtcctgcctatctattttaatactgtcctttgaaaaagaggtgaggcagtgtatgtatagacatgtagttacgtacactttaactggggagtcaacatagcaaaataattgtttgccctaaatcctgggcagatgatttggctacagcctgaaatatattcctctgagcagtgtgctgtgggtagtagtctgtttggccatgttccctgcttctagggggtctcctaccttcacctgtgtccttagcatgctccgcgatggcttccttgagtttctcagtataacttacaattcctttcagaggtacccgttcatcgttttcatatgccgttatgtgaattgaaggataatgctgaaagaaaatacatgcacgaagagtttacattatttcttatggtcccttgccactatagagactatgaaaaataattacctccaatttttccctgtaagtgctctatgctttttctcacttgctatcttgagagcgcctcagtattacagtagtagactacttgttatctggaatagccttttcttgactaaaggaccttagctaatttagtaattaaggcatgataagtctattcccctgaggtattaaacatggagcatgagcagagatggtgctgaagatatttgggcatcataagtagaaacatctctaaagctcctatttttgcttcagcttggataagttttttttttattatcttctgtgtaaattcaggataatctaacacaattgtctttcactacctgaggtttaatattttgatagggacagtaacgttttatgtagttcttgtgtttttcatcagatgaaggattcccccattcttctaattcttctaatgtcagaggaagtgtagtgtccatcatggtgttgagaacatccaagaaaggtgcctaaaaaaaaggcaaagaaacttatacttcaagtaagaggttggtaagtgagtttcagaaaaacattctattttatgaatatacatactaatatgagagaaaataactcaagccatgtagattcctaggagctagaatactcagtccttaaccagggcctgtaatttataacctacttttaaagtcttcagattccttaaatgacatataacaagaaatggtttatcttctaatttcacaatatttatttttagcttagtaccttttattcatttatattttttcttatataaaagcaataaatgctactgtctcataccaattaggacagttagttattatattaaaacaacaacaacaacaacaagtattggcagtaatgtggagaaaccggaatcctgatacactggtggttggaatgtaaaatgggggagctgctttggaaaacagtatggtggttcatcaaagagttaagcttaagattaccatatgatccagcaattccactcctggcatataatccccaaaactgaaagcagggtcttaaagagatctgcatacctatgttcacagcagcatattcacaacagccaaaaggtggaagcaactcaagtgtccattaaccaaagaacgaataagcaaaatgtggtatacacatgcaatattacatggaatattattcagccttaaaaatgaataaaattctgatccacgctacaatatggatgaacctcaaggatataatctaagtgaaataagccagtcacaaaaaattttgtatgactccacctatgtgaggtgtttgagtagtcaaattcacagagacagaggctgtgggaagaagcaaatggagagctgtttaatcggtacagggtttcagttttgttaagatgaaaaacgagttctggagattgactgcataagcctatgagtgcacttaccactactgaactattcacttaaaaatggttgagatggtaaattttatggtattttaccataattaaaaatttttaaatgaaaaaaatacacaaggaataaagtctttttgaccagttggacattttatattaaaagcaaaaaacgctaagtaaagaaactctgcaaaatacccaaggtgaaagaagagaaaacaacccattggcttataattagtgttacaaaatttaataaaacgaaggctgggtcgcacatggtggctcatgcctgtaatcccagcacattgggaggctgaggtgggcaaatcacttgagcccaggagtttgaaactagcctgggtagcatggtaaaaccacatctctacaaaacaacaacaaaccacaaaaattagcagggcatggtggcacatgcctgtagtcccagatactcaggaggctgaggtgggaggatcacctgagccccagaggtcgaggctgtagtgagctgtgttcgtgtgccattgcattccagcctgggtgaaagagcaaaactctgactcaaaaaacaaaacaaaacaaaacaaaaaaacaaaaaccccacaaaaacaacaaaacaaaaatgaaggctgtatttttcacttagctttattttcttctgttaacatactttttagctttccctcatattaacattaaccaagtatagtgagtcatctgtaattctttttggctgcctaccatatgaacttttttgcatttgaaaaacctccaaccttatcagctagagcctgcctctcactgtggagatactaagtgctagacttctctttcccatttttccctgcagcttgggagtagctgtgtgacccatgtgtgacttgggtctatcaaccagacacatgtgctttacactctgcatggaaagttagtgattcaaagaagcagtgatcacagataatttattctggcaaaagtgccacagctatatccagctctagaagttgcactggcagtgtgaggtgatttgtgcttggcagtggcggcagtaatagtttcattgggccaattctatgcctttggctctgaagcctctaacactggtctgaagacacctacattttcctaatgccctttaatcccttttctgcttaaattagggttgatttttggtgcttataagaagaatttgacttatacatgtataaaaggttgtctcctagtcttcactataataagcaacctagcataaatatccttctcatcatttccttttaaatttctaaaagtcaaaatctagttgctttgtctttaaactgtaaataattctgccattatctttgtgcataggctattctccacatttttctgtttttaaaaaatagacttacaggtgactactatttaacacttatttacaagcccacagtataaactccccaacctcaaaataaaaaatcctgaaaataatttactctctcccatctcagtcattatttttcagagtaacctagaagtaggagaatgatagcagtgaaaccaactgctacaatgtaacttcgtaatttctgacactgggaaaagataatcattttcagaacagggtaagatatttcaattaaaatacggaaaaactatgcccaaacgaccattaagaatggactatctaaaaataaagagcctataaatctaggactgaaatgttgatgggcagtagcctgtcaaggtgaccaggagccaaaggactcagtgcattccagagtcacagcgtgctttgcctggctttctcaactgggactcatatatgcttcagtgctttttcaccaattctaaatgtccttacaaatacaaatgagcaatggaaatagccattaatatctttcagtggaaagccttaaagataataaagaacactgtatcagagaagaataacggttaatagttggattaaaataactttagaagttctcctcaagctataattctgagtttaaaacttaaaagctttgttatactcctatgctatggtaaaactgtaacagaaatgtttttctttccttttttttttttttttttgacaatgtctcactctgttgcccaggctggagcacagtggtccactgcagcctcaacctcttaagagatcctcttaccaacaagcctgggtaggtttttttttttttttaatttcttgcagagacagggtctcgccatgttgcccaggctggtctcgagctcctggtaagcaatctgcccacctcagtttcccgaagtgctgggattacaggcatgagccgctgtgccagcccaaaaacatttttcttagagtagcctatggcttcacacctcccccattctataaacagtagagacagagcgtactcacctccaaagtcaccgctctcaccagctctggattagaattacacaatgctcctgcaagcacccctccagcactgaaagcagtcagggttgttagacttggctgagaaaagccttggccatgaagcgtcttaatgcaagcctctaaatcagcaaggccattgagttttttagttaggcggccatcagcgtgccactggaggcctaactcaccaccacctctgaaattgaagggcaaaaaagttttagtggaaaaaaaaagttaatactgtaggctggggtcagcgaactacacctggaggcctgttttttgtgtggccctggagctaagactggtttttgctttttaaaggttgagtgaaaacaaggaatgtgcaacagaaactgtacgcggcctgcaaagcttaaaatgtgactatgtagctctttagagaaaaaggtttgccaactcctgatatagacaatccagaattgattcaacgaatatattttgagtgcctgcccatttatcagggattaagtacagaccttaaaagtagaaacaaacgaaaatcccctaccgtggagaagacagtaattttgtggggtaagaaaacaacgacttacccagcaatgtggtgtcattgctacaatacaagtgtatttaaggtattacaggagcagaggaaagaacatccatctgccaggtgaggggtatatacacgagtcaggaacacaaatgcttttaaggagatgatgcctaaactgagttgtgaaggaaaaatttgagtttccagagggcaaagaaaaggcattaagacacagatacgacacagcatgtataagggcaaggaggtgacagagcatgtcatttaaaagacatgactttgggggctggacacagtgcctcaagcctgtcatctcagcattttggtaggctgaggtgagcaggtcacttgaggtcaggagtttgagaccagactggccaacatggtgaaacccccgtctctcctaaaaatagaaaaaattagccaggtgtggtggtgcgtgcctataagcccaactactcgggaggctgaggcaagagaattacttgaacctgggaggcggaggttgcagtgagcggagattgcgccactgcactctagcctgggagacagagtgagactccatctcaaaaaaatacaaaacaaaataaaaaaaataaaaggacatgattttggaaggctgaggcgggcggactgcttgagctcaggagttcgagaccagcctgggcaacattggaaaaccctgtctctactaaaatacaaaaaaatcgggctggtacggtggctcatgcctgtaatcccagcactttgggaggctgaggcgggcggatcacttgaggtcaggagttcgagaccagcctggccaacatggtgaaaccccatcgctacaaaaatttcaaaaattagtcaggagttatggcaggcacctgtaatcccagctactcaggaggctgaggcaggagaatcgcttgaaccctggccaagatcatgccactgcacactccagcctgggcgacagagcaagattctatctcaaaaaaaaaaaaaaaaaaattcagacagtgtggtggtgtgcgcctgtagtcccagctactcaggagcctgaagcatgagaatcacttgaacctgggaggcagaggttgcagtgagccgagattgtgccactgcactccagcctgggcgacaaagcaaaactgtctcaaacaaaaaaaaaaaaaaaaaaaaaaaaagggtctgatgctaaatgccgctacagagatccatcagaccattaggagtattatactggggaatctggactgtgttctagagatggggaggtggagaagaattttaagcagaaatacaaaataatatttgtgtcttgaaaacagctgaaataaaatggaagttaaatggaaaacagttcagattcagaggctacttaaacctgaattcaggagaactgaaaggaaataataatattactaaataagtacagagtctggtacctctatgcaaaaatcctaaaaacctatccttttgctttttggatcaactaatctgttaaagaatcaagtttcaccagtgctggtttaggaatacaaaaattgaataataagaatgaaaaaaataagcttttgttccctgatatatattgttattcttgacatctctcacaatggtctagcacttacatgccaggtaaaatatactgactcaccgaacatggcagtatgctaatatccatccatcatccaccaggacccgcctctcaggcctgaaattcattttcaaatccattccataagctccatatacatgtaccaagagaggtttcttctgcaagtcctcagagtcagttttgtggaaaacagtcattggcactaattttccatcctagaaatgaagaattactatgtatgtaaagaagagtcttttataataactgttttatcccaatttaaaatacattgaggtgcactgtccccacttgtgtgctacctactgatgttgagcacaaatttgtttaagaaaaagaattatggtctctaaaaataaatcatggcttttggtttcagctaccttgctgtcctacagtattaaccagaaaagagcagcaagactggcctgaaaacattttattaaatgcagcttttcatgacaataatgtaattttaaagagttcttcactacctactataattttaaattttcagatgaaaccaaaatacttaccaaggttagaagtcctagtatagcactcttcctatgcctaagagctagatattggcatttttcacttttgagtatctacaaatatgctgactaaagtcttaccagctcaattttctatatcctctgtagtcggaattctcaaccattaagacctgaaatcttactgatgttactgataactaccacaatcctcttcaaaggcccatttaactttattaaaaaaaatttaaagtggtcttaaaatttttcggtaaaattctttgtagggttaaagtaagttaaattatttgtaaggttactaagttacttgtaggttatgtaaccatcccccaatgtagctcaaactcatcagttccagttgattgaaactaggcagtctctgaacagacaaaagaactaattctgatctacctttcacacaaaaaagataaagaaattggttttcaccctgcttaaactaatgaaatagcaccgtttacataaagaaaataaataatacatccaagtcactcttcatattttcattctcattttgaaaacttcactttggggcaataactggagacagcaaaatgtaatcaaataaggaggaaattctcctctcattcttctttaaaatacccaagttgttatgacattgttaactttcacttttagtaagattcacttttataaaacttgatgtagattaatttctataaaacactcttggtcttttcacttcccaactcttccccaacttcaattatacaatcagaaaaagttgcttgttgaaaagttttgaaaggaagaggtaaaacagtagctactcctgtgatgggctggatctgggtttgccagcagtactaaaatgcctgtggaaaggtatagcgcttccattcagcagctgcttcccttctcccctcttggctctccaagaacatggtgcttaactgttctttccatctcgggtccaataattgcaacattttgatagactagtctaattccatgtttgtaaaaccaaataaaacctatctaaaagataatacactaagtgggtaacaatgattatttctaagaggtgcagcaagcaaatggtactgagaagtagtcatttaagatttgttctgtatttttgcatctgttcaacaagcatgtattgcttttgtaatataaaaatattaatatttacttaaagattgtcagagaaaaataaatgaattaaagaaaaaaattcctaagaataaaaggcttgtgttgtaattcattgtgtcagcacatgtgaaattatctgatatatgatatgctaaagtctgaggtttccttaaattcaaggctatagtttacatattaatttgttccctacttgcataaatttgtatattctgtatattgagtatacctggaatatggatatttgttatttccttttctgtgtctcatctctctctactcctcaccctgccaatcttccctcttttacttgattttggccataatggcctcctttatatttgttctttttctgagacaggatcttactctgtcacacaggctggaatgcaatggcgcaatcacaactcactgcagcctcaacctcctgggctcaagcaatcctcccacatcaggttcccaagaagcagggactacaagcatatgccaccatgcctggctaatatttttggtttttgtagagatgaggtctcactatattgcccaggttggtttctaacttctgggctcaagtgatcctcccagcttggcctcccaaagtgttgggattacaagtttgagccactgtgcctagccctacacttcttctgtaggctggagagcagtggtgaggtcttggctcactgcaacctctgcctcctgggttcaaaggattctcctgcctcagcctcctgagtagctgacattacaggcacctgccaccacacccggctaattttttgtatttttagtagagatggggtttcaccatattggccaggctggtctcgacctcgtgatctgcccgcctcagcctcccaaagtgctgggattataggtgtgagccactgtgcccggccagccctacacttcttgaattgtataatttctccccaaattcagggcctctatacaaaatggaatcccctatctcctttctagtttactcttaatcatcctagtggtcttacctgagacataacttccttggagaaaacttccctgatctctctagactaggtaaaatccctttgctctatgctcccactgtactcagtatgtcctcctttgcagcagtcagtacattattaatgactttttaaacatgtcatctttcctgctagatgtatgctccatgagggcagggactgtatcagtctagtttactctagtcaactaccaccttcactatttttgccataactacataccaactctattaattttttcttaaaatcaactttaaaaaatcagacataaacaacatgtaaaataaaaagtttgacatgctataaattttcttttttttttttttttttgagacggagtcttgctctgtagcccaggctggagtgcagtggcacgatctaggctcactgcatgctccgcctcctgggttcacgccattctcctgcctcagcctcccaagtagctgggactacaggcgcccgccaccatgcccagctaattttgtgtatttttagtagagatggggtttcaccgtgttagccaggatggtctcgatctcctgacctcgtgatccacccgcctcggcctcccaaagtgctgggattacaggcgtgagccaccgtgcccggccgacatgctataaattttctaatccatgttaaaacaaacatgaatattaaggttaaaaaaaattcacctatccctaaagtcacttgggtattactgtggtctaagaaatctacattaggaaaccgtgctaatgtaactccaacaactgcatggcatctggcaaacggtatgctttcagtaaatgggagctgaaagtgaagattataagacctaccttgcttttggcttctagacgtaaaacgcgactagtctttgtgattgggtcttcatgcccagtttcctcaaacagtttgccttctgcaaacttgtatgtgtaatattttgggggacgtattggagagcaaagttgaaaggggcagttctttgggtcagaatttgtatccattatgaatccacaggcccaaggagggagctaaagaaatacaacagctatttttattctttatttaggccaccaagtatcattaattaaatttctaagtcttctccaaacaagatgatgtggatatctcgtttactttttgttaccacgtcatgcctcattcaaggattactttatcacaacaacatacatttcaaataaaaaacaaaactgtacattaatgaccaataaaataagacaaactataggaaaatgatttatcatgattctagctttacatgaaattgcctttaacataaaagtttattttggggtataatcttggataataaaatagtaaaatggaagaataagagcaaatcaaatagtaattccagaacccaccgacactgccaagatctctgttctcaaagaacgtgaaattcctcacatgcgtgtgtttttcataatttacccactagtccttaccctgctgcctggacagccacagtgatgacagttattatttcagggctataaacgggctcagcagcattaaggcatttgcaatttgtttctaacttttagctcctaggctaaccattgtgcagaacaaaacctcttctggcacatctactctgagagactcacagctattatactcaaggttcttaactttaagaaaaaaggaaaggaatcaaaatttattctctcagagcagcagggtccagcttcaagccttgcactaacatccctcttacaccttttaaagaactctggtaagcaggttgacagagcgttagaaatggtaccgagaggcagaacattaaaagaaaattgcctttcttttcctgagtaattgtagaaagagcaaattccttagaaaatcagaggcacagaaacatcactggtgggcactattgaaaaagggcagccggggatttgtgcgtaaaggggataccattccacctgcagcaactacagccagagtttacgttctctgagcaaatctcttattaataaaaaaaaaaaatctattttcatgaaacactagtaaggacacacatctgcaatctctaaaagctcctaatgtatgcttctcacattgagggttgttttaaaggataacttgtctatttaaatttaagccataactggagagtaaaatgtaaacaaaaattgagaaatctggtagcatagttataagcaagcaaactgagacttgagaggggaaaaaaaggaagcactgctacaaacctcataaccaggcctcagagcgagggtacaaggttccttagcccatggaagctcaagtttttctgccctttgatgagacttcaggacagtctctatgtgacccacgcagtaagctgtcttagctttagaccaagtggttccaataaatcaaaaagtatttttggtgtttttctaaaactaatgggaccaacattaatgttttaatcataataaaaactgtttcaaggctatggacttttagaagttcatccagctaatgcagatataagtattaactaactcaaggatatcttaagccacatttcctattcagataagcctgcagtgtatctgtgtatattaatggacagcaccagagagtaagtaggccaggagatagggagacattccttagatacctgagagaaacaggttcagttttagcactctaccagcaaactatagttatttcatcaaaagaataagacatacatgccgaaagaaaattggcctgaatatgcagactcctcctctaaataaaactgatgttagcatacagcaaaaaacgtcccaactggcctaaattaaatatcataacttctttttgtgacaaaaaaaaatacttccagaaaatactgatggcatggtgaccaaggatacgaggcaaatatgtgaagggttttacatttctgttgctaagatagaatttatttatttatttagagacggagtcttgctcttgcacccaggctggaatgcagtggcgtgatctcggctcactgcagcctccagctctcggcttcaagtgactctcctgcctcagcctccagaatagctcggactataggcacctgccaccacgcctggctagtttttgtatttttagtattctttgtattttatattttttgtatttttagtagagacagggttttgccatgttggccagggtggtcttgaactcctgacctcaggtgatccgcctgccttggtctcccaaagtgctgggattacaggctgagattgaatttaaaaagatcttttaatcaagtgcccaccaggcagagatactgcataaagaaatattttataatgcactcacgctatggttaaagattttgtctttcgtgtatggatggcactgtctatgtatattaattaatattattcaggctcataaaaagggtctgatctataaaattctctttattatataccaggtactaaccagaaagatcaagaagtatttaattccacttgatgatgactagaacattataaaagtcgtaataggtactatcatttgggaagggtcagaaaatgaagagatagaagatacagaataaattaaagacataatgtttgttccagtggaatttaaaaccatggaaactggggcatatctttaaaataagaatacttacaaaaaatataaaaggtcatatttacttagaagtcaaatcatatagcagagtaaactccacatgacatttctaactttcctgacatagaattttgttctaacaagtgcattgctagaaattacatattctctcccattcttattcatacagactgaaataataatagatgctccaccagtttcccaactgaagatgtctaaatttggcaccagttaacatgtaaatggttagccataggcagaagattgaaaactggaccccttccttacaccatatatacaaatcaactcaagatgaattaaagacttaaatgtaaaacctaagactataaaaacccttgaagaaaacctaggaaatataattctacagaaaggcaaagattttatgacaaagatgccaaaagcaattgcaacaaaaacaaaaatcagcaactggaaactaaagagttcctgcacagcaaaataaactatcaacagagtaaatagacaacctacagaatgggagaaaatatttacaaactatgcatctgacaaagatctagtatccagaatttataaggaacttatattaacaagcaaaacaaacaaaaacagaaaaaaaccccaacaccataaaaaagtgggcaaaggacatgaacagatatttttaaaagaagacatacatgcagccaacaagcatatgaaaaaaatgctcaacatcactaaccattagaggaatgcaaatctaaaccacaacgagataccatctcacatcagttagaatgactgtagttaaaaagtcaaaatataacagatgctggtgaggctgtagaaaaaagggaaagcttatacactgctagtggaaatgtaagttcagccactgtggaaagcagtttgggaatttctcaaagaatgtaaaacagaactactatttgactcagcaatcccattattggatatataaccaaaggaatacaaatcgctctaccataaagacacatgcacacattatgttcatcacaatagcaaagacatggaatcaacctaaatgtccatcaatgatagactggatacagaaaatgtggtacatatataccatagaatactacacagccataaaaaagagataatgttctttgcagcaacatggatgaagctggaggccattatcctaagcaagccaacagaggaacagaaaatcaaacaccccatgttctcacttataagtgggagctaaacattgtgtccacatggacacaaggaagagaataacagacactggggcctacctgagggttgaaggagggtgaggattgaaaaactacctattgggtactatacttattacctgggtgacaaaataatacgtatatcaaacccctgtggcagacaatttatctattaaaccaacctgcacatgtacccctgaaagtaaaagttaaaaaaaaagaaatgctatctaaaataataatattaaaatttttaaaattagcaagtgaaaagaaatactttgcactccagcagatgaagacaataaggacatccctccaagtcagtcaccattttggttttaggacacttacatagtgttctaagagactggacattacatttgatcttttgattttagggagtagctggagatttcagttatttcaggcccttgttatttcttatttataccaataaaacaatctcaaaactagcttcctgccccttacttctttttggtttagtgtatcctaatatggctgccactcctcaaaccattcccctgctcaaaaacttcaaatgttacctttcataattaataaattcctcatattgacactcacaaaaagtcaaatcatgacttcatcccccagaaatgtatagcgctttaataaaacagaataattaacagtttcctgaacattttctgaatgtcagagcatacagcttcatttgatggctttctcatcttggaataccatcccctctccacctgtcaaaatcctatctctcttctctggtttatttcacattcaaccaactttaccaaaagctttcctgggccttcttctctagtttgagccccacagcacattttatgtttttgatactacttattcaaatccatgatacacttaacctttatgtactagtttaatcttgtgattaactatatcttccttaaggctaggatattctgctttaacagctttcgattctataatgcccgatacagtattgtgcacatgaaagttcaataaaaagccactgaattgactgaaattgcatttttacaggagttttaagaatattggagttagggaggtataaatggtctatgctgtttgctcatcaactggctcagtaactcttttcatatcaaacaaaatggaagccatcctcttcccttcagtgcctactacctcaactcacatgttaatgctgctttaaaactaggcaataaggttgtcattcaccaattttaggaagttcacttgtgaaggcaggttatctttcctggtagccacaagcagtatcaactagtcagcttgccaagcagtcttgccactattagccttctgtgctgctgtggagaccactgctactcctacactgaaagaaaccaaagtttgttccctgcatcccctgcggataagaaaactggcagacagaagatgatgcagacaaaagcatgtagtggctaaaaacacagtggataccactactgtccctgttggggatgtgggatgggggaacagcagtcagtgtttaggcactagctaccaactttggcctgagtttttactatatctcaagttgcagagatatgtgaggtagagagatatacagaaagagaaatattagcactcaactctacttgtgaagtccatgccataagacactatcttaagtaaaactgcataaaaagcaagatcctctaagtaattctaagataaccctcctaaacccaagagtgactttgctaaattccatttaagttacattcctttcaagaaaaagaacactgctgccactattcaaaatgtgatgttctgttaagctaaactgcataaatattttgattaacagtattaacttctgaaaattaaacatacctttagagaccgaactgaatcatcagccagaccaatcacattaacataaaggagattgctgtgcttcagaaatagaacacagtgatccttaaacatgtccaagtctatcacttttgtatttctcttcattgtaaaaaataaatcccaattcataattgcaggggtatcagccgctgttctcattagctacgtggaacaaagttagaagacatataggtaagaaaacacgaaggctgcagcatccagagatgcaatcactgagaactagaccatactagtcctcactgttttatgaagagctgaaggaactaacgctgcatcagggataaagtgtgaccatcaaccatatgaatgagtcctgactagcctgctgggtggtgagacagtatatccagtgcttagccaaccactggacatttgagtgagggcactgacagctagctgactacagatacatcagtgagcttagctgatatcagcagaagaactgcctagctgagatcaatccaaattgccaactcataaaatcacgagtttgtaagtttgctcttttaagctactaagtttgattttgttaacataaactcaggacagaatatgttttatttactaactttttaggcacaattaaaatatgtagaggcattagctctaagggaaaagaaatgggattggttatacataggaaggtggcatcaatttataaaacaatgagctcttggagcaagaaatgttgttgatcgaagtgtgacacttcttaacagcccaaataggaacaacgagcatccaggattaccttaaattctgtaggttctccaacattagtgagaatgtataattcatcatctctgtgttcaacatagtaaaggaccccatgtattcgcttctggataagtactggtgggtcccaagggctcaggccatctatcaaccacacttcagaagtagtcttgttcataatatttatggtgaggaaacgactgtcttttgtaagataaaggaaaacaaagtagctagagagagagagagagacatgagatcacagtttatttcagatgcatgctaccttgttaaggacagtatctcagaggtggtcagtatacatgttgatttataatgcagataggaaattaaaataattccttagtgaatatcacttgtaactttaacaattagctattatttttctcattttctcctaaagggcattcaaaataatttacttctaacattttatcataaatgtttttcaaaaatacagaaaagttgaaaaaaccatcttgattccatcattgctaacattttgctacatttactttattacatatctatgcacctattaatccatctttatttggatgcatttcaaggtaaactacaaacgtcatttctcaatcacatgagtagataacatagctttttgctgagaagaggaaataaactttctataggagacacaaatagggaataaaagggacacggagttatttttattttcttctttctctgcatgcattttggatttttttttcctttctcccagtttttacaacaaaatagaataggaagaaaacccctcacaatcttactaacgtaacacatttaaaacattaacatagctattttactttttaaatttttccttctaagttatatttatatttcatgtgtgtctttaaatagatgtaattatagatacaatttttgattctgtatttcttacttcatatatcaattttctccctacatgagttgaaagtctttgtgattattatttttaaaggctacctaatattataacaggtttaatggctacctaatatatcataattcttaaaaatttagattttaatgtttcattataataaacaatataacaagaaacatattcatgaagatattttccccttccatgatcttcacaattattttcccaagacaaatttttagaaatggaaatactaatttaataagtgtatttttatgacttgatgaatataatcaaataatatcctagaagcactatactaacataatgagtggctttaaatgttatatttatatttttccttattataaaagtaatttatactgaaactactgaaaaacgtaaagaatcccaatgcccccaaataacaactgcttatagtttggtaaaatttcttctgtattggatcacattaccatgtttatttgtcaatcgttatttcttttgtgaaatgtgtgtctattttaaactttgaatgtagcttaaattattagtatgtaaatagctctttaaaaattaagaatattggctgggcacagtggctcacaactgtaatcccagcactctgggaggccaaagctggcagatcacctgagatcaggagttcaagaccaccctggccaacatggtgaaaccccgtctccacaaaaaatacaaaaattagccaggcatggtggcaggtgcctgtaatcccagctacttgggaggctgaggtagaagaatcacttgaacctgggacgcagaggttgcagtgagctgagattgcgccactgcactccagtctgggtgacagagtgagactctgtttcaaaaaaaaaaaaaaaaaattaagaacattaacttgtctttttgttgaaaacactttcctccattttgttacctagattttaactatttacaatagtttttgtggtttttgacttgagtttaatattttacgtaatcgagactgctactaccctttgtaatttcttatattgattttatgtttcaaaaatattccaaccaagctgactaaaaagcttatattttcatcttattaaaaaattatttttctcaatgggttctttaaatctcttaggaatgtatgctgacatatacaatgatgaaaattattttttcccaaatagtatttcccattgcattataaaataacaccgattcatttttcattagtttgtgatgccttttatcatataaattttcacatagactaggatctatgttttagagttattctaagctctattatttgtctatcaatttgtattatttttactgttattgctttatatgctttaatatataattgtagggcaagtcccctaccctactttgctctttattttcaacactttcttcgctgtttttatatatttttgtttgcttagtttggtgatgacaaattaaaaataaactacttgaccaaatagttgttagatatgtggttacaggaagtgagaacacaagtggctctagggtaaaatgtgtctaagagaatatacgaaatataaagaactagacattaatctttttttccaattatttctatcgacaattatttttaaatttaaaatgtattataaaaataataatgcttattacaaaaagaaaaaaagaaaagtaaaaaaaaaaccattgttagtactttgggtgtatttcctttcaatcttttaaaaatgcatcttttttccttgatacccaattgaaaccatagcatatatttaattttttcacctagcacaataatacatttttgagttagttttaatttataatttagtagcaacacatactttaaattcttctatatattactaagaatttaatggttaaaaggtactcaacaatcatcaggaacaaggggttttagtttgaaagagagatacctatctaagtatataccatttatttaagcaatagatactgactaaatagcactatacaaacctggcaccctgcttatcaattaagatgcaaaggtgaaacagactcagtctgttcacaatctagcagttctaggtcatctttatgaatttacatgaatgaactatgttgtaattcacaaaatcaatttcagtttttaataaaatattagtgatatatctgtatttactctgattttgaatattaccagactccaattttgaatacaaacaactaataaaagaatgatcgttttagccttattattcctggttccaaccaaaataaacgttttaagtcaaccaaagtcagtactttaaataactggaggaaggttctggagagaaagatttaattatattattctagtaccttgggtctttttctgtgtaaaagcgttcattacgtttgttatcaccaaaagtggctcgatatacgtcatgacagcgaaggttcctctggaaggtgtagaataaaacatcttcatcttcctcgtcctttacccattctgaaagaaaataatgagataattatacataatcacctacactccattaaaaaaaaaaaaaaagcacagcacattctaattttgaatgccagtgagaacatgtgcaagtttatccctggaaatctaaatatttgactgtatctaatctgtgctgtatataagccagagagctttcctgagaataaaccactactacaccattccaaggtttcaagtagttatcagtctcagggtactcaggtttctaaataagagctaaatgctcaatatttaggaaagacattggtaaagtcacatttgcttttaggaggtgaattccgtctcaatctacaacttgaaactgtaagtctgaaggaatattgcatctttctctcatgtgtaaaccttctctgtctgctttcaagccacaggatatctccaactaccaaacacaatttaatgctgattcttgatcccaccagaagctgtcaacagaagtttgcacacaattacaccatgactgccacctggctgacagtgattgtaagtcatcattgtataatatgcaccatgattttaaaggttataaaatgtacaaaatatatgtcttagaattcaatagttagggtataatttcaattcactgcaacaacatttagttaaacaatggagaaaatgatggctgaaaatgaaaagggaggacaaaatgtaacatatgtaccactcaatgataaatttaaagttagttctattactaaaaatgtcacagcttccattgataaacaggttagttcaacacataccaagttctttggtagtgactttatgctgtaacagctctataagataacatgaaattaaaaaaatacattcaagcttaaagttgaataaaatattaagatgcaacttacgtgtaaaaatttattctagataataatttggcaaataattctgataaatcaaaacatattgtatgacatggactctaattataacacttttaaaaacatgagtattttaaaattacccatctagatatataattaaataagggaaggtctcctgaataagaggtacataggaagatgtatagtccatagggatacatgaatcaggcattcaccttctccctccctcacatgcgacaaaaaaatgtttcaaaagtgttaccgttgcctttcaacacagaggactattttggttggtggcttaccaaaactggacacattcgggaaagaagcttccattacgggctgatcgctgagctttataattacacaggtagatgcttcagaatcttcagttcttatcttggcagccacatatttttcatctggagcaactctgatacaatcaatgaagggctggtctaacttaagttcctccaaattgaataaaacttcataattatcattgtctgctgtataaagaaaaatacgaaagtgataacttcaaaggatgtactttaaaaaattaaaactgtattttaatgttttaaattagaattcccattctgtaagaggccatatcctagcttctttcaacaatgatggcagcttaacttgcacatcaactgacaataagttatttaatattaccttatactattcaatactattctgtgcatcaacctatgagacattatttgatattgttatagtctagtttagtatttacagaccatacagaacctagaaagtaagtgaatataaatgacaatcaacaatatatgccaagtgcctagcatagtacccaagacacagcagatgctcaaaaaatgctggatgccgtctccattctccctgccaaagcttctgagtctaactatatcttacacaaacccagatattaaaaactagtcattaaaaaaaaattcagaaataatctttaaaaaaatcttttctctatctttgagaaattaataaatttcctataaaaaatatgaaatctgaaaattagagcacgtaaaaagaaaaattgtggtgtaccttcttcatctttggaacgaaccaagcaacaaccttcttggtaataaacaaaaccaccatgtttaacctgacaaaagaaacatgcagtttacttaataataatttaattaaccttttcatagtctgactattcaagatgaagatgaaatgaagactcttataaaaaacagacctgttgaagtatatgaatgaacacatatgaaatataaaattgaccatttttacaatgtagttgataagatatggttttcgtatgttcataaccactagaggggtttttaatacataaatacaagaggcaataaagaaaaggtataacaaaatctgtcagttctcacaactgtacaaaccacttctgctacattttagaaacatctgatacctgtacagtgggagtcaattaacagaaatcaagtggcatctttaagacaatccaaaatgatgcagatgaggaaactgtggctcagactagcctgaaaacccagtctataactttctgagactccttcctttaaaatatgctgtcaccaacaactatacacagtcttgacttaacacaaactatttcacctgctgtagggtgacaaatacaatttgaaattgagagaattaatattacccaaatataaatagtgttcttgtctaatgcctacatattaaatgtaattgattggttgatatgatttcagtggcttacgtttattatctgttagttggtggcgtaatttgaatctggagatccttattcttaacctactatttccactctactatgtatgtgattttcacctattgcggttcaattttccaatcttattgaaaaattcaattcattttttcttttttttttgagacagagtcttgctctgtcacccaggctggagtgcagtggtgcaatcttggctcagggcaacctctgcatcctgagttcaagtgattctcctgcctcggcctcctgagtggctgggactacaggcgcctgccaccatgcctaatttttgtatttttagtagagatggggtttcaccatgttggctaggctggtcttgaactcttgacctcaggtgatctgcccaccttgacctcccaaagtgctgggattacaggcgtgagccactgcacgcacagccctcaattcatttcgactgactatttatgactgtgataaccataaaatggttaaacagatacttggctttcatggtattatactacttaaagtgaattccttttattaaaaaatttagacaaaacaatcaagtaattttcaaataataacaaagtatgaactactttcatttgaacttctccttagaatgattaaaaaatttttaaatcagtgctgggcatggtggctcacacctataatctcagcactttgggaggctgaggtgggagggttgcttgagcccaggagttcaagatcagccagggcaacacagtgagaccctgtctcttgaaattttttttttttaaatcggaactgattgtttgcaaaaaccagaattaatatattacagttgaaaattcatcttactttcgatctttacatttattaaaagatgtaaaggatcacattctgtgatcacaatctctgaaatctttgctttttaagtttttcagcatattttaaaggccaaaagcagtataatcttgatgtggactatgtctctaaatcaccaagtatctcatttgcatcttgattggtaatatcaaaaatttttttttaaagacatgagatatcttacttccacattgatgatttcatattcttcttgtggctgtgtttctaattttgttctcactttttcaaatgcatccatgttttctggaaggggtttttcgttttcttgtttaacaggctgaagatcctggaaaaagttttgttatgatcaaaatatttcaaactagggaaaaaaaacttttgctttttaaagataagtaggtctataccgtagacttaacgttgtacaaaaaagaaataagattaaatagtaggtatttcacagattgtaaatgttctttcctaggctcatcaataaaatgatctttttcgttaaaaaaagtaaacaaagtaagatagacatttgatggttatactattattttagatgaataagtccttaagaagcaggaatactaagaagctcagaagaatgttcagaaatactatggggaaaatttatacacaattaaggagaaaataaaattccatgaacttttacatatttaataggaaaatcaggtagagaaaaaaatctttcgcgtttaggaagtactgaagtacttcctaaaagaagggaaatatcaaagaagtggaagacattatcactactaataaatgttcactattattttattcacagccagagtgataagaaatatttccctacttcattaactataattttttactttttaaattttttaaatttaaatgggtctgagaaccaagggatataattttcttttcttgtgggaataactaagccccaaaacagaactgtttatcacatcaaaaagtaaactggcgaggcgcagtggctcatgcctgtaaccccagcattttgggaggccaaggagaatggatcacttgagcccaggagctcaagaccagcctgggcaacatagcgagaccccgtctctataaaaaaatacaaaaaaatttagccaggtgtggtggcacacacctgtagtcccagctacttgggaagctgaggtgggagggatcacctgagcccaggaggttgaggctgcagtgaagcatgatcatgccattgcactccagcatgcagagtgagaccctgtctcaacaacaacaaaaaaaagggaattaatgcctaatgaaacagagcttctttttcagtttctttgaggaaaaataacatgttcactttatgaaaggaagaaccaggaaaaataatagaaaataatgaacatgagtggagatatagatgaaagctaaataagcattcactgtgtcttatcaagagtgactaataagctgacagctttatttgagttctggtaagcaaattaatatcatataaatcattacaatttggataaagcaaaacctgttatcaaatttaaaaactgtttaataattcaacactccagtggtttgccttgtttaagcaaaaggattctggccaagatattttacttcagctctctgccaaagatgacaattgtacagtgatttgtaccagaggggggacttaagtctttggtaaggatcgccaacagctggaaagtatttattgcataaaatatgtccatgatactttaccaacattgtagagaatgtaagctataaatacagtttatattacaaagagtttacaatctaaaattaaacacaagaatataacggaaaaatcaccaaaacaaattaaatggaaaataatcattttcacaaaggttttccttttagatttttttgggacacattattatttgaattagattaaaattagcaataatggttgttatgatagtctcaatcatttagcctctacttactatcatataattttctgaattttttttaagagacagggtctcactatgttgcccaggctggactcaaactcctgggctcaagcaatcttcctgcctcagcctcccaagtagatgggactatagataggtgtgtgcctcctcattccatacagttaattttttgagtaattatttgaagatcaaatactggaggcttatatatttatttttcattcatttttaaagcatttctacaaaatctacagttgatctttaaagtggtgagacatgatatctgtatcaataatcccctcatatcaccatcataagtcagaagatgactaaaaatctattctgaaactgtaaaatagcaataggagctgcctttgcatttctagattcaggattgtctgttctgtaatttccattaaaacttttgaagtagagtcaggattatctctctactaccctgtagcttctagcacattctaggtcatggagctgggttctgtcacttttaaatactcattcttactgagagtcatagccaacacagagccaaaagcaacagagcgggctccaaaactcatcttcttaactttacattccttcctgattaacattttttctgtcatatatccaaataaactgagcttatctgaaccaaaataactctgaaagcaataggatttttgactcccttaacgaaattcaagcagaactcaacagctttctaagtaactcttctaaaggaattactcccatggaaactgaggttttatataatattcattaagtactccaggttacttttggtttttgttgcgtcccagggatacctgctcagtgttttaagctttcatttcaatttcagctagcaatatcattagcgtacacagctaaagccatccattttagccaggtatcttagtccagttgtttcaaaggcatatactacccaatggagctgaggtaaggatggctttaccttcagattttgagaaggttactggtacagtatcactccattagtggtaaaaagaagcactccttcccactccccaagtgacccaccactaaatcattttaacaatgaaagctgttataaaatagaaggagaatgatatgtgttaactttatcatggcaaagatgctgaactctaaagatagaaaaaatggtgaagtagaaagacaccggacagcccttcagtcaagactaattagccattagtaaatggctaattctaaggctagagcagggagaaaatacatggtaggtttgggaaatcttatgccagaaaataaggaagtgctcaaagtttaatggagacatgtcaaaagaatacaagtgtcaactgaaggggtttctacaggccacattttggacaactggagcctcaaaaagaataataaataataaataatacattgaaaaaacataaatccacagcaattgaaaaacagaatgcaatatgaagcatttcaatttaggaaaacagaaaaagagtaagtcttaaggaagtagaagaaaggtaagaaaattaatttttgaaattaaattgataacaaagaaactaaagagaatcaaattaaaagttggttcttttagaaacctattaaaaaacaaacatcacaaaactgatagaaaaaagaatacgaggccgggcgcggtggctcacgcctgtaatctcggcacttcgggaggccaaggcgggtggatcacgaggtcaagaaaaaagaatacgaggagagaaaaaggcataattacagatacaacagagatttttaaaaattacaataagctttatgtgaatctatttgaaaataaatgaaatgggtaattttccaggaagaaaaattaccaaaattgacccaagaaatagaaaagctatataagtcactaactcttaaagaaattaaattgctaactaaatgtccccttcttgaaagaaacaccaagcccagatgctttcaaatgtagctttcttggatcttcaagaaacagctaatcttttcatacgtcaactatttaaaaaaatagtaaaagaggtaaaactactcattttattaggctaatataaccttgacatcaaaattagacaatgatgatatgagacaattaaaaaaatcaatcttattctaaaataaaacttgataaaatcaaatttttaattttaaaaagcacaaaataagaacagtaatagtaataccaattaaacttaatgtgaccaagaaggattttttcctaagaatgaaaggatggtccaacatcagaaaaaaatctatcaatgtaatctaacacaaataaaggagataaatcttagagccatttttgataaatgcagggaaaaaataaaaaataatcacactttaaaaaaatgataaaaccttaaattaggaatagagaggaacttccttaatagtttctgtcagttatcttacacagaaatatactaaatctgtaatcaaaatacctgaaattaattcatattagcatatacatggtatttagcaaccatgaaacaccaatgagatttccaaaattttaataatgttcatgtaaaacaactaattgtatttgctgttaactcattttattttttaaaagcaactgttaaatgaaggaaacttgttcctttcatcttctgcctccaattcttctccttaccccttctctagagcccagacttttgctcttcttatgccactgactgctcctgtcaaggtcactcaatggctaccacattgcaaagtgcaaaagttaatgttcagtattcatattacttgacctgtcaggatcatgatacaattgatcacttcctcctcctaaaaacacttttctttacttggcttccaggacacctcattctccttgttttcctcttacttcactggcccttccttctcagtatctttagctagttccttctcaactccctggctttttttttgtttgagatgggatttcggctccctgcaacctctgcctcctgggttcaagcgattctcctgcctccgcctcctgagtagctgggattacaggcacttgctcaccacgctggctaatttttttttttttttttgtatttttagtagagatggggtttcaccatattggctaggctggtctgaaactcctgacctcaggtgaaccacccgcctcagcctcccgaagtgctgggattacaggcgtgagccactgggcctggcatctccctggctttttaacactggcagagctcaattcctgcactaagtacttctcttctttgcagtctgcactaattcccttggtgatctcatccagtcatgaccttaaataccatttatatgctaaggactcccaaatttacagctgtagcctgaacaatcctgaccaagatgaacttgtatatccaactgactacccaacatttttacttagatgtctaatatgccaaaaaatgtccgaatctgaactttaaatctccccatatatccctcgccctattaaaaaaaaaaaaaacaaaaccctgttctccaggcaatctttccaatttacataaatgacaaatctgtcctcccagctactcaggcttaaaaacattacagttggatttgtctttttctcttgccacaaacaactggtctgctaaatcctctcaattctactttcaacatatatttagaatctgaccacttctcacacttggactggactacttggctagtatcatcatcatttctcccttggattactgcaaaagcccaaaagctttctctgcttctgcgcttgcctcctggtctattttcaacaaaggagcttgtgtgagtctgaagtcagattatgttactccactcaaaaccctccagtggtttcccatcttgctcaagaggaaaagcaaaaattcttacaatggtctacaaagtcctaaagaatcttgtcccattacattgctgacctaatctactgctacacgccaagcccacttattccagttaatccatacttgatgtttcttgaacatatcaagcttgctcccatatcagtttcttagaacttgggccctatgcccaaatacctccttaaagctattgctcaaatgtcatcttctaagttaggcctttcctaaccattttactaaaataacacccctccctatccccacactgcctattcacatcttccccgtcttttttttcttttcttcttcgccataactatcgcttttgacccactttgtatttcattcatgtaattctttttatttttttgagagatgaggacttgcttgtgtccacctcagctggagtgcagtggcatgatctcggctcattgcaacctctgcctcctgggctcaagcaattgatccttgatctcagctctcaagtagctgagactacaggcgccaccatgcccagctaatttttgcattgtttgtagagacagggttttgccatgttgcccaggctgttcttgaacttctgggctcaagcaatgagcccacctcagcctcccaaagtatattacaggcatgacccattgcacctagccttgttcatgtaattctttattctttctcttttcctttctcaagtaggatggtaagcttcacaaaggcagggatttttgtttattttgttcagtgttatatctccagtgcctagaatggtgcatagcaggtgttcaacaaatatttgctgagttgaataaaattcagacagcataaaacataaaatgaaaaaaacatatttaacaaaagatatcacaaagtgaaaaaaataataatagaacaaatatggagaagatatctacagcacatataaaagacaaaggacacgtaaagaaatcttatgaatcagtaagaaaaggacagacaattaaaagaaggtcaaaagacaagaataggcattcaagaagaaaaactataggatcaataagtgtaagaaaagatgctcactggccatgagtggcagctcatgcctgtaatcccagcactttgggaagctgagacaggaggattgcttgagcccaagagcttcagaccagcctgggcaacatagcaagactctgtctctatttaaaaaagttttggattttggagcatttcagattttgtattagggatggtctacctgtactacaagatattaaaaaagaaaggtactgtgaatgaggctaacttaggtctacttctgactctactagttttcttacttaactttaggctctgtggctttagtttcttcatttgtttagaaagaatacacacgcttcctgattttaagacttattacaggccaggcgcagtggctcatgcctgtaatcccagcactttgggaggccaagttgggcagatcaccctgaggtcaggagtttgagaccagcctggccaacatggtgaaaccctgtctctactaaaaataaaaaaaaaattagctgggcatggtggcaggcacctgtaatcccagctactcggggggccttggcaggagaattgtttgaatctgggaggcagaggttgcagtgagctgagatggcaccactgcactccaacctgggcgacagagcgagactccatctcaaaaaataaataaataaataaataaaacttattacaaagctatagtaattaaatgtgtagtactggcataacgacagacatatacaaaaatgagatgaaagtgagagtcaagaataaaccattgaatttatggtcagttgattttcagaaaggacaccaagacaattcaatggaaaaagaacactcttttcaacaaatgttgctcagacaatggatatccacaagcaaaataataaagttgtaccccaatcccttgcactataaacaaaatgaactcaaaatgggtcatagggctgggcatggtgggtcacacatgtaatgccagcactctgggaggctgaggcaggaggattacttgagcttaggagtttgagacaagcccgcacaacaaagtgagaccctgtctccacacacacaaaaaatcaaaaaattagctgggcatagttgtgggcccagctacttgcaaggtaaggcaggaagacagcacgagcccaggaggttgaggctgcagtaagccatgtttgtgcctctgcactccagcctgagcaacagagtgaggccctctctcaacaacaacaacaacaaaaaaagtatcaaagacctaaagaaagagctcagatgggatgatttctggggtatgttttctagcaataaaatttatggttatatgaaaagaaaaaatgcattaatttaactattaattcattctataaacacgttgcttatctacaatgtggcagtcgttatgctatgtgctggcaagatgtgtattataaaattcttgtctttaaggacctcccaatataatggggagacaggaaaagtttaaaatgatgtagtaatagcagagaggtaaatatagtgatttgactcctatggcttcaactactatctacatgtaacaactctccccaaattccagactcatatatccaactgctactgaaatctccactttactagtgagttatatttatcctttcctcctctcttttttttttttgagatggagcctcgctcccatcacaccaggctggagtgcagtggcacgatctcagatcactgcaatctccacctcccgggttcaagtgattctccttcctcagcgtcccgagtagctgggattacaggcatgcgccaccaggcccggctaaaatttttggattttcagtagcaatggggttctgccatgttggtcaggctggtcttgaacttctgacctcaggcaatccacccgcctcagcctcccaaagtgctaggattataggcgtgaggcgccacgcccggccttcttcacccttaagatctgaatatcagtaagattacatacatgactgtgaaataagtccatctgaaacataaagataaaccaggtacgttttagaattttgagattttggaatgttaactgggtaccttatctcagtttacaggggaacaacactctaatcaaatgcagtaacattttagagctaaacatctactaattgggataaagatcataatagctttgtgtcagtttaggtcaggttttgcccattctcaacagcctccaatcagttaaaaaaaatcatttgttttctaacaggcttttggattttagaatccaaagagatgaggaattatcactcaagctctctagtcttccattaagatgtctcaaataaaatgtaatcagggccagctgcggtggctcatgcctgtaatcccagcactttgagagggcaaggcaggtggattgcttgaggctgggcttccagaccagcctagccaacatggcgaaaccctgtctctacttaaaatataaaaaaattagctgggtgtggtggcacatgcctgtaattccagttactcaggaggctaaggcacgagaatcacttgagcctgggaggtggaggttgcagtgagcagagactgtgccactgcactacagactgggtgacagagtgagacactgtctcaaaaaaaagcaatcaccctgtaaagactctcatcttcactcatctgagttactgacaaggcttcctacttccaatttattctctattctgtcagagtgattcttctaaaatgcaaatctgattgcgcctacatttttcaataacattctattgcttaaaaggatgtagctcaaactttttgcaagatatacaaaactacatattatatatatatatatatatatatatatacacacacacacacatatgaatatgagactattgcaggagctgctaacctgtattgtagaaataggcaaatgacatgtttaaccaaaggatttagtcttctctctttaattatacaatttcattttgtatcttgttcaaattatcactattaaagattttgggaattattttttaggcagagcagagcaggatgatgtggaagataaagaaatgtgatatctggatggatggatgctagtctttgaatatcactggctggcttgtaagtataatagagtaagttcatcttgccatctggctaatgtaaaatggaaagcagaggtacttgccaataagaactgcagaactgaatgaattcaataaggtttagatcggcaacacttgatcatcaaacatttccaatttctaaattcaggtccagtgtcagtcaagttgtgagttccagaattacctgatgtgaacttcaaaaaacagatctggggccgggcatggtggctcactcctgtaatcccagcactttgggaggccgaggcaggtggatcacctgaagtcaggagttcgagaccagcctgaccaacgtggtgaaaccctgtctctactaaaaaatacaaaaaaatttagctgggcatggtggtggacgcctgtaatcccagctacttggcagctgaggcaggagaattgcctgaatctgggaggtggaggttgcagtgagccaagatcatgccattgcactccggcctgggcaacaaagcaagactccgtctcaaacaaacaaacaaacaaacaaacaacagatgtgtaggcctcaaccatagagattttcattacgcagatgtggggtgagatccaggaatccgcatttctaaaaagctctccaggatttctgatatacagttagactgcagaagttgatactgaagagtccccaaacttttaggcagtaatttgttgctaaggtaacaagaggtatagaatcatgaaattttagcacctctaagactttctacagaatgacaagttgaaactccctatttttttttttttgagacagggtatccttctgtcacccaggctgaagatctcactgtgcctcaacctcactgcagcctcgacctcccaggctgaatcaatcatcccacatcagccttccaagcagctgggattacaggcgtgcgccaccatacccagctaatttttagtctttttggtagagttggggttttgccatgttgccaaggctggtctcgaattcctgagctcggacaatctgctcgccttggcctcccaatgttctgggattactggcgtgagccagtatgcctgatcagaactccctatttttttcagtcaggaaaattaggagtcctgattagttcagtcacaccaatcgtggctggatcttttgccttctaacattcccactacacatgctacttttctgttccttagttaacttatataggtaatagctctttaagcagacattttaatttacctaaaagcagtaactactttttctactttattacaccctataaaagtggacagagttggaaatcagtggatgcttgctgaaagaaggaaatgtgcattcttctctacaggtgttttcacagctgccggggcatctttataaagcttccccaggtctcagtgataaagaccatggcttttacattacatcatttctcatagagggaatggttgatacatgacatgtgacagcaggattactttatcaggtaaaggaattactaaatgaactattaatacttggagttattgagtcaggttaaagtttccaggtagtgggaatctataaaagagaacggaaaagttgcttcaggaacaaatggagggaagaaatagtcaaccttctgtttagaatgtgagctaatatcacagctgttactctgatggtaattcctgtctactatttataaactaagtgttaagacaaagtacgacatgacaaaatgttctaaacacaatgcaaaataaaataacctaaaggtccaaaatttagttcaataggtgaaattaaaaattttatctttctgaagtaggaaagatgtacaaaaaacacaaaaatgaaataaaaagaagttataaagaatttctaaatgagtaaagaaagtactaaactaaggcaagacactacaaaaaggaaaagaatttcaaagactaaaacataaacagtaaaagtctaggaagactagggggctaacatataaaatgttaaaagcaaaagagacacacacaacacctaaataggtatcagctaagatagcggcaaaaattgaacaaaaactagaaaaactgagaaaaattagattgaaaagatagtttctaaaatgagaagaatctgcccaagtgtccatcaattacaggaatggataaacaaaatgtggtttatacatacaaaggaatattattcaactataaaaagaaatgaagttatgatacatgcatacaacacagatgaactttgaaagccactgaattgcatactttaaaatggatcaagtggaaaactttgttatacatatattttacccgaagaaaggaggaagccaaaacagactaaaagaaaaatcagtatgcgacaaaaccagaaattaaaataaaaaaaatattaaaatcataaatttgtgaaactattgcaagaataccacccccaaatatcattaaggaacctaaggaacataagaagtaaaaggtaggagagggatgtcaaagcagcagcagcacaaatagatcatttaatcctacttactgtaggatgaccatataatttaccattctaaccaggacacttttgagaggaaaggggacactattaataattacacagggacaacaggtgtaggctggagctgtgccaggcaaaagtggttatgtggttactctctatataagggcaatcaggtccttaaggttgagttcacgcccacagcttggggtctggcagaagtacaatactctgacagtgtcttcctgaatgactcaagtggtcaaaaacgcaagattatttttcatttttttacagagaaataaaatacaattcatggcctttactgaagtttactgatttgtgattcataaaacaattagcgtatcattagattttattaagagctataatttagtgttctaggaaatttagaaggccgaattatactttgaaatgcactggcaggcatactaaggaagtcctgaggtgaatcattttttataaacctacatttttatatattacattagagccctataaatatatgtatacactttttttttttttttttttttcagacagagtctccctgtcacccaggctggagtgctgtggtgcgatctcagctcaccgcaacctctgcctcctgggttcaagagattctctgcctcagcctcccaagtagctgggattacaggtgggtgccatgacgcctagctaacttttgtatttttagtagagacagggttttaccatgttggccaggctggtctcgaactcctgacctcaggtgatctgcctgcctcgatgtatatactcttttatacttacttttgactagagacaattgagacttgaaaattagaaaaatcaagttagaattactgagaaaattagtagctctgatattctacccattctttatttttaaattaaaattaatcttaatgacctacaaataggttaacttaaacagtccataccttacatgagaagctccgacttgggatgtttcttgctaactctgatatcttgggtttattctgaagacacttggttaggtgatattttttcaattttattctattgtaacaatgatcagcgaagttatagtgattcaaatgctgtttctgcatgcattttccaaggtgaggaatactatacttcaaagcttggagaaataatttggtcttctgctgcatgatatcaaagtccctggtttatgctccttttggggctgccagcacacgaatgattttataggtatgattacagagtagtgggttctcagagtaactaagatcagcagttctcatccctccttttcagggccatgccccacttaggttatgaataacttcagacagctgataacttaggctaactaaatctaaaaacctgtgtaagttaaagtttcattcaaatcataattcttggcagatgtgacttaaatgtctcatttgtaaagttaatcctatcaggctcaaactatgcagcactgactctggcacacataggggttaaactaaaacaaaaaacaaaacaagaaacaaaatataaatttgcaaataagtacacagacttaatggggtatctcaggaactcagggctgtaaaaggtaaaaagccctttggtcttacataattatgaacgtatctttggtatatatgtggaagataaactggaaaagcctaattatttaataaaggtgggggagggaagattaattattgttgagtgttaactaactgccaggtgcttttatcttgtttgtctaatttaaattttatatggacttaataaagtagatattaccatgcacattttacaggttgccaaactgtggctgtgggaggttctaagcaactgttccaggtcacttgtacagtaagctgtatagcaaaaaatccaatttggttcggttccaaatactggacatactcaacttcggatttttaatgttaaaaaggtatttagcgctttaattaaaaacaacaaaaaacccctgcaagatgcacaaataaaatgtaaggccatctctggtttgtcaggaggtagcttttattaaccttgattgctaataagtagttaagagtcagagagacctgggttgaggtcttagctcctacacttaactgtgtctccgggcctcagtttcttcatctgcaaaaatgaaatgacaccatttaccttctagggttgttgttgtaaagacaaaatgagacagcttaacattaagaccatacagtgcctggcacatagtgaccactcaataaatggcagttgctattatttacgacaggaataatctaggtatgttgcacaccgctgaatgtcattatggaagtcttccacaaaatgccccctggtatcaaaggtagaatgctgcgtcaaatttaccatagatcagatgcgctacgacgcccccgccccccttaatccctttccatgtcgcagcaaaataatgggcgattgggggtaggggagcaacactagtttactagccgacactagtaaaaaaaggggaaaaaagacccgaataacaaggacctgcaaaggtcctacatcaccacgttcccacagcctttatccatccatctttcatccccaagaagacagtatgcaaggctaggatgggggtggggtagataaatgggtgttctcaggagaacctattcgtttaccccgtgcaactctccaccccagggatgaggcgatctgaatgcaacagggagagggaccaggtgacacgcacgcagtgccgggacattagtcaaaaagcgaggacctggggactgaggggtgggtggctgggcggggggagaaaggggagaaggaaagagaccagcacaccccccatacatacgcaaattgagagaatcagtccggctctggacacaaaccagtgaaggcaggccggagaacctgaagctctcagaggggagcaggtgtcaccgcaggcaagtccagccgaagtctgcgttccgcagcccacagaacgacaacttacccagagccgcctagagctggtttgcagcacgccaatct

SEQ ID NO: 856 - DNA, 43954 bp, Homo sapiens; identical to SEQ ID NO: 855

SEQ ID NO: 857 - DNA, 43067 bp, Homo sapiens
tttcaagtggtcataattttaatggtaaaattaggacataaaaataattttcaaagaattattttcaaagaacactagacataaaatataacaattttcaaattttcaaagaatactagaagaaaaaaattatacagtcaatccaacaaaaagcttaatagaaaaaaaccctaaacaatagtataactacaaataaaatagggcttccgaattatgtctaaataatacaataattacaaatatgaatgggttaaattagcctattaaaagataaaaccactcagataacaaaaacagacataagaaacactaacataaaacacaaagaattaaaatgaagatatagcaagcaaataatagaaagcttgcaacccagctatagctataaacacaaaaaatgaagttatcttttgacctaataattccattcctaatacttagaaatatttgcacatgtgcacaataatacttaaaggatctcaacactgtttttttttttttttgagacagtcttgctccgtcacccatgctcgagtgcagtggcgtgatctcggcacactgcagcctctgcttcctgggttcaagtgattctcctgctgcagcctcccaagtagctgggattacaggtgcacgtcattatgcccgggtaatttctgtattttttagtagagatggtgtttcaccatgttggccaggctggtcttgaactcctgacctctggtgatctgtctgccttgcctcccaaagtgctaggattacgggcctgagccaccttgcctggcctgcaaaatttgtttttaatagaagacacaagaaatgatttaaatattttatcaacagaaaaccagttctatcaactatgggcccagtatgcagcttttaaaaatgacagttctatatacattgatatgagaccatttcaaacaggtattcaataaagtatagaatggtaacatatcaccaactgtgtaaagaaaaatatataaacatatgaaatgatacattctgtgcctatgcaaacatatgatacattaaaaacaaaagaacatatagtgcctgtctctgaggggaactgtgaagctatggaaaggtgttgaagaaaacctttttatagtatgtattcttgtaattgaataaaaaataaaattacaaaaatcaggcttggaagtatttaatagcagacaaaatatagttcaatatgaaaagcattatatgagacaaaggcaattttcaaaaattgataaaacattccaccaaaaatcatgactacgcatctaacagcttcaaaatatagaaaatactcaaatgcaaaatcaacaaatctgcaattacagaaaaagacttcaacatacttttagaaagtagtaactcaagtagacaataatagctaacacttaccgggcacttcttatgtgagtggcactgaaacatgtgctttcatgcattacctaaggctagagaaaatgttaataacttagacaagtcatacatgtatcataaatatctttgtacctgacaaacagaataaacatctttttaaacaccattagataattatttaaagaccacatattgggaacctacccctaaagaacaataacaaccacaataacaactatcaccccagtaaacatggctggcaagaatacaattaaatgaacattatcactgatttggcaacagctcttatgaagaataatttggcattatgtatcaagtgcccatactctttgacaaagtaactgtctttctgataatctatcttaagtaatacaaaaatggggggaggggaataaaaatacaaaatattagaaacactatcgtcaaaatgaaagggcatggctgagtatggtacaaccgttcaacagaatattgtcattaaaaacatttatggaggctatattatatagtcaataacagaaaatgcttgaaaggttagaagtacatcatcaaattatgttttatatagctgtaaaataaacccaaatcatctttaatgaacacatactattatggtaaaaaaaagtctacaatttctaactttcaccttaggcagctttttattttgcatcctttttttcaactttgtcttctattagctgtgcaagaaatacatgtctgctaaagttacacgatcttcgcacaacagcaacctacacattagtctacaaaggggaacaaacccaaattcctcagaagtctgagtccactgttgccttctttctggccatctggcagttacaatatagcacagaatgactatgcaagttaaatattcatcttagacatggacatttgctttgggactcctaaagtggagtcaaatttgatctctacagaaactctacaatgtagcagagcactgtgcgtacttattgactcccagacaagccgaaaccccgaatttgtcatttctatcagtttttatataaattgttcttacctacttattgatgcttacaatttggcaattataaggggcaaaattggagcaagtgttttgggtaaataactccttacaatatattaaaaatacttacaaacaattcttagaatcaaacacttacgtaaatacttttttaaaaaaataggtccaaaagactcagcccagatcggctttgaagttatatcaagatttaagtctacttcatgccaatgagctactcctcaacaggggctggttttgccatttgaggaatgacagccactatgttgtgtacacaagagagctggatggcatcgacagaatctttatcgtggttctgaattttggagaatcaacactgttaaatctacataatatgatttcgggccttcccgctaaaatgagaataaggttaagtaccaattctgccgacaaaggcagtaaagttgatacaagtggcatttttctggacaagggagagggactcatctttgaacacaacacgaagaatctccttcatcgccaaacagctttcagagatagatgctttgtttccaatcgagcatgctattccagtgtactgaacatactgtatacctcgtgttaggcacctttatgaagagatgaagacactggcatttcagtgggattgtaagcatttgtaatagcttcatgtacagcatgctgcttggtgaacaatcattaattcttcgatatttctgtagcttgaatgtaactgctttaagaaaggttctcaaatgttttgaaaaaaataaaatgtttaaaagtaaattatggcttataggagcttataactttattcagatagcatcaatcagggatgaccagaacacattaggaccccagattattcaaaaactttaacgaattttaaggggaagaattttatcttttcccttaaaatgcagtcatagaaattagaggatgactcactgccacagtgtctaaaagcatttgctagcaaagaggcaggacactaatttgtaaactgctcaactgttctgactggaagggaggcctggagctctgctatcaccaatccttcccttccctctactccacatccttctaaggagcatgatttgaaaattactttcctaggttaatgggcatgtgcatcaatggagagaatagtataagcaagtgagatgtagactaagcaaaatttagatggagaagcacattttaaaaaattaataacttaaaagtctcaagttattaattttttttttgctaactcaattggaagtaagactatgaaatatttcagtgtgtttccaattcccagttgaatgcagtgtttcagaatttcaggtatttcttaagatcctcgaaaacactggtgctgtcaagtccaagttcctcgtacaggaatttaatttgggctgtaatctaaaagaaacacattaaaaaaattaaatagaaggcctttgtagtaaaatgccactgtttaagcttctctttatctatccatctttacctaaccgtgaagtcagcaatttatggcaagaatactttcattcgagagagaggcagaaggcttccaacaattaagattaaattattttctttaacagagctcacgtatcaagtacaagagagagacatttctcttgattgacacagtgtccctccctcccctcctgggtctcacccatagataggacatttgtgaagtggctttgtcataaacctgctgcaaccactgaaaatgtgaaaacaacatgtatctagttcgggaatctgtccactgagagggccttgataacatacctttttgtgagaatcctcaattacatgattgcctccaggctgaatatctagaataatattaggggtctgatagcctggaagagttaacatgtagaacaattagaagattgtatgggatcttctttggaagatcgagacccattcctcccctcttctttgagtactcagttcaaataatagtaaaggaataaaaagcaaaaaccaccatcatcaacaaaaagatgggaggggacaagcaacagaagacaaacttctgacacagcgaaagcaggaagaggccgtatggaaaagactatatggtgccacacggacaaggttgaaacccaggagatcatcaacctgccctgtggaatctgagagtcttatgccctggaaacaccaactacagcaatggatgggggtgacaaatggagatgaatacagggagactgatatggcatgtagtttcaaggcaaaagggagggattcttatctcataaagctgaaacagctagctagaggaaattcatgcagctaaacagtttgggcactgatggcccaaaacaaaaatctcagaatctgtcttttagagattcccaagaataacggctcaataaatattgttaaatgaattaataattgtatggcagtgcatctccaagttatatctgattcttaaatttcctgtttcctttgtgtcctgcctatctattttaatactgtcctttgaaaaagaggtgaggcagtgtatgtatagacatgtagttacgtacactttaactggggagtcaacatagcaaaataattgtttgccctaaatcctgggcagatgatttggctacagcctgaaatatattcctctgagcagtgtgctgtgggtagtagtctgtttggccatgttccctgcttctagggggtctcctaccttcacctgtgtccttagcatgctccgcgatggcttccttgagtttctcagtataacttacaattcctttcagaggtacccgttcatcgttttcatatgccgttatgtgaattgaaggataatgctgaaagaaaatacatgcacgaagagtttacattatttcttatggtcccttgccactatagagactatgaaaaataattacctccaatttttccctgtaagtgctctatgctttttctcacttgctatcttgagagcgcctcagtattacagtagtagactacttgttatctggaatagccttttcttgactaaaggaccttagctaatttagtaattaaggcatgataagtctattcccctgaggtattaaacatggagcatgagcagagatggtgctgaagatatttgggcatcataagtagaaacatctctaaagctcctatttttgcttcagcttggataagttttttttttattatcttctgtgtaaattcaggataatctaacacaattgtctttcactacctgaggtttaatattttgatagggacagtaacgttttatgtagttcttgtgtttttcatcagatgaaggattcccccattcttctaattcttctaatgtcagaggaagtgtagtgtccatcatggtgttgagaacatccaagaaaggtgcctaaaaaaaaggcaaagaaacttatacttcaagtaagaggttggtaagtgagtttcagaaaaacattctattttatgaatatacatactaatatgagagaaaataactcaagccatgtagattcctaggagctagaatactcagtccttaaccagggcctgtaatttataacctacttttaaagtcttcagattccttaaatgacatataacaagaaatggtttatcttctaatttcacaatatttatttttagcttagtaccttttattcatttatattttttcttatataaaagcaataaatgctactgtctcataccaattaggacagttagttattatattaaaacaacaacaacaacaacaagtattggcagtaatgtggagaaaccggaatcctgatacactggtggttggaatgtaaaatgggggagctgctttggaaaacagtatggtggttcatcaaagagttaagcttaagattaccatatgatccagcaattccactcctggcatataatccccaaaactgaaagcagggtcttaaagagatctgcatacctatgttcacagcagcatattcacaacagccaaaaggtggaagcaactcaagtgtccattaaccaaagaacgaataagcaaaatgtggtatacacatgcaatattacatggaatattattcagccttaaaaatgaataaaattctgatccacgctacaatatggatgaacctcaaggatataatctaagtgaaataagccagtcacaaaaaattttgtatgactccacctatgtgaggtgtttgagtagtcaaattcacagagacagaggctgtgggaagaagcaaatggagagctgtttaatcggtacagggtttcagttttgttaagatgaaaaacgagttctggagattgactgcataagcctatgagtgcacttaccactactgaactattcacttaaaaatggttgagatggtaaattttatggtattttaccataattaaaaatttttaaatgaaaaaaatacacaaggaataaagtctttttgaccagttggacattttatattaaaagcaaaaaacgctaagtaaagaaactctgcaaaatacccaaggtgaaagaagagaaaacaacccattggcttataattagtgttacaaaatttaataaaacgaaggctgggtcgcacatggtggctcatgcctgtaatcccagcacattgggaggctgaggtgggcaaatcacttgagcccaggagtttgaaactagcctgggtagcatggtaaaaccacatctctacaaaacaacaacaaaccacaaaaattagcagggcatggtggcacatgcctgtagtcccagatactcaggaggctgaggtgggaggatcacctgagccccagaggtcgaggctgtagtgagctgtgttcgtgtgccattgcattccagcctgggtgaaagagcaaaactctgactcaaaaaacaaaacaaaacaaaacaaaaaaacaaaaaccccacaaaaacaacaaaacaaaaatgaaggctgtatttttcacttagctttattttcttctgttaacatactttttagctttccctcatattaacattaaccaagtatagtgagtcatctgtaattctttttggctgcctaccatatgaacttttttgcatttgaaaaacctccaaccttatcagctagagcctgcctctcactgtggagatactaagtgctagacttctctttcccatttttccctgcagcttgggagtagctgtgtgacccatgtgtgacttgggtctatcaaccagacacatgtgctttacactctgcatggaaagttagtgattcaaagaagcagtgatcacagataatttattctggcaaaagtgccacagctatatccagctctagaagttgcactggcagtgtgaggtgatttgtgcttggcagtggcggcagtaatagtttcattgggccaattctatgcctttggctctgaagcctctaacactggtctgaagacacctacattttcctaatgccctttaatcccttttctgcttaaattagggttgatttttggtgcttataagaagaatttgacttatacatgtataaaaggttgtctcctagtcttcactataataagcaacctagcataaatatccttctcatcatttccttttaaatttctaaaagtcaaaatctagttgctttgtctttaaactgtaaataattctgccattatctttgtgcataggctattctccacatttttctgtttttaaaaaatagacttacaggtgactactatttaacacttatttacaagcccacagtataaactccccaacctcaaaataaaaaatcctgaaaataatttactctctcccatctcagtcattatttttcagagtaacctagaagtaggagaatgatagcagtgaaaccaactgctacaatgtaacttcgtaatttctgacactgggaaaagataatcattttcagaacagggtaagatatttcaattaaaatacggaaaaactatgcccaaacgaccattaagaatggactatctaaaaataaagagcctataaatctaggactgaaatgttgatgggcagtagcctgtcaaggtgaccaggagccaaaggactcagtgcattccagagtcacagcgtgctttgcctggctttctcaactgggactcatatatgcttcagtgctttttcaccaattctaaatgtccttacaaatacaaatgagcaatggaaatagccattaatatctttcagtggaaagccttaaagataataaagaacactgtatcagagaagaataacggttaatagttggattaaaataactttagaagttctcctcaagctataattctgagtttaaaacttaaaagctttgttatactcctatgctatggtaaaactgtaacagaaatgtttttctttccttttttttttttttttttgacaatgtctcactctgttgcccaggctggagcacagtggtccactgcagcctcaacctcttaagagatcctcttaccaacaagcctgggtaggtttttttttttttttaatttcttgcagagacagggtctcgccatgttgcccaggctggtctcgagctcctggtaagcaatctgcccacctcagtttcccgaagtgctgggattacaggcatgagccgctgtgccagcccaaaaacatttttcttagagtagcctatggcttcacacctcccccattctataaacagtagagacagagcgtactcacctccaaagtcaccgctctcaccagctctggattagaattacacaatgctcctgcaagcacccctccagcactgaaagcagtcagggttgttagacttggctgagaaaagccttggccatgaagcgtcttaatgcaagcctctaaatcagcaaggccattgagttttttagttaggcggccatcagcgtgccactggaggcctaactcaccaccacctctgaaattgaagggcaaaaaagttttagtggaaaaaaaaagttaatactgtaggctggggtcagcgaactacacctggaggcctgttttttgtgtggccctggagctaagactggtttttgctttttaaaggttgagtgaaaacaaggaatgtgcaacagaaactgtacgcggcctgcaaagcttaaaatgtgactatgtagctctttagagaaaaaggtttgccaactcctgatatagacaatccagaattgattcaacgaatatattttgagtgcctgcccatttatcagggattaagtacagaccttaaaagtagaaacaaacgaaaatcccctaccgtggagaagacagtaattttgtggggtaagaaaacaacgacttacccagcaatgtggtgtcattgctacaatacaagtgtatttaaggtattacaggagcagaggaaagaacatccatctgccaggtgaggggtatatacacgagtcaggaacacaaatgcttttaaggagatgatgcctaaactgagttgtgaaggaaaaatttgagtttccagagggcaaagaaaaggcattaagacacagatacgacacagcatgtataagggcaaggaggtgacagagcatgtcatttaaaagacatgactttgggggctggacacagtgcctcaagcctgtcatctcagcattttggtaggctgaggtgagcaggtcacttgaggtcaggagtttgagaccagactggccaacatggtgaaacccccgtctctcctaaaaatagaaaaaattagccaggtgtggtggtgcgtgcctataagcccaactactcgggaggctgaggcaagagaattacttgaacctgggaggcggaggttgcagtgagcggagattgcgccactgcactctagcctgggagacagagtgagactccatctcaaaaaaatacaaaacaaaataaaaaaaataaaaggacatgattttggaaggctgaggcgggcggactgcttgagctcaggagttcgagaccagcctgggcaacattggaaaaccctgtctctactaaaatacaaaaaaatcgggctggtacggtggctcatgcctgtaatcccagcactttgggaggctgaggcgggcggatcacttgaggtcaggagttcgagaccagcctggccaacatggtgaaaccccatcgctacaaaaatttcaaaaattagtcaggagttatggcaggcacctgtaatcccagctactcaggaggctgaggcaggagaatcgcttgaaccctggccaagatcatgccactgcacactccagcctgggcgacagagcaagattctatctcaaaaaaaaaaaaaaaaaaattcagacagtgtggtggtgtgcgcctgtagtcccagctactcaggagcctgaagcatgagaatcacttgaacctgggaggcagaggttgcagtgagccgagattgtgccactgcactccagcctgggcgacaaagcaaaactgtctcaaacaaaaaaaaaaaaaaaaaaaaaaaaagggtctgatgctaaatgccgctacagagatccatcagaccattaggagtattatactggggaatctggactgtgttctagagatggggaggtggagaagaattttaagcagaaatacaaaataatatttgtgtcttgaaaacagctgaaataaaatggaagttaaatggaaaacagttcagattcagaggctacttaaacctgaattcaggagaactgaaaggaaataataatattactaaataagtacagagtctggtacctctatgcaaaaatcctaaaaacctatccttttgctttttggatcaactaatctgttaaagaatcaagtttcaccagtgctggtttaggaatacaaaaattgaataataagaatgaaaaaaataagcttttgttccctgatatatattgttattcttgacatctctcacaatggtctagcacttacatgccaggtaaaatatactgactcaccgaacatggcagtatgctaatatccatccatcatccaccaggacccgcctctcaggcctgaaattcattttcaaatccattccataagctccatatacatgtaccaagagaggtttcttctgcaagtcctcagagtcagttttgtggaaaacagtcattggcactaattttccatcctagaaatgaagaattactatgtatgtaaagaagagtcttttataataactgttttatcccaatttaaaatacattgaggtgcactgtccccacttgtgtgctacctactgatgttgagcacaaatttgtttaagaaaaagaattatggtctctaaaaataaatcatggcttttggtttcagctaccttgctgtcctacagtattaaccagaaaagagcagcaagactggcctgaaaacattttattaaatgcagcttttcatgacaataatgtaattttaaagagttcttcactacctactataattttaaattttcagatgaaaccaaaatacttaccaaggttagaagtcctagtatagcactcttcctatgcctaagagctagatattggcatttttcacttttgagtatctacaaatatgctgactaaagtcttaccagctcaattttctatatcctctgtagtcggaattctcaaccattaagacctgaaatcttactgatgttactgataactaccacaatcctcttcaaaggcccatttaactttattaaaaaaaatttaaagtggtcttaaaatttttcggtaaaattctttgtagggttaaagtaagttaaattatttgtaaggttactaagttacttgtaggttatgtaaccatcccccaatgtagctcaaactcatcagttccagttgattgaaactaggcagtctctgaacagacaaaagaactaattctgatctacctttcacacaaaaaagataaagaaattggttttcaccctgcttaaactaatgaaatagcaccgtttacataaagaaaataaataatacatccaagtcactcttcatattttcattctcattttgaaaacttcactttggggcaataactggagacagcaaaatgtaatcaaataaggaggaaattctcctctcattcttctttaaaatacccaagttgttatgacattgttaactttcacttttagtaagattcacttttataaaacttgatgtagattaatttctataaaacactcttggtcttttcacttcccaactcttccccaacttcaattatacaatcagaaaaagttgcttgttgaaaagttttgaaaggaagaggtaaaacagtagctactcctgtgatgggctggatctgggtttgccagcagtactaaaatgcctgtggaaaggtatagcgcttccattcagcagctgcttcccttctcccctcttggctctccaagaacatggtgcttaactgttctttccatctcgggtccaataattgcaacattttgatagactagtctaattccatgtttgtaaaaccaaataaaacctatctaaaagataatacactaagtgggtaacaatgattatttctaagaggtgcagcaagcaaatggtactgagaagtagtcatttaagatttgttctgtatttttgcatctgttcaacaagcatgtattgcttttgtaatataaaaatattaatatttacttaaagattgtcagagaaaaataaatgaattaaagaaaaaaattcctaagaataaaaggcttgtgttgtaattcattgtgtcagcacatgtgaaattatctgatatatgatatgctaaagtctgaggtttccttaaattcaaggctatagtttacatattaatttgttccctacttgcataaatttgtatattctgtatattgagtatacctggaatatggatatttgttatttccttttctgtgtctcatctctctctactcctcaccctgccaatcttccctcttttacttgattttggccataatggcctcctttatatttgttctttttctgagacaggatcttactctgtcacacaggctggaatgcaatggcgcaatcacaactcactgcagcctcaacctcctgggctcaagcaatcctcccacatcaggttcccaagaagcagggactacaagcatatgccaccatgcctggctaatatttttggtttttgtagagatgaggtctcactatattgcccaggttggtttctaacttctgggctcaagtgatcctcccagcttggcctcccaaagtgttgggattacaagtttgagccactgtgcctagccctacacttcttctgtaggctggagagcagtggtgaggtcttggctcactgcaacctctgcctcctgggttcaaaggattctcctgcctcagcctcctgagtagctgacattacaggcacctgccaccacacccggctaattttttgtatttttagtagagatggggtttcaccatattggccaggctggtctcgacctcgtgatctgcccgcctcagcctcccaaagtgctgggattataggtgtgagccactgtgcccggccagccctacacttcttgaattgtataatttctccccaaattcagggcctctatacaaaatggaatcccctatctcctttctagtttactcttaatcatcctagtggtcttacctgagacataacttccttggagaaaacttccctgatctctctagactaggtaaaatccctttgctctatgctcccactgtactcagtatgtcctcctttgcagcagtcagtacattattaatgactttttaaacatgtcatctttcctgctagatgtatgctccatgagggcagggactgtatcagtctagtttactctagtcaactaccaccttcactatttttgccataactacataccaactctattaattttttcttaaaatcaactttaaaaaatcagacataaacaacatgtaaaataaaaagtttgacatgctataaattttcttttttttttttttttttgagacggagtcttgctctgtagcccaggctggagtgcagtggcacgatctaggctcactgcatgctccgcctcctgggttcacgccattctcctgcctcagcctcccaagtagctgggactacaggcgcccgccaccatgcccagctaattttgtgtatttttagtagagatggggtttcaccgtgttagccaggatggtctcgatctcctgacctcgtgatccacccgcctcggcctcccaaagtgctgggattacaggcgtgagccaccgtgcccggccgacatgctataaattttctaatccatgttaaaacaaacatgaatattaaggttaaaaaaaattcacctatccctaaagtcacttgggtattactgtggtctaagaaatctacattaggaaaccgtgctaatgtaactccaacaactgcatggcatctggcaaacggtatgctttcagtaaatgggagctgaaagtgaagattataagacctaccttgcttttggcttctagacgtaaaacgcgactagtctttgtgattgggtcttcatgcccagtttcctcaaacagtttgccttctgcaaacttgtatgtgtaatattttgggggacgtattggagagcaaagttgaaaggggcagttctttgggtcagaatttgtatccattatgaatccacaggcccaaggagggagctaaagaaatacaacagctatttttattctttatttaggccaccaagtatcattaattaaatttctaagtcttctccaaacaagatgatgtggatatctcgtttactttttgttaccacgtcatgcctcattcaaggattactttatcacaacaacatacatttcaaataaaaaacaaaactgtacattaatgaccaataaaataagacaaactataggaaaatgatttatcatgattctagctttacatgaaattgcctttaacataaaagtttattttggggtataatcttggataataaaatagtaaaatggaagaataagagcaaatcaaatagtaattccagaacccaccgacactgccaagatctctgttctcaaagaacgtgaaattcctcacatgcgtgtgtttttcataatttacccactagtccttaccctgctgcctggacagccacagtgatgacagttattatttcagggctataaacgggctcagcagcattaaggcatttgcaatttgtttctaacttttagctcctaggctaaccattgtgcagaacaaaacctcttctggcacatctactctgagagactcacagctattatactcaaggttcttaactttaagaaaaaaggaaaggaatcaaaatttattctctcagagcagcagggtccagcttcaagccttgcactaacatccctcttacaccttttaaagaactctggtaagcaggttgacagagcgttagaaatggtaccgagaggcagaacattaaaagaaaattgcctttcttttcctgagtaattgtagaaagagcaaattccttagaaaatcagaggcacagaaacatcactggtgggcactattgaaaaagggcagccggggatttgtgcgtaaaggggataccattccacctgcagcaactacagccagagtttacgttctctgagcaaatctcttattaataaaaaaaaaaaatctattttcatgaaacactagtaaggacacacatctgcaatctctaaaagctcctaatgtatgcttctcacattgagggttgttttaaaggataacttgtctatttaaatttaagccataactggagagtaaaatgtaaacaaaaattgagaaatctggtagcatagttataagcaagcaaactgagacttgagaggggaaaaaaaggaagcactgctacaaacctcataaccaggcctcagagcgagggtacaaggttccttagcccatggaagctcaagtttttctgccctttgatgagacttcaggacagtctctatgtgacccacgcagtaagctgtcttagctttagaccaagtggttccaataaatcaaaaagtatttttggtgtttttctaaaactaatgggaccaacattaatgttttaatcataataaaaactgtttcaaggctatggacttttagaagttcatccagctaatgcagatataagtattaactaactcaaggatatcttaagccacatttcctattcagataagcctgcagtgtatctgtgtatattaatggacagcaccagagagtaagtaggccaggagatagggagacattccttagatacctgagagaaacaggttcagttttagcactctaccagcaaactatagttatttcatcaaaagaataagacatacatgccgaaagaaaattggcctgaatatgcagactcctcctctaaataaaactgatgttagcatacagcaaaaaacgtcccaactggcctaaattaaatatcataacttctttttgtgacaaaaaaaaatacttccagaaaatactgatggcatggtgaccaaggatacgaggcaaatatgtgaagggttttacatttctgttgctaagatagaatttatttatttatttagagacggagtcttgctcttgcacccaggctggaatgcagtggcgtgatctcggctcactgcagcctccagctctcggcttcaagtgactctcctgcctcagcctccagaatagctcggactataggcacctgccaccacgcctggctagtttttgtatttttagtattctttgtattttatattttttgtatttttagtagagacagggttttgccatgttggccagggtggtcttgaactcctgacctcaggtgatccgcctgccttggtctcccaaagtgctgggattacaggctgagattgaatttaaaaagatcttttaatcaagtgcccaccaggcagagatactgcataaagaaatattttataatgcactcacgctatggttaaagattttgtctttcgtgtatggatggcactgtctatgtatattaattaatattattcaggctcataaaaagggtctgatctataaaattctctttattatataccaggtactaaccagaaagatcaagaagtatttaattccacttgatgatgactagaacattataaaagtcgtaataggtactatcatttgggaagggtcagaaaatgaagagatagaagatacagaataaattaaagacataatgtttgttccagtggaatttaaaaccatggaaactggggcatatctttaaaataagaatacttacaaaaaatataaaaggtcatatttacttagaagtcaaatcatatagcagagtaaactccacatgacatttctaactttcctgacatagaattttgttctaacaagtgcattgctagaaattacatattctctcccattcttattcatacagactgaaataataatagatgctccaccagtttcccaactgaagatgtctaaatttggcaccagttaacatgtaaatggttagccataggcagaagattgaaaactggaccccttccttacaccatatatacaaatcaactcaagatgaattaaagacttaaatgtaaaacctaagactataaaaacccttgaagaaaacctaggaaatataattctacagaaaggcaaagattttatgacaaagatgccaaaagcaattgcaacaaaaacaaaaatcagcaactggaaactaaagagttcctgcacagcaaaataaactatcaacagagtaaatagacaacctacagaatgggagaaaatatttacaaactatgcatctgacaaagatctagtatccagaatttataaggaacttatattaacaagcaaaacaaacaaaaacagaaaaaaaccccaacaccataaaaaagtgggcaaaggacatgaacagatatttttaaaagaagacatacatgcagccaacaagcatatgaaaaaaatgctcaacatcactaaccattagaggaatgcaaatctaaaccacaacgagataccatctcacatcagttagaatgactgtagttaaaaagtcaaaatataacagatgctggtgaggctgtagaaaaaagggaaagcttatacactgctagtggaaatgtaagttcagccactgtggaaagcagtttgggaatttctcaaagaatgtaaaacagaactactatttgactcagcaatcccattattggatatataaccaaaggaatacaaatcgctctaccataaagacacatgcacacattatgttcatcacaatagcaaagacatggaatcaacctaaatgtccatcaatgatagactggatacagaaaatgtggtacatatataccatagaatactacacagccataaaaaagagataatgttctttgcagcaacatggatgaagctggaggccattatcctaagcaagccaacagaggaacagaaaatcaaacaccccatgttctcacttataagtgggagctaaacattgtgtccacatggacacaaggaagagaataacagacactggggcctacctgagggttgaaggagggtgaggattgaaaaactacctattgggtactatacttattacctgggtgacaaaataatacgtatatcaaacccctgtggcagacaatttatctattaaaccaacctgcacatgtacccctgaaagtaaaagttaaaaaaaaagaaatgctatctaaaataataatattaaaatttttaaaattagcaagtgaaaagaaatactttgcactccagcagatgaagacaataaggacatccctccaagtcagtcaccattttggttttaggacacttacatagtgttctaagagactggacattacatttgatcttttgattttagggagtagctggagatttcagttatttcaggcccttgttatttcttatttataccaataaaacaatctcaaaactagcttcctgccccttacttctttttggtttagtgtatcctaatatggctgccactcctcaaaccattcccctgctcaaaaacttcaaatgttacctttcataattaataaattcctcatattgacactcacaaaaagtcaaatcatgacttcatcccccagaaatgtatagcgctttaataaaacagaataattaacagtttcctgaacattttctgaatgtcagagcatacagcttcatttgatggctttctcatcttggaataccatcccctctccacctgtcaaaatcctatctctcttctctggtttatttcacattcaaccaactttaccaaaagctttcctgggccttcttctctagtttgagccccacagcacattttatgtttttgatactacttattcaaatccatgatacacttaacctttatgtactagtttaatcttgtgattaactatatcttccttaaggctaggatattctgctttaacagctttcgattctataatgcccgatacagtattgtgcacatgaaagttcaataaaaagccactgaattgactgaaattgcatttttacaggagttttaagaatattggagttagggaggtataaatggtctatgctgtttgctcatcaactggctcagtaactcttttcatatcaaacaaaatggaagccatcctcttcccttcagtgcctactacctcaactcacatgttaatgctgctttaaaactaggcaataaggttgtcattcaccaattttaggaagttcacttgtgaaggcaggttatctttcctggtagccacaagcagtatcaactagtcagcttgccaagcagtcttgccactattagccttctgtgctgctgtggagaccactgctactcctacactgaaagaaaccaaagtttgttccctgcatcccctgcggataagaaaactggcagacagaagatgatgcagacaaaagcatgtagtggctaaaaacacagtggataccactactgtccctgttggggatgtgggatgggggaacagcagtcagtgtttaggcactagctaccaactttggcctgagtttttactatatctcaagttgcagagatatgtgaggtagagagatatacagaaagagaaatattagcactcaactctacttgtgaagtccatgccataagacactatcttaagtaaaactgcataaaaagcaagatcctctaagtaattctaagataaccctcctaaacccaagagtgactttgctaaattccatttaagttacattcctttcaagaaaaagaacactgctgccactattcaaaatgtgatgttctgttaagctaaactgcataaatattttgattaacagtattaacttctgaaaattaaacatacctttagagaccgaactgaatcatcagccagaccaatcacattaacataaaggagattgctgtgcttcagaaatagaacacagtgatccttaaacatgtccaagtctatcacttttgtatttctcttcattgtaaaaaataaatcccaattcataattgcaggggtatcagccgctgttctcattagctacgtggaacaaagttagaagacatataggtaagaaaacacgaaggctgcagcatccagagatgcaatcactgagaactagaccatactagtcctcactgttttatgaagagctgaaggaactaacgctgcatcagggataaagtgtgaccatcaaccatatgaatgagtcctgactagcctgctgggtggtgagacagtatatccagtgcttagccaaccactggacatttgagtgagggcactgacagctagctgactacagatacatcagtgagcttagctgatatcagcagaagaactgcctagctgagatcaatccaaattgccaactcataaaatcacgagtttgtaagtttgctcttttaagctactaagtttgattttgttaacataaactcaggacagaatatgttttatttactaactttttaggcacaattaaaatatgtagaggcattagctctaagggaaaagaaatgggattggttatacataggaaggtggcatcaatttataaaacaatgagctcttggagcaagaaatgttgttgatcgaagtgtgacacttcttaacagcccaaataggaacaacgagcatccaggattaccttaaattctgtaggttctccaacattagtgagaatgtataattcatcatctctgtgttcaacatagtaaaggaccccatgtattcgcttctggataagtactggtgggtcccaagggctcaggccatctatcaaccacacttcagaagtagtcttgttcataatatttatggtgaggaaacgactgtcttttgtaagataaaggaaaacaaagtagctagagagagagagagagacatgagatcacagtttatttcagatgcatgctaccttgttaaggacagtatctcagaggtggtcagtatacatgttgatttataatgcagataggaaattaaaataattccttagtgaatatcacttgtaactttaacaattagctattatttttctcattttctcctaaagggcattcaaaataatttacttctaacattttatcataaatgtttttcaaaaatacagaaaagttgaaaaaaccatcttgattccatcattgctaacattttgctacatttactttattacatatctatgcacctattaatccatctttatttggatgcatttcaaggtaaactacaaacgtcatttctcaatcacatgagtagataacatagctttttgctgagaagaggaaataaactttctataggagacacaaatagggaataaaagggacacggagttatttttattttcttctttctctgcatgcattttggatttttttttcctttctcccagtttttacaacaaaatagaataggaagaaaacccctcacaatcttactaacgtaacacatttaaaacattaacatagctattttactttttaaatttttccttctaagttatatttatatttcatgtgtgtctttaaatagatgtaattatagatacaatttttgattctgtatttcttacttcatatatcaattttctccctacatgagttgaaagtctttgtgattattatttttaaaggctacctaatattataacaggtttaatggctacctaatatatcataattcttaaaaatttagattttaatgtttcattataataaacaatataacaagaaacatattcatgaagatattttccccttccatgatcttcacaattattttcccaagacaaatttttagaaatggaaatactaatttaataagtgtatttttatgacttgatgaatataatcaaataatatcctagaagcactatactaacataatgagtggctttaaatgttatatttatatttttccttattataaaagtaatttatactgaaactactgaaaaacgtaaagaatcccaatgcccccaaataacaactgcttatagtttggtaaaatttcttctgtattggatcacattaccatgtttatttgtcaatcgttatttcttttgtgaaatgtgtgtctattttaaactttgaatgtagcttaaattattagtatgtaaatagctctttaaaaattaagaatattggctgggcacagtggctcacaactgtaatcccagcactctgggaggccaaagctggcagatcacctgagatcaggagttcaagaccaccctggccaacatggtgaaaccccgtctccacaaaaaatacaaaaattagccaggcatggtggcaggtgcctgtaatcccagctacttgggaggctgaggtagaagaatcacttgaacctgggacgcagaggttgcagtgagctgagattgcgccactgcactccagtctgggtgacagagtgagactctgtttcaaaaaaaaaaaaaaaaaattaagaacattaacttgtctttttgttgaaaacactttcctccattttgttacctagattttaactatttacaatagtttttgtggtttttgacttgagtttaatattttacgtaatcgagactgctactaccctttgtaatttcttatattgattttatgtttcaaaaatattccaaccaagctgactaaaaagcttatattttcatcttattaaaaaattatttttctcaatgggttctttaaatctcttaggaatgtatgctgacatatacaatgatgaaaattattttttcccaaatagtatttcccattgcattataaaataacaccgattcatttttcattagtttgtgatgccttttatcatataaattttcacatagactaggatctatgttttagagttattctaagctctattatttgtctatcaatttgtattatttttactgttattgctttatatgctttaatatataattgtagggcaagtcccctaccctactttgctctttattttcaacactttcttcgctgtttttatatatttttgtttgcttagtttggtgatgacaaattaaaaataaactacttgaccaaatagttgttagatatgtggttacaggaagtgagaacacaagtggctctagggtaaaatgtgtctaagagaatatacgaaatataaagaactagacattaatctttttttccaattatttctatcgacaattatttttaaatttaaaatgtattataaaaataataatgcttattacaaaaagaaaaaaagaaaagtaaaaaaaaaaccattgttagtactttgggtgtatttcctttcaatcttttaaaaatgcatcttttttccttgatacccaattgaaaccatagcatatatttaattttttcacctagcacaataatacatttttgagttagttttaatttataatttagtagcaacacatactttaaattcttctatatattactaagaatttaatggttaaaaggtactcaacaatcatcaggaacaaggggttttagtttgaaagagagatacctatctaagtatataccatttatttaagcaatagatactgactaaatagcactatacaaacctggcaccctgcttatcaattaagatgcaaaggtgaaacagactcagtctgttcacaatctagcagttctaggtcatctttatgaatttacatgaatgaactatgttgtaattcacaaaatcaatttcagtttttaataaaatattagtgatatatctgtatttactctgattttgaatattaccagactccaattttgaatacaaacaactaataaaagaatgatcgttttagccttattattcctggttccaaccaaaataaacgttttaagtcaaccaaagtcagtactttaaataactggaggaaggttctggagagaaagatttaattatattattctagtaccttgggtctttttctgtgtaaaagcgttcattacgtttgttatcaccaaaagtggctcgatatacgtcatgacagcgaaggttcctctggaaggtgtagaataaaacatcttcatcttcctcgtcctttacccattctgaaagaaaataatgagataattatacataatcacctacactccattaaaaaaaaaaaaaaagcacagcacattctaattttgaatgccagtgagaacatgtgcaagtttatccctggaaatctaaatatttgactgtatctaatctgtgctgtatataagccagagagctttcctgagaataaaccactactacaccattccaaggtttcaagtagttatcagtctcagggtactcaggtttctaaataagagctaaatgctcaatatttaggaaagacattggtaaagtcacatttgcttttaggaggtgaattccgtctcaatctacaacttgaaactgtaagtctgaaggaatattgcatctttctctcatgtgtaaaccttctctgtctgctttcaagccacaggatatctccaactaccaaacacaatttaatgctgattcttgatcccaccagaagctgtcaacagaagtttgcacacaattacaccatgactgccacctggctgacagtgattgtaagtcatcattgtataatatgcaccatgattttaaaggttataaaatgtacaaaatatatgtcttagaattcaatagttagggtataatttcaattcactgcaacaacatttagttaaacaatggagaaaatgatggctgaaaatgaaaagggaggacaaaatgtaacatatgtaccactcaatgataaatttaaagttagttctattactaaaaatgtcacagcttccattgataaacaggttagttcaacacataccaagttctttggtagtgactttatgctgtaacagctctataagataacatgaaattaaaaaaatacattcaagcttaaagttgaataaaatattaagatgcaacttacgtgtaaaaatttattctagataataatttggcaaataattctgataaatcaaaacatattgtatgacatggactctaattataacacttttaaaaacatgagtattttaaaattacccatctagatatataattaaataagggaaggtctcctgaataagaggtacataggaagatgtatagtccatagggatacatgaatcaggcattcaccttctccctccctcacatgcgacaaaaaaatgtttcaaaagtgttaccgttgcctttcaacacagaggactattttggttggtggcttaccaaaactggacacattcgggaaagaagcttccattacgggctgatcgctgagctttataattacacaggtagatgcttcagaatcttcagttcttatcttggcagccacatatttttcatctggagcaactctgatacaatcaatgaagggctggtctaacttaagttcctccaaattgaataaaacttcataattatcattgtctgctgtataaagaaaaatacgaaagtgataacttcaaaggatgtactttaaaaaattaaaactgtattttaatgttttaaattagaattcccattctgtaagaggccatatcctagcttctttcaacaatgatggcagcttaacttgcacatcaactgacaataagttatttaatattaccttatactattcaatactattctgtgcatcaacctatgagacattatttgatattgttatagtctagtttagtatttacagaccatacagaacctagaaagtaagtgaatataaatgacaatcaacaatatatgccaagtgcctagcatagtacccaagacacagcagatgctcaaaaaatgctggatgccgtctccattctccctgccaaagcttctgagtctaactatatcttacacaaacccagatattaaaaactagtcattaaaaaaaaattcagaaataatctttaaaaaaatcttttctctatctttgagaaattaataaatttcctataaaaaatatgaaatctgaaaattagagcacgtaaaaagaaaaattgtggtgtaccttcttcatctttggaacgaaccaagcaacaaccttcttggtaataaacaaaaccaccatgtttaacctgacaaaagaaacatgcagtttacttaataataatttaattaaccttttcatagtctgactattcaagatgaagatgaaatgaagactcttataaaaaacagacctgttgaagtatatgaatgaacacatatgaaatataaaattgaccatttttacaatgtagttgataagatatggttttcgtatgttcataaccactagaggggtttttaatacataaatacaagaggcaataaagaaaaggtataacaaaatctgtcagttctcacaactgtacaaaccacttctgctacattttagaaacatctgatacctgtacagtgggagtcaattaacagaaatcaagtggcatctttaagacaatccaaaatgatgcagatgaggaaactgtggctcagactagcctgaaaacccagtctataactttctgagactccttcctttaaaatatgctgtcaccaacaactatacacagtcttgacttaacacaaactatttcacctgctgtagggtgacaaatacaatttgaaattgagagaattaatattacccaaatataaatagtgttcttgtctaatgcctacatattaaatgtaattgattggttgatatgatttcagtggcttacgtttattatctgttagttggtggcgtaatttgaatctggagatccttattcttaacctactatttccactctactatgtatgtgattttcacctattgcggttcaattttccaatcttattgaaaaattcaattcattttttcttttttttttgagacagagtcttgctctgtcacccaggctggagtgcagtggtgcaatcttggctcagggcaacctctgcatcctgagttcaagtgattctcctgcctcggcctcctgagtggctgggactacaggcgcctgccaccatgcctaatttttgtatttttagtagagatggggtttcaccatgttggctaggctggtcttgaactcttgacctcaggtgatctgcccaccttgacctcccaaagtgctgggattacaggcgtgagccactgcacgcacagccctcaattcatttcgactgactatttatgactgtgataaccataaaatggttaaacagatacttggctttcatggtattatactacttaaagtgaattccttttattaaaaaatttagacaaaacaatcaagtaattttcaaataataacaaagtatgaactactttcatttgaacttctccttagaatgattaaaaaatttttaaatcagtgctgggcatggtggctcacacctataatctcagcactttgggaggctgaggtgggagggttgcttgagcccaggagttcaagatcagccagggcaacacagtgagaccctgtctcttgaaattttttttttttaaatcggaactgattgtttgcaaaaaccagaattaatatattacagttgaaaattcatcttactttcgatctttacatttattaaaagatgtaaaggatcacattctgtgatcacaatctctgaaatctttgctttttaagtttttcagcatattttaaaggccaaaagcagtataatcttgatgtggactatgtctctaaatcaccaagtatctcatttgcatcttgattggtaatatcaaaaatttttttttaaagacatgagatatcttacttccacattgatgatttcatattcttcttgtggctgtgtttctaattttgttctcactttttcaaatgcatccatgttttctggaaggggtttttcgttttcttgtttaacaggctgaagatcctggaaaaagttttgttatgatcaaaatatttcaaactagggaaaaaaaacttttgctttttaaagataagtaggtctataccgtagacttaacgttgtacaaaaaagaaataagattaaatagtaggtatttcacagattgtaaatgttctttcctaggctcatcaataaaatgatctttttcgttaaaaaaagtaaacaaagtaagatagacatttgatggttatactattattttagatgaataagtccttaagaagcaggaatactaagaagctcagaagaatgttcagaaatactatggggaaaatttatacacaattaaggagaaaataaaattccatgaacttttacatatttaataggaaaatcaggtagagaaaaaaatctttcgcgtttaggaagtactgaagtacttcctaaaagaagggaaatatcaaagaagtggaagacattatcactactaataaatgttcactattattttattcacagccagagtgataagaaatatttccctacttcattaactataattttttactttttaaattttttaaatttaaatgggtctgagaaccaagggatataattttcttttcttgtgggaataactaagccccaaaacagaactgtttatcacatcaaaaagtaaactggcgaggcgcagtggctcatgcctgtaaccccagcattttgggaggccaaggagaatggatcacttgagcccaggagctcaagaccagcctgggcaacatagcgagaccccgtctctataaaaaaatacaaaaaaatttagccaggtgtggtggcacacacctgtagtcccagctacttgggaagctgaggtgggagggatcacctgagcccaggaggttgaggctgcagtgaagcatgatcatgccattgcactccagcatgcagagtgagaccctgtctcaacaacaacaaaaaaaagggaattaatgcctaatgaaacagagcttctttttcagtttctttgaggaaaaataacatgttcactttatgaaaggaagaaccaggaaaaataatagaaaataatgaacatgagtggagatatagatgaaagctaaataagcattcactgtgtcttatcaagagtgactaataagctgacagctttatttgagttctggtaagcaaattaatatcatataaatcattacaatttggataaagcaaaacctgttatcaaatttaaaaactgtttaataattcaacactccagtggtttgccttgtttaagcaaaaggattctggccaagatattttacttcagctctctgccaaagatgacaattgtacagtgatttgtaccagaggggggacttaagtctttggtaaggatcgccaacagctggaaagtatttattgcataaaatatgtccatgatactttaccaacattgtagagaatgtaagctataaatacagtttatattacaaagagtttacaatctaaaattaaacacaagaatataacggaaaaatcaccaaaacaaattaaatggaaaataatcattttcacaaaggttttccttttagatttttttgggacacattattatttgaattagattaaaattagcaataatggttgttatgatagtctcaatcatttagcctctacttactatcatataattttctgaattttttttaagagacagggtctcactatgttgcccaggctggactcaaactcctgggctcaagcaatcttcctgcctcagcctcccaagtagatgggactatagataggtgtgtgcctcctcattccatacagttaattttttgagtaattatttgaagatcaaatactggaggcttatatatttatttttcattcatttttaaagcatttctacaaaatctacagttgatctttaaagtggtgagacatgatatctgtatcaataatcccctcatatcaccatcataagtcagaagatgactaaaaatctattctgaaactgtaaaatagcaataggagctgcctttgcatttctagattcaggattgtctgttctgtaatttccattaaaacttttgaagtagagtcaggattatctctctactaccctgtagcttctagcacattctaggtcatggagctgggttctgtcacttttaaatactcattcttactgagagtcatagccaacacagagccaaaagcaacagagcgggctccaaaactcatcttcttaactttacattccttcctgattaacattttttctgtcatatatccaaataaactgagcttatctgaaccaaaataactctgaaagcaataggatttttgactcccttaacgaaattcaagcagaactcaacagctttctaagtaactcttctaaaggaattactcccatggaaactgaggttttatataatattcattaagtactccaggttacttttggtttttgttgcgtcccagggatacctgctcagtgttttaagctttcatttcaatttcagctagcaatatcattagcgtacacagctaaagccatccattttagccaggtatcttagtccagttgtttcaaaggcatatactacccaatggagctgaggtaaggatggctttaccttcagattttgagaaggttactggtacagtatcactccattagtggtaaaaagaagcactccttcccactccccaagtgacccaccactaaatcattttaacaatgaaagctgttataaaatagaaggagaatgatatgtgttaactttatcatggcaaagatgctgaactctaaagatagaaaaaatggtgaagtagaaagacaccggacagcccttcagtcaagactaattagccattagtaaatggctaattctaaggctagagcagggagaaaatacatggtaggtttgggaaatcttatgccagaaaataaggaagtgctcaaagtttaatggagacatgtcaaaagaatacaagtgtcaactgaaggggtttctacaggccacattttggacaactggagcctcaaaaagaataataaataataaataatacattgaaaaaacataaatccacagcaattgaaaaacagaatgcaatatgaagcatttcaatttaggaaaacagaaaaagagtaagtcttaaggaagtagaagaaaggtaagaaaattaatttttgaaattaaattgataacaaagaaactaaagagaatcaaattaaaagttggttcttttagaaacctattaaaaaacaaacatcacaaaactgatagaaaaaagaatacgaggccgggcgcggtggctcacgcctgtaatctcggcacttcgggaggccaaggcgggtggatcacgaggtcaagaaaaaagaatacgaggagagaaaaaggcataattacagatacaacagagatttttaaaaattacaataagctttatgtgaatctatttgaaaataaatgaaatgggtaattttccaggaagaaaaattaccaaaattgacccaagaaatagaaaagctatataagtcactaactcttaaagaaattaaattgctaactaaatgtccccttcttgaaagaaacaccaagcccagatgctttcaaatgtagctttcttggatcttcaagaaacagctaatcttttcatacgtcaactatttaaaaaaatagtaaaagaggtaaaactactcattttattaggctaatataaccttgacatcaaaattagacaatgatgatatgagacaattaaaaaaatcaatcttattctaaaataaaacttgataaaatcaaatttttaattttaaaaagcacaaaataagaacagtaatagtaataccaattaaacttaatgtgaccaagaaggattttttcctaagaatgaaaggatggtccaacatcagaaaaaaatctatcaatgtaatctaacacaaataaaggagataaatcttagagccatttttgataaatgcagggaaaaaataaaaaataatcacactttaaaaaaatgataaaaccttaaattaggaatagagaggaacttccttaatagtttctgtcagttatcttacacagaaatatactaaatctgtaatcaaaatacctgaaattaattcatattagcatatacatggtatttagcaaccatgaaacaccaatgagatttccaaaattttaataatgttcatgtaaaacaactaattgtatttgctgttaactcattttattttttaaaagcaactgttaaatgaaggaaacttgttcctttcatcttctgcctccaattcttctccttaccccttctctagagcccagacttttgctcttcttatgccactgactgctcctgtcaaggtcactcaatggctaccacattgcaaagtgcaaaagttaatgttcagtattcatattacttgacctgtcaggatcatgatacaattgatcacttcctcctcctaaaaacacttttctttacttggcttccaggacacctcattctccttgttttcctcttacttcactggcccttccttctcagtatctttagctagttccttctcaactccctggctttttttttgtttgagatgggatttcggctccctgcaacctctgcctcctgggttcaagcgattctcctgcctccgcctcctgagtagctgggattacaggcacttgctcaccacgctggctaatttttttttttttttttgtatttttagtagagatggggtttcaccatattggctaggctggtctgaaactcctgacctcaggtgaaccacccgcctcagcctcccgaagtgctgggattacaggcgtgagccactgggcctggcatctccctggctttttaacactggcagagctcaattcctgcactaagtacttctcttctttgcagtctgcactaattcccttggtgatctcatccagtcatgaccttaaataccatttatatgctaaggactcccaaatttacagctgtagcctgaacaatcctgaccaagatgaacttgtatatccaactgactacccaacatttttacttagatgtctaatatgccaaaaaatgtccgaatctgaactttaaatctccccatatatccctcgccctattaaaaaaaaaaaaaacaaaaccctgttctccaggcaatctttccaatttacataaatgacaaatctgtcctcccagctactcaggcttaaaaacattacagttggatttgtctttttctcttgccacaaacaactggtctgctaaatcctctcaattctactttcaacatatatttagaatctgaccacttctcacacttggactggactacttggctagtatcatcatcatttctcccttggattactgcaaaagcccaaaagctttctctgcttctgcgcttgcctcctggtctattttcaacaaaggagcttgtgtgagtctgaagtcagattatgttactccactcaaaaccctccagtggtttcccatcttgctcaagaggaaaagcaaaaattcttacaatggtctacaaagtcctaaagaatcttgtcccattacattgctgacctaatctactgctacacgccaagcccacttattccagttaatccatacttgatgtttcttgaacatatcaagcttgctcccatatcagtttcttagaacttgggccctatgcccaaatacctccttaaagctattgctcaaatgtcatcttctaagttaggcctttcctaaccattttactaaaataacacccctccctatccccacactgcctattcacatcttccccgtcttttttttcttttcttcttcgccataactatcgcttttgacccactttgtatttcattcatgtaattctttttatttttttgagagatgaggacttgcttgtgtccacctcagctggagtgcagtggcatgatctcggctcattgcaacctctgcctcctgggctcaagcaattgatccttgatctcagctctcaagtagctgagactacaggcgccaccatgcccagctaatttttgcattgtttgtagagacagggttttgccatgttgcccaggctgttcttgaacttctgggctcaagcaatgagcccacctcagcctcccaaagtatattacaggcatgacccattgcacctagccttgttcatgtaattctttattctttctcttttcctttctcaagtaggatggtaagcttcacaaaggcagggatttttgtttattttgttcagtgttatatctccagtgcctagaatggtgcatagcaggtgttcaacaaatatttgctgagttgaataaaattcagacagcataaaacataaaatgaaaaaaacatatttaacaaaagatatcacaaagtgaaaaaaataataatagaacaaatatggagaagatatctacagcacatataaaagacaaaggacacgtaaagaaatcttatgaatcagtaagaaaaggacagacaattaaaagaaggtcaaaagacaagaataggcattcaagaagaaaaactataggatcaataagtgtaagaaaagatgctcactggccatgagtggcagctcatgcctgtaatcccagcactttgggaagctgagacaggaggattgcttgagcccaagagcttcagaccagcctgggcaacatagcaagactctgtctctatttaaaaaagttttggattttggagcatttcagattttgtattagggatggtctacctgtactacaagatattaaaaaagaaaggtactgtgaatgaggctaacttaggtctacttctgactctactagttttcttacttaactttaggctctgtggctttagtttcttcatttgtttagaaagaatacacacgcttcctgattttaagacttattacaggccaggcgcagtggctcatgcctgtaatcccagcactttgggaggccaagttgggcagatcaccctgaggtcaggagtttgagaccagcctggccaacatggtgaaaccctgtctctactaaaaataaaaaaaaaattagctgggcatggtggcaggcacctgtaatcccagctactcggggggccttggcaggagaattgtttgaatctgggaggcagaggttgcagtgagctgagatggcaccactgcactccaacctgggcgacagagcgagactccatctcaaaaaataaataaataaataaataaaacttattacaaagctatagtaattaaatgtgtagtactggcataacgacagacatatacaaaaatgagatgaaagtgagagtcaagaataaaccattgaatttatggtcagttgattttcagaaaggacaccaagacaattcaatggaaaaagaacactcttttcaacaaatgttgctcagacaatggatatccacaagcaaaataataaagttgtaccccaatcccttgcactataaacaaaatgaactcaaaatgggtcatagggctgggcatggtgggtcacacatgtaatgccagcactctgggaggctgaggcaggaggattacttgagcttaggagtttgagacaagcccgcacaacaaagtgagaccctgtctccacacacacaaaaaatcaaaaaattagctgggcatagttgtgggcccagctacttgcaaggtaaggcaggaagacagcacgagcccaggaggttgaggctgcagtaagccatgtttgtgcctctgcactccagcctgagcaacagagtgaggccctctctcaacaacaacaacaacaaaaaaagtatcaaagacctaaagaaagagctcagatgggatgatttctggggtatgttttctagcaataaaatttatggttatatgaaaagaaaaaatgcattaatttaactattaattcattctataaacacgttgcttatctacaatgtggcagtcgttatgctatgtgctggcaagatgtgtattataaaattcttgtctttaaggacctcccaatataatggggagacaggaaaagtttaaaatgatgtagtaatagcagagaggtaaatatagtgatttgactcctatggcttcaactactatctacatgtaacaactctccccaaattccagactcatatatccaactgctactgaaatctccactttactagtgagttatatttatcctttcctcctctcttttttttttttgagatggagcctcgctcccatcacaccaggctggagtgcagtggcacgatctcagatcactgcaatctccacctcccgggttcaagtgattctccttcctcagcgtcccgagtagctgggattacaggcatgcgccaccaggcccggctaaaatttttggattttcagtagcaatggggttctgccatgttggtcaggctggtcttgaacttctgacctcaggcaatccacccgcctcagcctcccaaagtgctaggattataggcgtgaggcgccacgcccggccttcttcacccttaagatctgaatatcagtaagattacatacatgactgtgaaataagtccatctgaaacataaagataaaccaggtacgttttagaattttgagattttggaatgttaactgggtaccttatctcagtttacaggggaacaacactctaatcaaatgcagtaacattttagagctaaacatctactaattgggataaagatcataatagctttgtgtcagtttaggtcaggttttgcccattctcaacagcctccaatcagttaaaaaaaatcatttgttttctaacaggcttttggattttagaatccaaagagatgaggaattatcactcaagctctctagtcttccattaagatgtctcaaataaaatgtaatcagggccagctgcggtggctcatgcctgtaatcccagcactttgagagggcaaggcaggtggattgcttgaggctgggcttccagaccagcctagccaacatggcgaaaccctgtctctacttaaaatataaaaaaattagctgggtgtggtggcacatgcctgtaattccagttactcaggaggctaaggcacgagaatcacttgagcctgggaggtggaggttgcagtgagcagagactgtgccactgcactacagactgggtgacagagtgagacactgtctcaaaaaaaagcaatcaccctgtaaagactctcatcttcactcatctgagttactgacaaggcttcctacttccaatttattctctattctgtcagagtgattcttctaaaatgcaaatctgattgcgcctacatttttcaataacattctattgcttaaaaggatgtagctcaaactttttgcaagatatacaaaactacatattatatatatatatatatatatatatatacacacacacacacatatgaatatgagactattgcaggagctgctaacctgtattgtagaaataggcaaatgacatgtttaaccaaaggatttagtcttctctctttaattatacaatttcattttgtatcttgttcaaattatcactattaaagattttgggaattattttttaggcagagcagagcaggatgatgtggaagataaagaaatgtgatatctggatggatggatgctagtctttgaatatcactggctggcttgtaagtataatagagtaagttcatcttgccatctggctaatgtaaaatggaaagcagaggtacttgccaataagaactgcagaactgaatgaattcaataaggtttagatcggcaacacttgatcatcaaacatttccaatttctaaattcaggtccagtgtcagtcaagttgtgagttccagaattacctgatgtgaacttcaaaaaacagatctggggccgggcatggtggctcactcctgtaatcccagcactttgggaggccgaggcaggtggatcacctgaagtcaggagttcgagaccagcctgaccaacgtggtgaaaccctgtctctactaaaaaatacaaaaaaatttagctgggcatggtggtggacgcctgtaatcccagctacttggcagctgaggcaggagaattgcctgaatctgggaggtggaggttgcagtgagccaagatcatgccattgcactccggcctgggcaacaaagcaagactccgtctcaaacaaacaaacaaacaaacaaacaacagatgtgtaggcctcaaccatagagattttcattacgcagatgtggggtgagatccaggaatccgcatttctaaaaagctctccaggatttctgatatacagttagactgcagaagttgatactgaagagtccccaaacttttaggcagtaatttgttgctaaggtaacaagaggtatagaatcatgaaattttagcacctctaagactttctacagaatgacaagttgaaactccctatttttttttttttgagacagggtatccttctgtcacccaggctgaagatctcactgtgcctcaacctcactgcagcctcgacctcccaggctgaatcaatcatcccacatcagccttccaagcagctgggattacaggcgtgcgccaccatacccagctaatttttagtctttttggtagagttggggttttgccatgttgccaaggctggtctcgaattcctgagctcggacaatctgctcgccttggcctcccaatgttctgggattactggcgtgagccagtatgcctgatcagaactccctatttttttcagtcaggaaaattaggagtcctgattagttcagtcacaccaatcgtggctggatcttttgccttctaacattcccactacacatgctacttttctgttccttagttaacttatataggtaatagctctttaagcagacattttaatttacctaaaagcagtaactactttttctactttattacaccctataaaagtggacagagttggaaatcagtggatgcttgctgaaagaaggaaatgtgcattcttctctacaggtgttttcacagctgccggggcatctttataaagcttccccaggtctcagtgataaagaccatggcttttacattacatcatttctcatagagggaatggttgatacatgacatgtgacagcaggattactttatcaggtaaaggaattactaaatgaactattaatacttggagttattgagtcaggttaaagtttccaggtagtgggaatctataaaagagaacggaaaagttgcttcaggaacaaatggagggaagaaatagtcaaccttctgtttagaatgtgagctaatatcacagctgttactctgatggtaattcctgtctactatttataaactaagtgttaagacaaagtacgacatgacaaaatgttctaaacacaatgcaaaataaaataacctaaaggtccaaaatttagttcaataggtgaaattaaaaattttatctttctgaagtaggaaagatgtacaaaaaacacaaaaatgaaataaaaagaagttataaagaatttctaaatgagtaaagaaagtactaaactaaggcaagacactacaaaaaggaaaagaatttcaaagactaaaacataaacagtaaaagtctaggaagactagggggctaacatataaaatgttaaaagcaaaagagacacacacaacacctaaataggtatcagctaagatagcggcaaaaattgaacaaaaactagaaaaactgagaaaaattagattgaaaagatagtttctaaaatgagaagaatctgcccaagtgtccatcaattacaggaatggataaacaaaatgtggtttatacatacaaaggaatattattcaactataaaaagaaatgaagttatgatacatgcatacaacacagatgaactttgaaagccactgaattgcatactttaaaatggatcaagtggaaaactttgttatacatatattttacccgaagaaaggaggaagccaaaacagactaaaagaaaaatcagtatgcgacaaaaccagaaattaaaataaaaaaaatattaaaatcataaatttgtgaaactattgcaagaataccacccccaaatatcattaaggaacctaaggaacataagaagtaaaaggtaggagagggatgtcaaagcagcagcagcacaaatagatcatttaatcctacttactgtaggatgaccatataatttaccattctaaccaggacacttttgagaggaaaggggacactattaataattacacagggacaacaggtgtaggctggagctgtgccaggcaaaagtggttatgtggttactctctatataagggcaatcaggtccttaaggttgagttcacgcccacagcttggggtctggcagaagtacaatactctgacagtgtcttcctgaatgactcaagtggtcaaaaacgcaagattatttttcatttttttacagagaaataaaatacaattcatggcctttactgaagtttactgatttgtgattcataaaacaattagcgtatcattagattttattaagagctataatttagtgttctaggaaatttagaaggccgaattatactttgaaatgcactggcaggcatactaaggaagtcctgaggtgaatcattttttataaacctacatttttatatattacattagagccctataaatatatgtatacactttttttttttttttttttttcagacagagtctccctgtcacccaggctggagtgctgtggtgcgatctcagctcaccgcaacctctgcctcctgggttcaagagattctctgcctcagcctcccaagtagctgggattacaggtgggtgccatgacgcctagctaacttttgtatttttagtagagacagggttttaccatgttggccaggctggtctcgaactcctgacctcaggtgatctgcctgcctcgatgtatatactcttttatacttacttttgactagagacaattgagacttgaaaattagaaaaatcaagttagaattactgagaaaattagtagctctgatattctacccattctttatttttaaattaaaattaatcttaatgacctacaaataggttaacttaaacagtccataccttacatgagaagctccgacttgggatgtttcttgctaactctgatatcttgggtttattctgaagacacttggttaggtgatattttttcaattttattctattgtaacaatgatcagcgaagttatagtgattcaaatgctgtttctgcatgcattttccaaggtgaggaatactatacttcaaagcttggagaaataatttggtcttctgctgcatgatatcaaagtccctggtttatgctccttttggggctgccagcacacgaatgattttataggtatgattacagagtagtgggttctcagagtaactaagatcagcagttctcatccctccttttcagggccatgccccacttaggttatgaataacttcagacagctgataacttaggctaactaaatctaaaaacctgtgtaagttaaagtttcattcaaatcataattcttggcagatgtgacttaaatgtctcatttgtaaagttaatcctatcaggctcaaactatgcagcactgactctggcacacataggggttaaactaaaacaaaaaacaaaacaagaaacaaaatataaatttgcaaataagtacacagacttaatggggtatctcaggaactcagggctgtaaaaggtaaaaagccctttggtcttacataattatgaacgtatctttggtatatatgtggaagataaactggaaaagcctaattatttaataaaggtgggggagggaagattaattattgttgagtgttaactaactgccaggtgcttttatcttgtttgtctaatttaaattttatatggacttaataaagtagatattaccatgcacattttacaggttgccaaactgtggctgtgggaggttctaagcaactgttccaggtcacttgtacagtaagctgtatagcaaaaaatccaatttggttcggttccaaatactggacatactcaacttcggatttttaatgttaaaaaggtatttagcgctttaattaaaaacaacaaaaaacccctgcaagatgcacaaataaaatgtaaggccatctctggtttgtcaggaggtagcttttattaaccttgattgctaataagtagttaagagtcagagagacctgggttgaggtcttagctcctacacttaactgtgtctccgggcctcagtttcttc
